United States Patent 11,602,557 (BUNYAVIRALES VACCINE) - sequence listing, part 14

SEQ ID NO: 15375 - RNA, 3495 nt, Artificial Sequence
  derived and/or modified CDS sequence (opt11) from CCHVF(CCHVF 88166)__AB069675.1__Gn-NSm-Gc
ucggaggaguccggcgacgacugcaucagccgcacacagcugcuccggaccgagacggccgagauccacuccgacaacuacgggggcccuggggacaagaucaccauaugcaacggcagcacgguggucgaccagcgccucggauccgagcugggcugcuacaccauuaaccgggucaagagcuucaagcucugugagaacucggcuacgggcaagagcugcgagaucgacucaaccccggugaagugcagacagggguucugccugaagaucacccaggagggccgggggcacgugaagcugagccgcgguuccgaaguggugcucgacgcgugcgacagcuccugcgagaucaugauccccaaggggaccggagacauccuggucgacugcagcggcgggcagcagcacuuccugaaggacaaccucaucgaccuuggaugccccaauaucccccuacucgggaagauggccaucuacaucugccggauguccaaucacccgaagacgaccaugggcuuccuguucugguucagcuucggcuacguagucacgugcauccugugcaaagucaucuucuaccuccugaucgugguggggacccugggcaagaaauucaagcaguaccgcgagcucaaaccccagacgugcaccauaugcgagaccacccccgucaacgccaucgacgccgaaaugcacgaccugaacuguuccuauaacauaugucccuacugcgccagccgguuaacguccgacgggcucgcucgccacgugaugcaguguccgaagcggaaggagaagaucgaggagaccgagcuguaccugaaccucgagcggauccccugggugguccggaaacuucuccaggugagcgagagcaccggcguggcccucaagcgcuccagcuggcuggucgugcugcucgugcuccugacggucucccucagccccgugcaguccgcccccauagggcacggcaagacgguggagaccuaccagacccgggagggcuacacuagcaucugccuguucguccugggguccauccucuucaucgugagcugccucaugaagggccuggucgacuccguggggaacucuuucuucccgggccucuccaucugcaagacguguagcaucggguccgugaacggcuuugagaucgagagccacaagugcuacugcagucuguucugcugccccuacugccgccacugcagcgccgaccgggagauccaccgccugcaccucuccaucugcaagaagcggaagaccuggagcaacgucaugcuggcgguguguaagcgcaugugcuuccgggcuaccguggagguuuccaacaaggcacugcucauccgcaacauaaucaacaccacguucguacuguguauccugauacucgcggugugcgucgucaguaccagcgccguggagauggagucccugcccgccggcaccugggagcgcgaagaggaccugaccaacuucugccaccaggagugccaggucacagagaccgagugucugugccccuacgaggcccucguguugagaaagccgcuguucagcgacuccaucgucaaaggaaugaagaaccuccugaacagcaccucccuggagaccagccucuccaucgaggcccccuggggcgccaucaacguccagagcacguucaagccaaccaugucggccgcgaacauugcccugagcugguccagcguggagcaucgcgggaacaagauccugguguccggccgaagcgaguccaucaugaaacucgaggaacgcaccgggaucagcuggaaccugggcgucgaggacgccuccgaaagcaagcugcucaccgugagcgugauggaccugucccagauguacagccccgucuucgaguaccuguccggcgaccgccagguugaggaguggccgaaagcgaccugcacgggcgauugccccgagcggugcggcugcaccagcuccacauguuugcacaaggaguggccccacagccggaacuggcgcugcaaccccaccuggugcuggggcgucgguacgggcugcacgugcugcgggcuugacgucaaggaccuguucaccgacuacauguuuaucaaguggaagguggaguacaucaagaccgaggccaucgugugcgucgagcucacgagccaagagcggcagugcacccugaucgaggccggcacccgcuuuaaccuggggccggugaccauaacgcucagcgagccccggaacauccagcagaagcugccgcccgagaucgugaccuuacacccccgcaucgaggagggcuucuucgaccucaugcacgugcagaaggugcuguccgccucgaccgugugcaagcugcaguccugcacccacgggguccccggcgaccuccagguguaccacauuggcaaccugcugaagggggacaaggugaacggccaccucauccauaagaucgagccccacuucaacacgagcuggauguccugggacgggugcgaccuggacuacuacugcaacaugggcgacuggccgagcugcaccuacaccggggucacccagcauaaccacgccgccuucgugaacaugcuaaacaucgaaacagacuacaccaaaaacuuccacuuccacuccaagcgggugaccgcacacggcgacacgccccaguuagaccugaaggcgcgccccaccuacggcgccggcgagaucaccguccuggucgagguggccgacauggagcuccacaccaagaagaucgagaucagcggccucaaguucgccucccugaccugcacggggugcuaugcgugcagcuccggcaucagcugcaaggucagaauccacguggaugagccagacgagcugaccgugcacguuaagagcgaggacccggaccugguggccgccuccagcucccugauggcccgcaagcucgaguucggcaccgacagcaccuucaaggccuucuccgccaugcccaaaacgagccugugcuucuacaucguggaacgggaguauugcaagagcugcagcaaggaggacacccagaagugcgucaacaccaagcuggagcagccccaguccauccucaucgagcacaagggcaccaucaucggcaagcagaacaacacgugcaccgccaaggccagcugcuggcuggaauccgucaagagcuucuucuacgggcuaaagaacaugcucuccggcaucuucgggaacguuuucaucggcguguuccuguucuucgcccccuucauccugcucauccuguucuucauguucggguggcgcaucuuauucugcuucaagugcugccggcgcacucgcggccucuucaaguaccggcaccucaaggacgacgaggagaccggcuaccgcaagaucaucgagcggcugaacaacaagaagggcaagaacaagcucuuagacggagagcggcuggccgaccggaagaucgcggagcuguucagcacuaagacgcacaucgga

SEQ ID NO: 15376 - RNA, 3495 nt, Artificial Sequence
  derived and/or modified CDS sequence (opt11) from CCHVF(CCHVF BA88166)__AF338470.1__Gn-NSm-Gc
agcgaggaguccggcgacgacuguaucagccgcacacagcuccuccggaccgagacggcagagauccacuccgacaacuacggcgggcccggggauaagaucaccaucugcaacgggaguaccguggucgaucagcgccugggguccgagcucggcugcuacaccaucaaccggguuaagaguuucaagcucugcgagaacuccgccacgggcaagagcugugaaaucgauuccaccccggugaagugccgccagggguucugcuugaagaucacccaggagggucggggacacguaaagcugagccgcggcagugaaguggugcucgacgcgugcgacagcucaugcgagaucaugauccccaaggggaccggcgacauccuggucgacugcagcggcgggcagcagcacuuccugaaggacaaccucaucgaccugggcuguccaaacaucccccuacucgggaagauggccaucuacaucugccggaugagcaaccaccccaagacgaccaugggauuccuguucugguucagcuucggcuauguggugaccugcauccugugcaaggggaucuucuaccucuugaucgucguggguacccuagggaagaaguucaagcaguaccgcgaacucaagccccagacgugcaccaucugcgagacaacccccgugaaugccaucgacgccgagaugcacgaccucaacugcucuuacaacaucugcccuuacugcgccagccgguugacguccgacggccucgcgcgccacgucaugcagugcccgaagcggaaggagaagaucgaagagaccgagcuguaucucaaccucgagcgcaucccuuggguggugcggaagcugcugcaagucagcgagucgacggggguggcucucaagcgcuccucauggcucgugguccuacugguucuucugaccgucucguugagccccguccaguccgcccccaucggccacggcaagacgguagagaccuaccagacccgggagggcuacaccagcaucuguuuauucguguugggcaguauucucuucaucgucagcugucugaugaaggggcugguggacuccgucggcaacagcuucuucccggggcucucaaucugcaagacguguagcaucggcuccgugaacggcuucgagaucgagagccacaagugcuacugcagucuguucugcugccccuacugucgccacuguagcgccgaccgggaaauccaccgcuuacaccuguccaucugcaagaaacguaagaccuggucaaacgugauguuggcagucugcaagcgcaugugcuuccgggccaccguggaaguguccaacaaggcccugcugauccgcaacaucaucaacaccacguucguccugugcauucugauccucgccgugugcguggucagcacgagcgccguggagauggagucccugcccgcggggacgugggagcgcgaggaggaccugaccaacuuuugucaccaggaaugccaagugacggaaaccgagugccugugccccuacgaggcccucgugcugagaaagccgcuguaccuugacagcaucgugaagggcaugaaaaaccuguugaacuccacaagccucgagaccucauuaagcaucgaggcccccuggggcgccaucaacgugcaguccacguucaagccgacaaugagcgccgcuaauauagcccuguccuggagcuccgucgagcaccgcgggaacaagauccucgucagcgggcgguccgagagcaucaugaagcuggaggagcgcaccggcauuuccuggaaccugggcguagaggacgccagugagucaaagcuccugaccgucagcgugauggaccugagccagauguauucccccguguucgaguaccucagcggggaccggcagguugaggaguggccgaaggcgacaugcacgggcgacugucccgagcgcugcggaugcaccuccuccacgugcuugcacaaggaguggccgcacagccggaacuggcgcugcaaccccacuuggugcuggggugugggcaccggguguaccugcugcggccuggacgugaaggaccuuuucaccgacuauauguucaucaaguggaaggucgaauacaucaagaccgaggccauagucugcguggagcugacaagccaggagcggcagugcacccugaucgaggccgggacccgcuucaaccucggaccggucauaaucacccuguccgagccccggaacauccagcagaaacuuccgcccgagaucgugacgcuccaccccaggaucgaagaggguuucuucgaccugaugcacgugcagaagguccugagcgccuccaccgugugcaagcuccagagcugcacgcacggcgugccaggcgaccugcaggucuaccacaucgggaaccuguuaaagggcgacaaagugaacggucaccugauccacaagaucgagccccacuucaacacguccuggaugagcugggacggcugcgaccuggacuacuauugcaacaugggggacuggccuuccugcacguacaccggcgugacccagcacaaccacgcugccuucgugaacaugcucaauaucgagaccgacuacacgaaaaauuuucacuuccacagcaaaagggugaccgcccacggcgacacgccccagcuggaccugaaggcgcgccccaccuacggggcgggcgagaucaccguacucgucgagguggccgacauggaguuacacacgaagaagaucgagauauccggccugaaauucgccagccugaccugcaccggcugcuacgcgugcaguagcgggaucuccugcaaggugcggauacacgucgaugagcccgaugagcugacggugcacguuaagagcgaggacccggauauaguggccgccagcuccagccugauggcacgcaagcucgaguucggcaccgacuccacauucaaggccuuuuccgcgaugcccaagacaucccugugcuucuacaucguggaacgggaguauugcaagagcugcuccaaggaggacacgcagaagugcgugaacaccaaguuggagcagccacagucuauacucaucgagcacaagggcaccauaaucgggaagcagaacaacacgugcaccgccaaggccuccugcuggcuggagagcguaaaguccuucuucuacggccugaagaacaugcucagcgggaucuucgguaacguguuuaucgggguguuccuguucuucgcccccuucauacugcucauccuguucuucauguucggcuggcgcauccuguuuugcuucaagugcugccgccgcacccgcggcuuguucaaguaccggcaccuaaaggacgacgaggaaacaggauaccgcaagaucaucgagcggcugaacaauaagaagggcaagaacaagcuccuggacggagagcgccuggccgaccggaagauugccgagcucuuuuccaccaagacccacaucggc

SEQ ID NO: 15377 - RNA, 3495 nt, Artificial Sequence
  derived and/or modified CDS sequence (opt11) from CCHVF(CCHVF BA66019)__AF350448.1__Gn-NSm-Gc
ucugaggaguccggcgaugacugcaucagccgcacccaacugcuccggaccgagacggccgaggugcacggggauaacuacggcgggccgggcgacaagaucaccaucugcaacgggucuacgaucgucgaccagcgccugggcagcgaacugggcugcuacaccaucaaccgggugaaguccuucaagcuaugcgaaaacagcgggacuggcaaguccugcaagaucgacaagcacccggugaagugccgccagggauucugccugaagaucacccaggagggccgggggcacgucaaacugagccgcggcucggagguggugcucgacgccugcgacagcuccugcgaaaucaugauccccaagggaaccggggauauccuggucgacuguagcggcgggcagcagcacuuccuaaaggacaaccucguggaucucggcugcccaaacaucccccugcucggcaagauggcuaucuacaucugcagaauguccaaucacccgaagaccacaauggccuuccuguucugguucagcuucggguacgugaucacgugcaucuucugcaaaaucauauucuaccugcucauugucgugggcacccuggggaagaaguucaagcaguaccgagagcugaagccccaaaccugcaccaucugcgagaccacccccacaaacgccaucgacgcugagaugcacgaccucaagugcuccuacaacaucugccccuauugugccagcagauuaacgucggacggcuuggcgcgccacgugacccagugcccgaagcgcaaggagaaagucgaggagaccgagcucuaccugaaccuggagcgcauccccuggaucgugcggaagcuccuccaggugagcgaguccaccggggucgcccugaagagaagcagcuggcucaucgugcuguuagugcuccugacggucucccugagccccguacaguccgccccgaucggccacggcaagaccaucgaggccuaccaaacccgggagggguacaccagcgugugccucuucaugcuuggagggaucuuguucgucguguccugcuugaugaagggccugguggacagcgucuccaacagcuucuucccggggcuaaguaucugcaagacgugcagcaucggauccgugaacggcuucgagaucgagucgcacaagugcuauugcucccuccugugcugccuguacugcaggcacugcagcgcggaucgggagauccaccagcuccaucuguccaucugcaagaagcgccgggccgggggcaaugucaugcuggccgugugcaagcgcaugugcuuacgggccaccauggaggugaguaacaagguccuguucauccgcuccaucaucaacaccaccuucgucaucugcauccucgugcucgccgugugcauagucagcacguccgcgguggagauggagagccuacccgccgggacaugggaacgugaggaagaccugaccaacuucugccaccaggagugccaggucaccgagacggagugccugugccccuacgaggcccucgugcugcggaagccccuguucagcgacuccauuguuaagggcaugaagaaccuccugaacaguaccucccuggagaccagccucuccaucgaggccccguggggcgccaucaacguccagagcaccuucaagcccacgguguccaccgcgaacaucgcccugagcugguccagcguggagcacagggggaacaaaauccuggucuccggccggagcgagucaauaaugaagcucgaggagcgcaccgggauaagcugggaccugggcguggaggacgcgagcgagagcaagcugcucaccguguccgucauggaccugagccagauguacucccccguguucgaguaccuguccggggaccgccaaguggaggaguggcccaaggcgaccugcaccggcgacugcccggaccggugcggcugcaccagcuccacgugccuccauaaagaguggccccacucgcggaacuggcgcugcaaucccaccuggugcuggggcgucgggaccgggugcacgugcugcggccuggacgugaaggaucuguucaccgacuacauguucgugaaguggaaggucgaguacaucaagaccgaggccaucgugugcguggagcucaauucccaggagcggcaguguagccugaucgaggcggggacccgcuucaaccugggccccgucaccaucacccuauccgagccgcgcaacauccagcaaaagcugccgcccgagaucaucacccugcacccccgcaucgaggagggcuucuucgaccucaugcacgugcagaaggugcugagcgccuccacggucuguaagcugcagagcugcacccacggggugccuggcgaccuccagaucuaccacaucggcaaccugcugaagggcgaccgggugaacggacaccucauccacaagauagagccccauuucaacaccucuuggaugagcugggacggcugcgaccuggacuacuacugcaacaugggcgacuggcccuccugcaccuacacaggggucacccagcacaaucacgccgccuucgugaaccugcuaaacaucgagaccgacuacaccaagaacuuccacuuccacagcaagcgcguuacggcucacggcgacacgccgcagcuggaccugaaggcgcgacccaccuacggggcuggcgagaucaccguccuaguggagguggccgacauggagcugcacacgaagaagaucgccauuuccgggcugaaguucgcuagccugaccugcaccggcugcuacgccugcuccagcggcauauccugcaagguccgcauccacguugaugagccagacgaguuaaccgugcacgucaagagcgaggaccccgauauuguggcggccagcuccagccucauggccagaaaacucgaguucgggacggacuccaccuucaaggcguucagcgccaugccgaaaacuucccucugcuucuacaucguggagcgcgaguacugcgagagcuguuccaaggaggacacccagaagugcguuaacacgaagcuggagcagccccagagcauccucaucgagcacaaaggcaccauuaucgggaaacagaacgauacgugcaccgccaaggccuccugcuggcuggagagcgugaaguccuucuucuacggccugaagaacaugcucucugggaucuucggaaacguguucaucggcaucuuccuguuccuggcccccuucauccuccugauccuguucuucauguucggguggcggauccuauucuguuucaagugcugccgccgcacccggggccuguuuaaguaccgcuaccugaaggacgacgaggaguccggguaccggcgcauuaucgagaggcucaacaacaagaagggcaagaacaagcugcuggacggcgagcgccucgcggaccggcgcaucgccgagcuguucagcacuaagacccacaucggg

SEQ ID NO: 15378 - RNA, 3495 nt, Artificial Sequence; identical to SEQ ID NO: 12092
  derived and/or modified CDS sequence (opt11) from CCHVF(CCHVF BA8402)__AF350449.1__Gn-NSm-Gc

SEQ ID NO: 15379 - RNA, 3495 nt, Artificial Sequence
  derived and/or modified CDS sequence (opt11) from CCHVF(CCHVF Matin)__AF467769.2__Gn-NSm-Gc
agcgaggaguccggcgacgacugcaucagccgcacccagcugcuccggaccgagacggccgagauccacuccgacagcuacggcggccccggagacaagaucaccaucugcaacggcucgaccguggucgaccagcgccuggggagcgagcuaggcugcuacaccaucaacagagugaaguccuucaagcucugcgagaacagcgccacggguaaguccugcgagaucgacuccaccccggugaagugucgccagggguucugccugaagaucacccaggagggccggggccacgucaagcugucccgcggcagcgaggugguacuugacgcgugcgacuccucaugcgagaucaugauccccaaggggaccggcgacauccuggucgacugcuccggcgggcaacagcacuuccugaaggacaaccucaucgaccucggcugcccaaacauuccccugcucgggaagauggccaucuacaucugccggaugagcaaccauccgaagacgaccaugguguuccuguuuugguucuccuucggcuacgugaucacgugcauacugugcaaggucaucuucuaucucuuaauaguggugggcacccuggggaagaaguucaaacaguaccgcgagcucaagccacagacuugcaccauaugcgagaccaccccggucaacgccaucgacgccgagaugcacgaccugaacugcagcuacaacaucugcccuuacugcgccucccggcugacgagcgacggccuagcacgccacgugaugcagugcccgaagcggaaggagaagaucgaagagaccgaacuguaccugaaccucgagcgcauccccugggugguccggaaguugcuccaggugucugaauccaccggcgucgcgcucaagcgcagcagcugguuagucgugcuguuggugcugcugaccgucagccucucgcccgugcagagcgcccccaucggccacgggaagacgguggagaccuaccagauccgggagggcuacaccuccgucugccuguucguucugggcagcauccucuucaucguguccugccugaugaaggggcugguggacagcgacggcaacuccuucuuuccgggguuaagcaucugcaagacaugcuccaucggcagcaucaacggguucgagaucgaaucccacaagugcuauugcagccuguucugcugccccuauugccgccacugcuccacggaccgagagauccacaagcugcaccucagcaucugcaagaagcgcaagaccggcagcaacgucauguuggccgucugcaagcggauguguuuccgcgcgaccguggaagugucaaacaaggcccugcuaauccggucuaucaucaacaccacguucgucgugugcauccuuauucuggccgugugcgucguguccaccucggccguugagauggagucccuccccgccggcaccugggagagagaagaggaccuuauaaacuucugucaccaggagugccaggucaccgagaccgagugccugugccccuacgaggcgcuggugcuccguaagccgcuuuuccuggacagcaucaucaaggggaugaagaaccuccugaacuccaccagccuggagacgucccucagcaucgaggcccccuggggcgccauaaacgugcaguccaccuucaagcccacgaugagcgccgccaacaucgcgcuguccuggagcuccgucgagcaccgggggaacaagauccuggugagcggccgcuccgagaguaucaugaagcucgaggagcgcacagggauauccugggacuuaggcguggaggacgccagcgaaagcaagcugcucaccgucuccgugauggaccugagccagauguacuccccuguguucgaauaucugagcggcgaccgccaggucgaggaguggccgaaggccacuuguaccggggacugccccgagcggugcggcuguacguccagcaccugucuccacaaggaguggccccacucccguaacuggcggugcaaccccaccuggugcuggggcguggggaccggcugcacgugcugcgggcuggacgugaaggaccuguuuaccgauuacauguucgucaaguggaagguggaguacaucaaaaccgaggugaucgucugcguggaacucaccagccaggagcgccagugcucccugaucgaggccggcacgcgguucaaccuggggccggucaccaucacccucagcgagccccgcaacauccagcagaagcugccgcccgagaucgucacucugcacccccguaucgaggagggcuucuucgaccucaugcacgugcagaaggugcuguccgccagcacggucugcaaacugcaguccugcacccauggggugcccggcgaucuccagguguaccacaucggcaaccuucugaagggggacaaggucaacggccaccucauccauaagaucgagccccacuucaauaccagcuggauguccugggacgggugcgaccuggacuacuacugcaacaugggcgacuggccgagcugcuccuacaccggggugacgcaacacaaucacgcggcguucgucaacauguugagcauugagaccgacuacaccaagaacuuccacuuccacuccaagcgcgucaccgcccacggcgacacgccccagcucgaccugaaggcccggcccaccuacggugccggcgagaucaccgugcugguggaggucgcggacauggagcuccauaccaagaagaucgagauuagcggccugaaguucgccagccucacgugcaccgggugcuacgccugcuccagcggcaucuccugcaaagugcgcauccacguggacgaacccgacgagcucaccguccacguaaagagugaggauccggauaucguggccgcgucgagcucccugauggcccggaagcuggaguucgggaccgacagcacguucaaggccuucuccgccaugcccaagaccagccucugcuucuacauagucgagcgcgaguacugcaaauccugcagcaaggaagacacccaaaaaugcgugaacaccaagcuggagcagccccaauccauccugaucgagcacaagggcacgaucaucggcaaacagaacgauaccugcaccgccaaggcgucuugcuggcucgagucagucaagagcuucuucuacggccuaaagaacauguuguccggcaucuucgggaacguguuuaucggcaucuuccucuucuuagccccauucgcccugcucauccuguucuucauguucggguggcggauccuguucugcuuuaagugcugccgccgcacccgcggccucuuuaaguaccgccaccugaaggacgacgaggagaccggcuaccggaagaucaucgagcgcuuaaacaacaagaagggcaagaacaagcuccuggacggcgagcgccuggccgaccgcaagaucgccgagcuguucagcacgaagacccacgugggg

SEQ ID NO: 15380 - RNA, 3495 nt, Artificial Sequence
  derived and/or modified CDS sequence (opt11) from CCHVF(CCHVF Baghdad 12)__AJ538197.2__Gn-NSm-Gc
ucggaggaguccggcgacgacugcaucagccgcacccggcugcuccgcaccgaaacggccgagauccacggggacucuuacggcggacccggagacaagaucacuaucugcaacgggagcacgaucguagaucagcggcugggcuccgagaugggcugcuauaccaucaaccgaguuaagagcuucaaacuuugcgagaacuccgccacagggaaaaguugcaaaaucgacuccaucccggugaagugucggcagggcuacugccucaagaucacccaggaggggcgcggccacgucaaacugagccgggguuccgaggucguccuggacgcgugcgacagcaguugcgaagugaugauccccaagggcaccggcgacaucuuggucgacugcagcggaggccagcagcacuuccugaaggacaaucuuaucgaccucgggugccccaacauaccacugcucggcaagauggccaucuacaucugccgcauguccaaccacccgaaaaccacgauggccuuccucuucugguucagcuucggcuacgugauaaccugcauccugugcaaggccaucuucuaccuucucauaaucgugggcacccugggcaagcgcuucaagcaguaccgcgaguugaagccccagaccugcacgauaugcgagacaacccccgucaacgccaucgacgcggagaugcaugaccucaacugcuccuacaacaucugccccuacugcgccucaagacugaccuccgaugggcuggcccggcacgugacgcagugcccgaagcggaaggagaagguggaggagaccgaguuauaccucaaccuggagcgcaucccgugggucgugcggaagcuccuccaagugagugaaagcaccggugucgcccugaagcgcuccagcuggcucaucgugcugcuggugcuccuagcagucuccucgucccccgugcagagcgcccccaucggguacggcaagaccaucgagacguaccaggcccgggagggcuacaccucaaucugccuguucgugcucgggagcauccuguucaucgucuccugccugaccaagggccucgucgacagcauagggaacaucuucuuuccgggacuguccaucuguaagaccugcagcaucggguccauaaacggguucgagguggaaagccacaagugcuacugcucccugcucugcugccccuacugccgccacugcagcgcagaucgggagauccaccagcugcaucuguccaucugcaagaagcgcaagacgggaagcuccgucaugcucgccgugugcaagcggaugugcuuccgcgcgacaauggaggucagcaacaaggcccugcugauccgcagcaucaucaacacaaccuucgugguuuguauccucacgcuagccgucugcgugguguccacuagcgccgucgagauggagagucugcccgccgggaccugggagcgggaggaggaccucaccaacuucugccaccaagaaugccaggugacggagaccgagugccugugccccuacgaggcgcuggugcugcgcaagccacucuuccuggacaguauugucaagggcacaaagaaucugcuuaacuccaccagccuugagacgucccuaagcaucgaagcccccuggggcgcaaucaauguccaguccaccuacaagcccaccgugagcaccgccaauaucgcuuugucuuggagcuccgucgagcaccgggggaacaagauccugguuagcgggcgcuccgagagcaucaugaagcuggaggagcggaccgguaucuccugggaccuugggguggaggaugcgagcgagagcaagcugcugacggucuccgugauggaccucagccaaauguacuccccgguguucgaguacuugagcggggaucgccagguugaggaguggccgaaggccacuugcaccggcgacugccccgagcggugcgggugcaccacguccacuugccugcacaaggaguggccccauagcaggaacuggcggugcaacccgaccuggugcuggggcgugggaaccgggugcacuuguugcggccucgacgucaaggaccuguucaccgacuacauguucgucaaguggaaaguggaguacaucaagacugacgccaucgugugugucgagcugaccucccaggagcgccagugcagccucaucgaggccgggacgcgguucaaccugggcuccgugaccaucacgcugagcgagccgcguaacauccagcagaagcucccgcccgaaauaauaacccugcacccccggaucgaggagggguucuuugaucugaugcacgugcagaaaguccucuccgccagcacggugugcaagcuacaguccugcacccacggcgugcccggcgaccugcaagucuaccacaucgggaacuuacugaagggcgacaaggugaacggacaccucauccacaagaucgagccgcacuucaacaccagcuggauguccugggacggcugugaccucgacuauuacugcaacaugggggacuggcccagcugcaccuauacgggcgugacacagcacaaccaugcguccuucgucaaccugcugaacaucgagaccgacuacaccaagagcuuccacuuccacuccaagcgcgugacggcccacggcgacaccccacagcucgaccugaaggugcggccaaccuacggggccggugagaucaccguccugguagagguggccgacauggagcuccacacgaagaagaucgagaucagcgggcuuaaguucgcgagcuuaaccugcaccggcugcuacgccugcuccagcgggaucuccugcaaggugcgcauccacguugacgagccagacgagcucaccgugcacguuaagagcgaugaucccgacguuguggccgccucaagcucacugauggcccgaaagcuggaguucggcacggacagcaccuucaaggccuucagcgccaugccgaagaccagccucuguuucuacaucgucgaacgcgaguacugcaaguccuguagcaaggaggacacccagaagugcgucaauacgaagcuggagcagccucaguccauccugauagagcacaagggcaccaucaucgggaagcagaacaauaccugcaccgccaagaccagcugcuggcucgaguccguaaagagcuucuucuacggccugaagaacaugcuguccgggauuuuuggcaacuucuucauggggaucuuccuuuuccuggcucccuucauccugcucauccuguucuucauguuuggcuggaggauccuguucuguuucaagugcugccgccgcacucggggccuuuucaaguacagacaccugaaggacgacgaggagaccggguaucggcggaucauagagcggcugaacaacaagaagggcaagaacaagcuccuagacggugagcgccuagccgaccggcgcaucgcggaacucuucagcaccaaaacccacaucggg

SEQ ID NO: 15381 - RNA, 3495 nt, Artificial Sequence
  derived and/or modified CDS sequence (opt11) from CCHVF(CCHVF VLG/TI29414)__AY179961.1__Gn-NSm-Gc
agcgaggagcccggcgacgacuguaucucccguacccaacuucucagagccgagccggccgagauccacgacgacaacuacggggguccaggggacaagaucacaauuuguaacggcaguaccauaguggaccagcgccucggguccgagcugggaugcuacaccaucaaucgggucaagagcuucaagcugugcgaaaacucugcgaccggcaagaccugcgagauagacagcacgcccgugaagugucgccagggguuuugucugaagaucacccaagagggccgggggcauguaaaacugucucgcggcagcgaggucgugcucgacgccugcgauucgagcugcgaggucaugauacccaaagggaccggcgacauccugguggacugcuccggcgggcaacagcacuuccuaaaggacaaccucaucgaccugggcugcccccauaucccacuguuaggcaagauggcgaucuacauuugccggaugagcaaccacccacgcacaacgauggccuuccuguucugguucuccuucggcuacguuaucacgugcauauucuguaaggcccuguucuacagccucauuaucaucggcacccuggggaagaaaaucaagcaguaccgugagcugaagccccaaacaugcaccaucugcgagaccgcgccgguaaacgccauagaugccgaaaugcacgaccucaacugcuccuacaacauaugccccuauugcgccucacgccucacguccgacggccuggcgcggcaugucccccaaugccccaagcgcaaggagaagguggaagagaccgagcuauaccugaaccuggagcggauccccuggaacgugcgcaagcucuugcaggucagcgaguccacggguguggcccuaaagcgcaguagcuggcucaucgugcugcugguccuccugaccgugucccugucccccgugcaguccgccccagucggccacgggaagaccaucgagaccuaccaaacacgcgaggguuucaccagcaucugucucuuuaugcugggaucaauccuguuccucgugagcugccuggugaaggggcuggucgacucaguauccgauuccuuuuuccccggacucaguguaugcaagaccuguagcaucgggucaaucaacggcuucgagaucgagucccacaaaugcuacuguagccuuuucuguugcccguacugcagacacuguucggccgaccgcgagauccaucaguugcaucuuucgaucugcaagaaacggaagauggggagcaacgucaugcuggccgugugcaagaggauguguuuccgugcgaccaucgaggcaagccgccgcgcccugcucauucgguccaucaucaacacgaccuucgucaucugcauccuaacccugaccaucugcguugugagcaccagcgcggucgagauggagaaccuccccuccggcacaugggagcgcgaggaagaccucacgaacuuuugccaccaggagugccaggugaccgagacagagugccugugucccuacgaggccuuggucuugcgcaagccgcuuuuccuggauagcauugucaagggcaugaagaaccuccuaaacucuacaaaccuagagaccagccucagcaucgaggcgccguggggcgcuaucaacgugcagagcaccuucaagccgacaguuuccaccgcaaacaucgcgcuuucaugguccagcgucgagcacagagggaacaaaauccuggugaccggaaggagcgagagcaucaugaaguuggaagaacguacuggcguuuccugggaccuggguguugaagacgccagcgagagcaagcuccucacugugagcauuauggaucugucgcagauguacagccccguguucgaguaccugagcggagaccggcaaguggaggaauggcccaaggcgacuuguaccggagacugcccggaacgcugcggguguaccucuagcacgugcuuacacaaagaauggccucauucucggaacuggcgcugcaacccgaccuggugcugggaggugggcacagggugcacgugcugcggcuggaacguaaaagaucuguucaccgaccacauguuugucaaguggaagguugaguacauuaagaccgaggcuauaguguguguugagcugaccagccaagagcgacaguguuccuugaucgaagcagggacccgcuucaaccuggggcccgugaccaucacgcugagcgaaccgcggaacauccagcagaagcucccgccagagaucauaacccuucacccaaagguggaggaaggcuuuuucgacuugaugcacguccagaagguguugucagcuagcaccgugugcaagcugcagucuugcacccacgguauccccggcgaccugcaagucuaccacauagggaaccuccugaagggugacagggugaacggccaccugauccauaagaucgagccccacuucaacacgagcuggauguccugggauggcugcgaucucgacuacuacugcaacaugggggacuggccgucgugcacuuacaccgguaugacccagcacaaucacgccgcguucgucaaucugcuuaacaucgagaccgacuacaccaagaccuuccacuuccauuccaagcgggucaccgcccauggcgacacgccgcaacucgaucugaaggcccgcccgaccuacggugccggggagaucacugugcucgucgaagucgcggacauggagcuccauaccaagaagguggaaaucaguggucuuaaauucgccucccuggcuugcacggggugcuacgccuguagcucugguauaagcuguaaggugcggauucacgucgacgagcccgacgagcucacuguacacguaaaguccaacgaccccgacgucaucgccgccagcaccucgcugauggcuaggaaacuggaguucgggaccgacuccacguucaaagccuucagcgccaugccgaaaaccucccuaugcuuuuacauagccgagagagaguacuguaaauccugcuccgaagaagacacccagaagugcguggacaccaagcuggagcagccccagagcauccucauagaacacaaagggacgaucaucggcaagcagaaugauaccugcacggcgaaggccuccugcugguuagaaucugugaagaguuucuucuacggccugaagaacaugcugggcagcguguucgggaacuucuuuauaggaauuuugcuuuuccuagcccccuuuguacuccuggugcuguucuucauguucggguggaagauccucuucugcuucaagugcugucgccguacccgcggccuauugaaguaccgccucuuaaaggacgacgaggagaccggguaccggcgcaucaucgaacgccuuaacaacaaaaagggcaagaaccgcuugcuggacggcgagcggcuggccgaccgcaagaucgccgagcuguuuucuaccaagacgcacauagga

SEQ ID NO: 15382 - RNA, 3495 nt, Artificial Sequence
  derived and/or modified CDS sequence (opt11) from CCHVF(CCHVF TADJ/HU8966)__AY179962.1__Gn-NSm-Gc
agcgaggaguccggcgacgacugcaucagccgcacccagcuacugcggaccgagacggccgagauccacggggaugacuacggaggacccggggacaagaucaccauaugcaacggauccaccauaguggaccagcgccugggcagcgagcugggcugcuacaccaucaacagagugaaguccuucaagcucugcgagaacagcgcaacggggaagaacugcgagaucgauuccgugccggugaagugcaggcaggguuacugccugaagaucacccaggaggggcggggccacgucaagcucagccgcggguccgaggugguucuggacgcgugugacucauccugcgaagucaugaucccgaagggcaccggcgauaucagcguagauugcagcgggggccagcagcacuucuugaaggacaauuugaucgaccuuggcugccccaagauaccccuacuggggaaaauggccaucuacaucugccggaugucgaaccacccgaagaccacgauggcguuccuauucugguucuccuucggauacgugaucacccgcauccugugcaaggccaucuuuuaucugcucaucaucgucgggacccugggcaagcgguucaaacaguaccgggagcugaagccccagaccugcaccaucugcgaaaccaccccggccaaugcgaucgacgccgagaugcacgaucucaacugcagcuacaauaucugccccuacugcgccucccggcugaccagcgacgggcuggcccgccacguuacacagugcccgaagcggaaagagaggguggaggagaccgagcuauaccugaaucuggaacggauccccuggaucguccgcaaguugcuccagguguccgagagcacgggcgucgcgcugaagcggagcuccuggcucaucguccugcuuguacuauucaccguuagccugucgcccgugcagagcgcccccaucggauauggcaacacgaucgaaaccuaccaggcccgcgaggaguacaccuccaucugucuuuucguguuaggcagcauccuguuuaucguguccugccugaugaaggggcucgucgacagcaucggcaacaucuucuucccggggcugacuauaugcaagacgugcuccaucggcagcaucaauggcuucgagaucgaaucccauaaaugcuacugcagccugcucugcugucccuauugucggcacugcuccgccgaccgcgagauccaccagcugcacuuaagcaucugcaagaagcguaagaccggcuccaacgugaugcucgcggugugcaagcgcaugugcuuccgcgcgaccauggaggucagcaacaaggcccugcugauccguuccaucauuaacaccacguucguagugugcauccucauccuggcugugugcaucgugagcacuagcgccgucgagauggagagccugcccgccggcaccugggaacgcgaggaggaccucacuaacuucugccaccaggagugccaggugacggagaccgagugccugugcccuuacgaggcacuggugcugcggcgcccccucuuccuggacagcauagucaagggaaugaagaacccccugaacuccaccagccucgagaccucccugagcaucgaggcccccuggggcgccaucaacgugcaguccacguacaagcccaccguaagcaccgcuaacaucgcccuguccuggagcuccaucgagcaccgugguaacaauauccucgucagcggccgcuccgagagcaucaugaagcuggaggagcggaccgguaucucgggagaccugggcguugaagacgcgagcgagucaaagcuacugaccgugagcgucauggaccugucccagauguacucaccggucuucgaguaccucagcggggaccgccagguggaggaguggcccaaagcaaccugcaccggcgacugccccgagcgaugcgguugcaccuccagcacgugccugcacaaagaguggccccacucccgcaacuggcggugcaauccgacgugguguuggggagugggcaccgggugcacgugcugcggccucgacgugaaagaccuguucaucgacuacauguucguaaaguggaaagucgacuacaucaagaccgaagcaaucgugugcguggagcugaccagccaggaacggcagugcucccuugucgaagccgggacacgguucaaccucggccccgugaccauuacccuuagcgagccccgcaacauccagcagaagcugccuccggaaaucaucacgcuccacccucggaucgaagaggguuucuucgaccugaugcacgugcagaaaguucuguccgccagcaccguguguaagcuccaauccugcacccacggcguucccggcgaccugcaggucuaccacauugguaaccuccucaagggcgauaaggagaacgggcaucuuauccacaagaucgaaccgcauuuuaacacaaguuggauguccugggacggcugcgaccucgacuacuacugcaacaugggggacuggcccagcugcacguacaccggcguuacgcagcacaaccacgccagcuucgugaaccuccugaacaucgagaccgacuacacuaagagcuuccacuuccacuccaagcgcguaaccgcccacggggacacgccccagcuggaccucaaggcccggcccaccuacggggccggggaaaucaccgugcuuguggaggucgcggacauggagcugcacaccaagaagaucgagauaaccggucucaaguuugccagccugaccugcaccggcugcuacgccugcuccagcgggauauccugcaaggugcgcauucacguagacgagccggacgagcucaccguccacguuaagagcgacgaccccgacgugguggccgcuagcuccagccucauggcgaggaagcuggaguucggcaccgauuccaccuucaaggccuucucagccaugcccaagacgagucugugcuucuacaucguggagagggaguaccgcaaaagcuguuccaaggaggacacccagaagugcgugaacacuaagcucgagcagccccagagcauacugauugagcacaagggcaccauuaucgggaagcagaacaauacgugcaccgccaaggccuccugcuggcuggagagcgucaaguccuucuucuacggccucaagaacauguuaagcgguaucuucggaaacguguuuguggggaucuuucuguuccucgcgccguucauccugcugauccucuucuucauguucggcuggagaauccuguccugcuucaagugcugccgccggacccgcggacuguuaaagcaccgacaucugaaggacgacgaggaaaccggguaccgccggaucaucgagcgccugaacaacaagaagggcaagaacaagcuccuggacggggagcggcuggccgaucgcaggauugccgagcuguuuucuaccaagacgcacaucggc

SEQ ID NO: 15383 - RNA, 3495 nt, Artificial Sequence
  derived and/or modified CDS sequence (opt11) from CCHVF(CCHVF Hodzha)__AY223476.1__Gn-NSm-Gc
agcgaagagagcggggacgacugcauaucccguacccaacugcuacggacagagacagcugaaauacauggcgaugacuacggcggaccuggcgacaaaaucacaaucugcaacggaucaacaaucgucgaccagcgccuagguucagaacucggaugcuauacaaucaaccgcguaaaaucuuucaaacucugcaaaaacuccgccacaggcaagucaugcgaaaucgauucaacacccguaaaaugccgccaagguuacugccugaaaauaacgcaggagggacgagggcacguuaagcucucccgcggcucugagguaguccuagaugcgugcgacucguccugcgagguaaugauaccgaaaggaaccggggacauccucguggacugcucgggagggcaacaacacuuccucaaggacaaccugauagaccucgguuguccccgcauacccuuacuaggcaagauggccaucuacauaugucgaaugucuaaucaccccaaaacaacaauggccuuccucuucugguucucuuuuggauacguaaucacaugcauacucugcaaagcuaucuucuaccuccucaucaucguagggacacuagguaaacgcuucaaacaguaucgcgaacuaaagccgcagaccugcaccaucugcgagaccaccccagccaacgcaaucgacgccgaaaugcacgaccucaacugcagcuacaauauuugccccuacugcgccucccgccucacgagcgacggccucgcccggcacgucacacaaugccccaaaagaaaagaaaaagucgaagaaaccgaacuguaccucaaccuagagcgaauccccuggaucguucgcaaacuccuacaaguaucagaaagcaccggcguagcucuaaaaagauccuccuggcuuauaguacuacucguucucuucgcgguaucucuauccccaguccaauccgccccaaucggccauggcaaaacgaucgagaccuaccaggccagagaagauuacaccucuauuugucuuuucguccuaggcuccauacuuuucaucguuuccugccugaugaaaggacucguugacucaaucggcaauauuuucuuccccggacuaacaaucuguaaaacuugcuccauaggaucgauaaacggauuugagaucgagagccacaaauguuacugcagccuccucugcugcccuuacugccgccacugcucagcggacagagaaauccaccaacuccaccuaucgaucugcaagaaacguaaaaccgguucaaacgucauguuagcagucugcaaacggaugugcuuccgcgccaccauggaagucuccaacaaagcucuccuaauccguagcaucauaaacaccacauucgucgucuguauacucauccucgccgucugcgucgucucuacauccgccguggaaauggagagccuucccgcaggcaccugggaacgagaggaagaccucaccaacuuuugucaccaagaaugccagguaaccgaaacagaaugccuauguccguacgaagcacucguccucagacgcccccucuuccucgacagcaucguuaaaggaacuaaaaaccuacuuaacucgaccucguuagaaaccagucuaagcauugaggccccauggggcgccauuaacguccaaucaaccuacaaacccacagucagcacagcaaacaucgcacucaguuggagcuccgucgaacacagagguaacaagauucucgucagcggaagaucagagucgauuaugaaacuggaggagcgcaccgguaucucaugggacuuaggugucgaggacgccuccgaaucaaaacugcuaacugucucaguaauggaccucucccaaauguacagcccagucuucgaauaucucagcggagaccgccagguagaagaauggcccaaggcaaccugcacaggcgacugccccgaacguugcggcuguaccucaagcacuugccuccauaaggaauggccccacucucgaaacuggcgaugcaaucccacauggugcuggggcguaggcacugggugcacaugcugcggacucgacgucaaggaccuauucacugacuacauguucguaaaauggaagguggacuacaucaaaacagaggccauagugugcguagaacugaccagccaagaacgccagugcucccuugucgaagccggaacacgguucaaccucggacccgucacaaucacccugucggagcccagaaacauccaacaaaaacucccacccgagaucaucacccuccacccccgcauagaagaaggguuuuucgaccuaaugcauguacagaagguccucuccgccucaacaguguguaaacugcaauccugcacacacggcguacccggcgacuuacaagucuaccauaucggaaaccuccugaaaggcgacaaggucaacggacaccucauucacaaaauagaaccccacuucaacacgagcuggauguccugggauggcugcgaucuggacuacuacugcaauaugggagauuggccuuccuguaccuacacuggugugacccaacacaaccacgccucauucgugaaccuucuuaacauagaaaccgacuacaccaagucguuccacuuccacaguaaacggguuacagcacacggagacaccccacaacuagaccuaaaagcgcgccccacuuacggagccggagaaaucaccguccuaguagaaguagccgacauggaauuacacacuaagaaaaucgaaauaaccggacucaaauucgccagccuaaccugcaccggcugcuacgccugcuccagcggcauaagcugcaaagugcgcauccacguagaugaaccggacgagcuaacaguccacgucaaaucagacgaucccgacguugucgcugcgucauccucccugauggcacgaaaacucgaauuuggaacugauuccaccuuuaaagccuucagugccaugcccaaaaccucccucugcuucuacauuguggaacgggaauacugcaaaucguguagcaaagaagacacgcaaaaguguguuaacaccaagcuagaacagccccagucaauacucaucgagcgaaagggcaccauuaucggaaaacaaaacaauacaugcacggccaaagccucaugcuggcuagaaaguguaaaauccuucuuuuauggccucaagaacaugcucuccggcauuuucggaaaugucuucgucggcaucuuccuuuuccucgcccccuucauuuuacuaauccucuucuuuauguucggguggcgaauacuauucugcuucaaaugcugccggcgcacgcggggacucuucaaguacaagcaccuaaaagacgaugaggaaacaggguaccgccggaucauagagcgacucaacaacaagaaaggcaaaaacaaacuacucgacggagaacgacuagcggaccggcgcauagcagaacuauucucaacuaagacucacaucggu

SEQ ID NO: 15384 - RNA, 3495 nt, Artificial Sequence
  derived and/or modified CDS sequence (opt11) from CCHVF(CCHVF Kosovo/9553/2001)__AY675511.1__Gn-NSm-Gc
agcgaggagcccggcgacgacugcaucucccgcacccagcugcuccggacugagacggccgagauccacgacgacaacuacgggggcccgggggauaagaucaccaucugcaacggcagcaccaucguagaccagcgccugggguccgaguuaggcugcuacaccaucaaccgggucaagagcuucaagcucugcgagaacuccgccacgggcaagaccugcgagaucgacagcacacccgugaagugccgccaaggcuucugccugaagaucacacaggagggccgggggcacgucaagcugucccgcggcagcgaggucgugcucgacgcgugcgacuccagcugcgaggugaugauccccaaggggacgggcgacauccugguggacugcuccggcgggcagcagcacuuccugaaggacaaccucauugaccucggcugcccccacaucccgcugcucgggaagauggccaucuacaucgcccggaugagcaaccaccccaagaccaccauggcguuccuguucugguucucccugggcuacgugaucacgugcauccucugcaaagcccuguucuacagcuugaucaucaucggcacccucgggaagaagaucaagcaguaccgcgagcugaagccccagaccugcaccaucugcgaaaccgcgcccgugaacgccaucgacgccgagaugcacgaccugaacugcuccuacaacaucugcccguacugcgccagccggcucacguccgacggccuggcgcgccacgucaagcagugccccaagcggaaggagaaaguggaggagaccgaguuguaccucaaccuggagcgcauccccugggugguccggaagcugcuccaggugagcgaguccaccgggguggcccugaagcgcagcagcuggcugaucguccuccuggugcugcucaccgugagccugagccccguccaguccgccccggugggccacgggaagacgauugagaccuaccagacccgggagggcuucaccagcaucugccuguucaugcucggcuccauccuguucaucgugagcugccuugucaaggggcucguggacuccgugagcgacuccuucuuucccggccugagcgucugcaagacgugcucuaucgggagcaucaacggcuucgagaucgagucccacaagugcuacugcagccuguucugcugccccuacugccgccacugcuccgccgaccgggagauccaccagcuccaccuuagcauaugcaagaagcgcaagaccggauccaaugugaugcuggccgucugcaagcggaugugcuuccgcgcgaccaucgaggccagccggcgcgcccuccugauccgcuccaucaucaacaccacguucgugaucugcauccugacccucaccaucugcguggccagcaccagcgccgucgagauggagacgcugcccgcggccaccugggagcgggaggaggaccugaccaacuucugccaccaggagugccaggugccggagaccgagugccugugccccuacgaggcgcucgugcugcgcaagccccuguuccucgauuccaucgucaagggcaugaagaaccuacugaacagcacgucuuuggagaccucucuguccaucgaggcccccuggggcgccaucaacgugcagagcaccuucaaaccgaccguguccaccgcgaacaucgcccugagcugguccagcgucgagcaccgggggaacaagauccucgugacgggccgcuccgagagcaucaugaagcuggaggagcggaccggggugagcugggaccugggcgucgaggacgccagcgaguccaagcuccugaccgugagcauaauggaccugucccagauguacagccccguguucgaguaccucagcggggaccgccaggucgaggaguggccgaaggcgaccugcacgggcgacugccccgagcggugcgguugcaccuccagcacgugccugcacaaggaguggccgcacucccgcaacuggcggugcaaccccaccuggugcuggggcguggggaccgggugcacgugcugcggcguggacguuaaagaccuguucaccgaccacauguucgugaaguggaagguggaguacaucaagaccgaggccaucgucugcguggagcucaccagccaggagcgccagugcucgcugaucgaggccggcacccgguucaaccugggacccgugaccaucacccucagcgagccccgcaacauccagcagaagcugccgcccgagauuaucacgcugcaccccaagauagaggagggcuucuucgaccucaugcacguccagaaggugcuguccgcaagcaccgugugcaagcugcaguccugcacccacgggaucccgggcgaccuccaggucuaccacaucgggaaccuucugaagggcgaccgcgugaacggccaccucauccacaagauugagccccacuucaacaccagcuggaugaguugggacgggugcgaccuggacuacuacugcaacaugggcgacuggcccagcugcacguacaccggggugacccagcacaaccacgccgccuucgucaaccugcucaacaucgagaccgacuacacgaagaccuuccacuuccacuccaagcgcgugaccgcgcacggcgacacgccccagcuggaccugaaggcccggccgaccuacggggccggggagaucaccgugcucgucgagguagccgacauggagcugcacaccaagaaggucgagaucagcggccugaaguucgccucccucgcgugcaccgggugcuacgccugcagcuccggcauaagcugcaagguccgcauccacguggacgagcccgacgagcugacggugcacgucaaauccagcgaccccgacgugguggccgccagcaccucccugauggcccggaagcucgaguuugggaccgacagcaccuucaaggcguuuuccgcuaugcccaagacgagccugugcuucuacaucgucgagaaggaguacugcaaguccugcagcgaggacgacaccaagaagugcguggacaccaagcuggagcagccgcaauccauccucaucgagcaccgcgggaccaucaucgggaaacccaacgacacgugccccgccaagaccagcugcuggcuggaguccgucaagagcuucuucuacggccugaagaacaugcucggcuccgucuucgggaacuucuucaucggcauccugcuguuccucgcccccuucuuccucuggaugcugagcuucauguucggguggaagauccucuucugcuucaagugcugccggcgcacccgcggccuguucaaguaccggcaccugaaggacgacgaggagaccggguaccgccggaucaucgagcgccucaacaacaagaagggcaagaaccggcugcuggacggcgagcgccucgccgaccggaagaucgcggagcuguucuccaccaagacccacaucggg

SEQ ID NO: 15385 - RNA, 3495 nt, Artificial Sequence
  derived and/or modified CDS sequence (opt11) from CCHVF(CCHVF SPU41/84)__AY900142.1__Gn-NSm-Gc
agcgaagagucaagcgacgacugcaucucccgaacccagcuccuccggaccgagacggccgagauccacggcgauaacuaugggggccccggcgacaagauuaccauuugcaacggcagcaccguggucgaccagcgccuggggagcgagcugggcugcuacaccaucaaccggguuaagacguucaagcucugcgagaacagcgccaccggcaaguccugcgagaucgacagcguaccggucaagugccgccagggguacugccugaagauuacccaggagggccgggggcacgugaagcuguccaggggcagcgaggugguccucgaugcgugcgacaccuccugugaggugaugaucccaaaggggacaggcgacauccugguggacuguuccggcgggcaacagcauuuccuuaaggacaaccucaucgaccugggcugucccaagaucccccugcugggcaagauggccauuuacaucugccggauguccaaccacccgaaaaccaccauggccuuuuuauucugguucagcuucggcuacgucaucacaugcaucauuugcaaggugaucuucuaucugcucaucaucgugggcacccuaggcaagcgcuucaaacaauaccgggagcugaagccccagacuugcaccaucugcgagaccacacccgucaacgccaucgacgccgagaugcacgaccucaacugcagcuacaacaucugccccuacugcgcgagccgccugaccuccgauggccuggcccggcacgugacucaguguccgaagcgcaaggagaaaguggaggagaccgaacucuaccugaaccuggagagaaucccaugggucgugcgcaagcucuuacaggugagcgaauccacgggggucgccuugaagcggagcagcuggcucgugguucugcugguccuccugaccgugucacuuagcccggugcaauccgcccccaucagccacggcaagaccgucgaagcguaccgcgcccgggagggguacaccagcaugugccucuucgugcugggaagcguucucuuccucgugucuugccugaugaagggccugguggacagcgucgggaacacguucuucccgggcuuguccaucugcaaaaccugcagcaucagcucgauuaacggguucgagauugagucgcaccgcugcuacugcagccuguucugcugcccuuacugccggcacugcuccgccaacaaggagauccaccagcugcaccucagcaucugcaagaagcgcaaggccggcuccaacguaaugcucgccgugugcaagcggaugugcuuccgcgcgacaauggaggucagcaaccgcgccuuauucauccgguccaucaucaacaccaccuucguccucugcauccugauccuggccgccugcguggucagcaccagcgccguggaaauggagagccuccccgcggggacgugggagcgcgaggaggaucugaccaacuucugccaccaggagugccagguagcugacacggaaugucuaugcccuuacgaggcccuaguccuccgccgcccgcuguuccuggacagcaucgugaagggcaugaagaaucuccugaacuccaccagccuggagaccucccucagcaucgaggcucccuggggcgccauuaacgugcaguccaccuacaaacccaccgucucuaccgcgaauaucgcccuguccuggagcuccguggagcaccgggggaacaagaucuuagugagcggccgcuccgagagcaucaugaagcuagaggaacggacugggaucuccugggaucugggcgucgaggacgccagcgagaguaaauuacucacgguguccgugauggaccuaucucagauguacucccccgucuucgaguaccugagcggggaccgccagguggaagaguggccaaaagcgacuugcacgggcgacugccccgagcggugcggcugcaccuccucaacgugucuccacaaggaguggccccacucccgcaauuggcgaugcaaccccaccuggugcuggggcguggggacugggugcacuugcugcggccucgacgucaaggaccuguucacagacuacauguuugugaaguggaagguggaguacaucaagaccgaggccauugucugcguggaguuaacgagucaggagcgccaaugcucccugaucgaggccggcacucgguucaaccugggcccggugaccaucacgcucagcgaaccccgcaacauccagcagaagcugccacccgaaaucauuacgcugcacccgcggaucgaggagggcuucuuugaccucaugcacguccagaaggugcuguccgccucuaccgugugcaagcugcaauccugcacccacggcguccccggcgaccuccagguauaccacaucgggaacuuacugaagggcgauaaagugaacggccacuugguccauaagaucgagccccauuucaacaccucauggauguccugggacgggugugaccuggacuacuacugcaacaugggcgacuggccuagcugcaccuacaccggggugacccagcacaaccacgccuccuucgugaacaugcugaacaucgagaccgacuacacgaagaacuuccacuuccacagcaaacgcgucacggcccacggcgacacgccccagcucgaccugaaggcucggccaaccuacggugccggcgagaucaccgugcugguggagguugccgacauggagcuccacaccaagaagaucgagaucuccggcuuaaaguucaccagccugaccugcacgggaugcuacgccugcagcagcggcaucucuugcaaggugagaauccacguggacgagcccgacgagcucaccguccacgugaaguccgaagacccggacguggucgcggcgagcuccagcuuaauggcccggaaacuggaguucgggaccgacuccaccuucaaggccuucagcgccaugcccaagacgucccucugcuucuacaucguggaacgcgaauacugcaagagcuguuccgaggaagacacccagaagugcgugaacaccaaacuggagcaaccacagagcauccuaaucgaacgcaagggcaccaucauugggaagcagaacaauaccugcaaggccaaggcgggcugcuggcucgaauccgucaagagcuucuucuacggccugaaaaacaugcuguccgggaucuuugggaacguguucaucgggaucuuccuuuuccuggccccauucauacuguuaauccuguucuucauguuuggguggcggauccuguucuguuuuaagugcugccgccggacacgcggccucuucaaguaccggcaccugaaggacgacgaggagaccggguaccgcaagaucaucgagcggcucaacaacaagaaggggaaaaacaagcuccuggacggcgagcgccuggccgacagacggaucgccgagcuguucucuaccaagacgcacaucggc

SEQ ID NO: 15386 - RNA, 3495 nt, Artificial Sequence; identical to SEQ ID NO: 12100
  derived and/or modified CDS sequence (opt11) from CCHVF(CCHVF UG3010)__AY900143.1__Gn-NSm-Gc

SEQ ID NO: 15387 - RNA, 3495 nt, Artificial Sequence
  derived and/or modified CDS sequence (opt11) from CCHVF(CCHVF Hy13)__AY900145.1__Gn-NSm-Gc
ucugaggaguccggcgacgacugcauaagccgcacccagcugucccggaccgagacggccgagauccacagcgacaacuacgggggccccggggacaagaucaccaucugcaacggcuccacuauaguggaccagcgccucgggagcgagcugggcuguuacaccaucaaccgggucaaguccuucaaacugugcgagaacucugccacgggcaaguccugcgagaucgacagcaccccgaucaagugccgccagggguucugccucaagaucacccaggagggccgugggcacgugaagcugucccgcggcagcgaggugguccuggacgcgugcgacucaagcugcgagaucaugauccccaaggggaccggcgacauccucguggacugcagcggcgggcagcagcacuuccuuaaggacaaccugaucgaccucggcugccccaacaucccccugcuggggaagauggccaucuacaucugccggaugagcaaccacccgaagacgaccauggccuuccucuucugguucuccuucggguacgugaucacgugcauccugugcaaggucaucuucuaccugcucaucguggugggcacccuggggaagaaguucaagcaguaccgcgagcuuaagccccagaccugcacgaucugcgagaccacccccgucaacgccaucgacgccgagaugcacgaccucaacugcagcuacaacaucugccccuacugugcgucccggcugacgagcgacggccuggcccgccacgugaugcagugcccgaagagaaaggagaagguggaggagaccgagcucuaccugaaucuagagcgcauccccugggucgugcggaagcuccuccaggugagcgaguccacuggggucgcccugaagcgcagcuccuggcugguagugcugcugguccuccugaccgugagccugagccccgugcagagcgcccccaucggucacgggaagacggucgagaccuaccagacccgggagggcuacaccuccaucugucucuucgugcugggcagcauccuuuucaucguguccugccucaugaaggggcuggucgacagcgugggcaacuccuucuucccggggagcuccaucugcaagacgugcagcaucggcuccaucaacggguucgaaaucgagagccacaagugcuacugcucccuguucugcugccccuacugccgccacugcagcgccgaccgggagauccacaagcuccaccuguccaucugcaagaagcgcaagaccggcucaaacgucaugcuggccgugugcaagcggaugugcuuccgagccaccguggaggucagcaacaaggcccuccugauccggaacaucauaaacaccacguuuguggugugcauccugauccucgcugucugcgugguguccaccagcgcggucgagauggagucccugcccgccggcaccugggagcgcgaggaggaccugacuaacuucugccaccaggagugccaggccaccgagaccgagugccucugccccuacgaagccuuggugcugcgcaagccgcuguucagcgacuccaucgugaaggggaugaagaaccuccuuaacagcaccucccuggagaccagccucuccaucgaagcccccuggggcgcgaucaacguccagagcacuuucaagcccaccguguccgccgccaacaucgcccugagcugguccagcguggaacaccgggggaacaagauccuggucucgggcagaagcgaguccaucaugaagcucgaggagcggaccgggaucagcugggaccugggcguggaggacgccagcgaguccaagcugcucaccgugagcaucauggaccugucccagauguacagccccgucuucgaguaccuguccggcgaccgccagguggaggaguggccgaaggcgaccugcacgggggacugucccgagcggugcggcugcaccagcuccacgugucuccacaaggaguggccccacagccgcaacuggcgaugcaaccccaccuggugcuggggcguggggacuggcugcacgugcugcgggcuggacgucaaggaccuguucaccgaccacauguucgugaaguggaagguggaguacaucaagaccgaggccaucgucugcguggagcucaccucccaggagcgccagugcagccugaucgaggccggcacccgguucaaccuggggccggugaccaucacccucagcgagccccguaacauccagcagaagcucccgcccgaaaucgucacgcugcacccccggaucgaggagggcuucuucgaucucaugcacgugaagaaggugcugagcgccuccaccgucugcaagcugcagagcugcacccacggggugcccggcgaccuccagguguaccacauuggcaaccugcugaagggggacaaggucaauggccaccucauccacaagaucgagccccacuucaacaccucauggaugagcugggacgggugcgaccuggacuacuacugcaacaugggcgacuggccguccugcagcuacacgggggugacccagcacaaccacgccgcguucguaaacaugcugaacaucgagaccgacuacaccaagaucuuccacuuccacuccaagcgcgucacggcccacggugacacaccgcagcucgaccugaaggcccggcccaccuacggcgccggggagaucaccgugcugguggaggucgcggacauggagcuccacaccaagaagaucgagaucagcggccugaaauucgccagccugaccugcaccgggugcuacgccugcuccagcggcaucuccugcaaggugcgcauccacguggacgagcccgacgagcucaccguccacgucaagagcgaggacccggacaucguggccgccagcagcucccugauggcgcggaagcuggaguucgggacggacagcaccuucaaggccuucagugccaugcccaagaccagccucugcuucuacaucguggagcgcgaguacugcaaguccuguagcaaggaggacacccagaagugcgugaacacgaaauuagagcagccccaguccauccugaucgagcacaagggcaccaucauuggcaagcagaacgacacgugcaccagcaaggccgggugcuggcucgaguccgucaagagcuucuucuacggccugaagaacaugcuguccgggaucuucggcaacguguucaucgggaucuuccucuuccuggccccuuucauccugcucauccuguucuucauguucggguggcggauccuguucugcuuuaagugcugccgccggacccgcggccucuuuaaguaccgccaccugaaggacgacgaggagaccggguaccggaagaucaucgagcgccugaauaacaagaagggcaagaacaagcuccuggacggggagcggcuggcggacagaaagaucgccgagcuguucagcaccaagacccacaucggc

SEQ ID NO: 15388 - RNA, 3495 nt, Artificial Sequence
  derived and/or modified CDS sequence (opt11) from CCHVF(CCHVF Semunya)__DQ094832.1__Gn-NSm-Gc
gccgagggcgugucgaacgauugcgugagccgcacgcagcugaucaaaaccgaaguggcugagauccacgaggacagcuauggcgggcccggggaaaagaucacgaucugcaacggguccaccaucguggaccagcggcuggguagcgagcugggcugcuacacaaucaaccgagucaagacguacaaacuuugcgagaacuccgcgacggaaaaggggugcgagaucgacagcgugccggugaagugcaagcagggguucugccucaagguuacccaagagggucgggggcauguaaaguuaucccgcggcaccgagaucguguuggacgucugcgacaccagcugcgagcucaugauuccaaagggaacgggcgacauccuuguggauuguaguggcgggcagcagcacuuccugcaggacaaccucaucgaccugggcugccccaacgucccccuguuagggaagauggccaucuacauaugcagaauguccaaccaccccaagaccacuauggccuuccucuucugguucuccuuuggcuacgucaucacgugcguggugugcaagguccuguucuauuuacugaucgugaucggcacacuggggaagaagcucaagcaguaccgcgagcugaagccccagaccugcauagugugcgagucuaucccugucaacgccaucgaugcagagaugcacgagcugaacugcaacuacaacaucugucccuacugcgcgucccgucucacgucggacggccuggugcgccacguaacacagugcccgaagcggaaggagaaggucgaggagaccgaacuguacuugaaccuggaacgcauccccuggcuggugaggcgccuccuccagguauccgaguccaccgggauggcccugaaacgguccugcuggaugaccacccuccugauuuuguuggucgugagccuuucacccguccaaagcgccccagugggccaggaaaaggccaucgaggucuaccagguccgcgagagcuacacguccaucugccuguuuguccucgggagcgugcuguucgcgguauccuggcuggugaagggccucaucgauggcaucgggaacucguuuuucccgggccugucggugugcaagaccugcagcaucgggucaaucaacggcuucgagaucgagucucacaagugcuacugcagccuguucugcugccccuacugccgugccuguagcuccgacaaaaucacccaccgcaugcaccucaacaucugcaagcggcgcaaggucgggagcaaugugaugcuggccgugugcaaacggaugugcuucaaggccaccgucgaggccuccaacagcgcgcugcucauccggaguaucaucaauagcacguucgugaucugugugcugauccuggucaucugcgugguauccaccagcgccgucgacauggagaaccuccccgcaggcaucugggagcgggaggaggaccugacuaacuucugccaccaggagugccaggugaccgaaacggagugccugugccccuacgaggcccugauccuccgcaagccccuguuccuggacuccaucgccaagggcaagaaguccuuacugaacaguacgaaccuggagacaucgcucagcaucgaggcucccuggggcgccauaaacgugcaguccaccuucaaacccacgguuagcgccgccaacaucgcuuuguccuggagcaguguggagcaccgcgggaacaagauccugguaagcgggcggucugagucaaucaugaagcucgaggagcgcacuggcaucuccuggagccugggcgucgaggacgcgucggaaagcaagacccugacgguguccgugauggaccucagccagauguacucacccgucuuugaguaccugagcggugaccgccagguagaggaguggccgaaggcuacaugcaccggcgacugccccgagcggugcgggugcaccagcuccacgugccugcacaaggaguggccccauagccggaacuggcgcugcaaccccaccuggugcuggggaguggguaccggcuguacgugcugcggccucgacgucagggaccucuucaccgacuacaugauggugaaguggaagguggaguacgucaagacggaggccauaaugugcguggagcucaccucccaggagcgccagugcagccucaucgaggccgggacacgguuuaaucugggccccgugaccaucacccuguccgagccccgcaauguacagcagcggcuccccagcgagaucgugacacugcaccccaagaucgaggagggguuuuucgaccugaugcacgugcagaagguacuauucugcaaguauucucugcaagccaccagcugcacccacggcgugccgggggaccuacaagucuaccacgucggcaaccugcugaagggcgacaaagugaacgggcacuccauucacaagaucgagagucacuucaacaccagcuggaugagcugggacgguugcgaccucgacuacuucugcaacaugggggacuggcccuccugcacguacaccggcgugacccagcacaaucgcgcagccuucgucaacaugcucaacaucgaaaccgauuacacgaaaaccuuccacuuccacagcaagcgggugaccgcccacggggacacuccccaacuggaccugaaggcucgcccgaccuacggcgcgggcgaggugaccgucuugguggagguggccgaccuggagcugcacaccaagaagaucgaggucuccgggcucaaguucgccagccugacaugcucgggcugcuaugccugcagcuccgggaucagcuguaaggugcggauccacgucaacgagcccgacgaguucacggugcacgucaagagcaacgaccccgacgugguggccgcgggcuccucgcugauggccaggaagaucgaguucggggccgacuccaccuucaaggccuucucguccaugccuaagaacucauuaugcuucuacaucgucgagcgggacuacugcucgagcugcaccgacgacgauacccagaaaugcgugaacaucaagcuggaacacccgcagucaauccugaucgaacacaagggcaccaucaucggcaagcagaacgacacgugccccaccaagaccagcugcuggcucgaguccgucaagagcuucuucuacggacugaagaacauguuaggcggaaucuucggcaacguguuucucgggaucuuccuguuccuggcccccuucgcgcuccugauccuguucuucuucuucggcuggcgccuccuguuuugucugaagugcugccggcgcacgcgaggccuccugaaguacaagcagcugaaggaugaggaggaggcuggguacaagaagaucaucgagcggcugaaugacaagaagggcaaaucacgccuguuugauggggagcggcuggcagaccgcaagaucgccaagcuguucagcaccaagacccacaucggc

SEQ ID NO: 15389 - RNA, 3495 nt, Artificial Sequence
  derived and/or modified CDS sequence (opt11) from CCHVF(CCHVF SPU128/81/7)__DQ157174.1__Gn-NSm-Gc
agcgaggagcccuccgacgacugcaucagccgcacccagcugcugcggaccgagacagccgagauccacggugacaacuacgguggcccgggggacaagaucaccaucugcaacggcuccaccaucguggaccagcgccuggggagcgagcugggcugcuacaccaucaaccgggucaaguccuucaagcucugcgagaacagcgccacgggcaaauccugcgagaucgagagcgugcccgugaagugccgucagggguacugccugcggaucacccaagagggccgcggucacgucaagcugucccggggaagcgagguggugcucgacgcuugcgacaccucaugcgagaucaugauccccaaggggaccggcgacauccuggucgauugcagcggcgggcaacagcacuuccugaaggacaaccucaucgaccugggcugcccuaagaucccgcugcuagggaagauggccaucuacaucugccgcauguccaaccaucccaagacgacgauggccuuccuguucugguucagcuucggcuacguuauuacgugcauccugugcaaggccaucuucuaccuccugaucaucaucggcacccuggggaagcgguucaagcaguaccgcgagcucaagccccagaccuguaccaucugcgagaccacccccgugaacgccaucgacgcagagaugcacgaccuaaauugcuccuacaacaucugcccguacugcgccagccggcugacgucugacggccucgcccgccacgugacccagugccccaagcggaaggagaagguggaggagaccgagcuguaccugaaccucgagcgcauccccugggucguccguaaacugcuccaggugagcgaguccaccgggguggcgcucaagagaagcagcugguuaaucguccuucucgugcuguucacggugucucuaagccccguacaguccgcgccgaucggccacgggaagaccauugaggccuaccgggcucgcgagggcuacacaagcaucugccucuucgugcugggcuccauccuguucaucguaagcugccucaugaaggggcuggucgacuccgugggcaacagcuuuuuccccggguuguccaucugcaagaccuguagcaucuccagcaucaacggcuucgagauugagucccauaagugcuacugcagccucuucuguugccccuacugccggcacuguuccgcggacaaagagauccacaagcugcaccugagcauaugcaagaagcgcaagacgggguccaacguaaugcucgccgucugcaagcggaugugcuuccgcgcgaccauggaggugagcaaccgcgcccuguucauuagauccaucaucaacaccaccuucguccugugcauccucauccuggccgugugcguugucucuacgagcgcgguggagauggagaaccugcccgccggcacaugggagcgcgaagaggaccucaccaacuucugccaccaggagugccaggugaccgagaccgagugucugugcccguacgaggcgcuggucuuacggaagccccucuuccuggacuccaucgugaagggcaugaagaaccugcucaacagcaccucccuggagaccagccuguccaucgaggcccccuggggcgccauuaacgugcagagcaccuacaagcccacggucuccacagccaacaucgcccucagcugguccagcguggagcaccgcgggaacaagauccugguguccgggaggagcgaauccaucaugaaguuggaggagcgcaccggcaucagcugggaccucggggucgaagacgcguccgagagcaagcuguugaccguguccgugauggaccuuucacagauguacagcccggucuucgaguaccuguccggcgaccgccagguggaggaguggcccaaggcgaccugcacgggcgacugccccgagcggugcggaugcaccagcuccacgugccugcacaaggaguggccccacucucggaacuggagaugcaacccgaccuggugcuggggcguggggaccggcugcacgugcugcgggcucgaugucaaggaccuguuuaccgacuacauguucgugaaguggaagguggaauacaucaagacugaggcaaucgucugcguggagcugaccucccaggagcggcaaugcagccucaucgaggccggaacccgcuucaaccugggccccgugacuaucacccuguccgagccccggaacauccaacagaagcugcccccggagaucaucacgcugcacccccgcaucgaggagggguuuuucgaccugaugcacguccaaaagguucucagcgcauccaccgugugcaagcugcagagcugcacccacggcguccccggggaccuccagguguaccacaucggcaaccuacuaaagggcgacaaggugaacgggcaccugauccacaagaucgagccacacuuuaacaccuccuggaugucgugggacggcugcgaccucgacuacuacugcaauaugggggacuggcccuccugcaccuacacuggcgucacucagcacaaccacgccagcuucgugaaccugcugaacaucgagaccgacuacacaaagaacuuccacuuccacuccaagcgggugaccgcccauggggacacgccccagcucgaccugaaggcccgcccuaccuacggcgccggcgagaucaccguccugguggagguggcggacauggagcuccacaccaagaagaucgaaaucagcgggcugaaguucgccucccugaccugcaccggcugcuacgccugcagcuccgguaucagcugcaagguccggauccacguggacgagccggacgagcucacggugcacgucaagagcgacgaccccgacgugguggccgccuccagcucccugauggcgcgcaaacuggaguucggcaccgacagcaccuucaaggcguucuccgccaugcccaagacuagccucugcuucuacaucgucgagagggagcacugcaaguccugcagcgaggaggacacgaagaagugcgugaacaccaagcuggagcagccccaguccauccugaucgagcacaaggggaccauuaucggcaaacagaacagcacgugcaccgccaaggccuccugcuggcucgagagcgugaaguccuucuucuacggccugaagaacaugcugagcgggauauucggcaacgucuucaucgggaucuuucucuuccugggcccguucauccugcuaauccuauucuuuauguucggguggcgaauccuguucugcuucaagugcugucgacggacccgcggccuacugaaguaccgccaccugaaggaggacgaggagaccggcuaucgccggaucauugagcgccucaacaacaagaaggggaaaaacaagcuguuagacggcgagcggcucgcggaccgccggaucgcggagcuguucucuacuaaaacgcacaucggg

SEQ ID NO: 15390 - RNA, 3495 nt, Artificial Sequence
  derived and/or modified CDS sequence (opt11) from CCHVF(CCHVF ROS/HUVLV-100)__DQ206448.1__Gn-NSm-Gc
agcgaggaacccggcgacgacugcaucucacgcacccagcugcuccggaccgagacggccgagauacacgacgacaacuacgguggcccgggggacaagaucaccaucugcaacggcagcaccaucguggaccagcgccugggguccgagcugggcugcuacaccaucaaccgggucaagucauucaaguuaugcgaaaacuccgccaccggcaagaccugcgagaucgacucaaccccggugaagugccgccagggguucugccugaagaucacccaggagggccgggggcacgugaagcugucgcgcgggagcgaggucguucucgacgcgugcgacuccagcugcgaggugaugaucccgaaggggacgggcgacauccuggucgacugcuccggcggccagcagcacuuccugaaggacaaccuuaucgaccugggcuguccccacaucccauuguuagggaagauggccaucuacaucugccggaugucgaaccacccccgcaccaccauggccuuccuguucugguucuccuucggcuacgugaucacgugcaucuucugcaaggcccuguucuacucccucauaaucaucggaacccuggggaagaagaucaaacaguaccgggagcugaagccccagaccugcaccaucugcgagaccgcccccgugaacgcgaucgacgccgagaugcacgaccucaacuguuccuacaacauaugcccguacugcgccagcaggcugacguccgauggccuggcccggcacgucccccagugccccaagcgcaaggagaagguggaggaaaccgagcucuaccugaaccuugagcggauccccuggaucgugcgcaaacuccugcaggucagcgaaagcaccgggguggcgcugaagcggagcagcuggcucaucguacugcugguacuccugaccgugucccuaagcccggugcaguccgcccccgugggccacgguaagacgauagagaccuaccagacccgcgaggguuucaccagcaucugccucuucaugcugggcuccauucuguuccucgugagcugccuggugaaagggcuggucgacuccgugagcgacuccuucuuccccggccucagcgugugcaagacgugcuccaucgggucaaucaacggcuucgagauugagucccacaaguguuacugcagccuguucugcugccccuacugccggcacugcuccgccgaccgggagauccaccagcugcaccucagcaucugcaagaagcggaagaccggguccaacgucaugcuggccgugugcaagcgaaugugcuuccgggccaccaucgaagcgagccgccgcgcccugcucauccgguccaucaucaauaccacguuugucaucuguauccugacccugaccaucugcguagugagcaccagcgccgucgagauggagaaccucccguccggcacgugggaacgcgaagaggaccugaccaacuucugccaucaggaaugccaggugaccgagacggagugccugugccccuacgaagcccugguacuccggaagccccuguuccuggauagcaucgucaagggcaugaagaaccuccugaacuccacgagccuggaaaccucccucuccaucgaggcccccuggggcgcgaucaacgugcaguccacauucaagccgaccgugagcaccgccaacaucgcccugucuuggagcuccgucgagcaccgcgggaauaagauacuggugacggggcggagcgaaagcaucaugaagcucgaggagcgcaccggcgugagcugggaucugggggucgaggacgccuccgagagcaagcuccucaccguguccaucauggaccugagccagauguacagccccguguucgaauaccugucgggcgacaggcaggucgaggaguggcccaaggcaaccugcacgggcgauugucccgagcgcugcgggugcaccagcuccacgugccuccacaaggaauggccgcauagccggaacuggcgcuguaaccccaccuggugcuggggcguggggaccggcugcacgugcugcggcguggacgucaaggaccuguucaccgaccacauguucgugaaguggaagguggaguacaucaagaccgaggccaucguaugcguggaguuaaccucccaggagcggcagugcagccucaucgaggccgggacccgcuucaaccuggggcccgugaccaucacucuguccgagccucgcaacauccagcagaagcuaccgcccgagaucaucacgcugcaccccaaggucgaggagggguucuucgaccugaugcacgugcagaagguacucagcgccucuacagucugcaagcugcagagcugcacccacggcauuccaggggaccuccagguguaccacaucgggaaccuccugaagggcgaccgcgugaacgggcaccugauccacaagaucgagccccacuucaacaccuccuggauguccugggacgggugugacuuggacuacuacugcaacaugggggacuggcccagcugcacguacaccggcgucacccagcacaaccacgccgccuucguuaaccugcugaacaucgagacggacuacacgaaaacauuccacuuccacagcaagcgggugaccgcgcacggggacacgccccagcucgaccugaaggcccgcccgaccuacggcgccggcgagaucaccguccugguggagguggccgacauggagcuccacaccaagaaggucgagaucucugggcugaaguucgcgagccuggccuguaccggcugcuacgccugcuccagcgggauuuccuguaaggugcggauccacguggacgagcccgacgagcucacgguccacgucaaaagcagcgaccccgacgucguggccgccuccaccagccugauggcgcggaagcuggaguucggcaccgacuccaccuucaaggccuucagcgccaugcccaagacgucgcucugcuuuuacaucguggagagagaauacugcaagagcugcuccgaggaagacacccagaaaugcguggacaccaaguuggagcagccgcagagcauccugaucgaacauaaggggaccaucaucggaaagcaaaacgacacuuguaccgccaaggcuaguuguuggcucgagagcgucaaguccuuuuucuacggccugaagaacaugcuggggagcguguucggcaacuucuucaucgggauccuccuguuccuggcgccuuucgugcuccugguccuguucuucauguucgguuggaaaauccucuucugcuucaagugcugccgccgcacccgggggcugcugaaguaccgccuccugaaggacgaugaggagaccggcuaccggaggaucaucgagcggcugaacaacaagaagggcaagaaccgccuccuggacggggagcggcuggccgaccgcaagaucgcagagcuguucucaaccaagacgcauaucgga

SEQ ID NO: 15391 - RNA, 3495 nt, Artificial Sequence
  derived and/or modified CDS sequence (opt11) from CCHVF(CCHVF AP92)__DQ211625.1__Gn-NSm-Gc
agcgaaggcggcgacggaggcugcaucucccgaacacaacuaaucaaaaccgaaacugcugaaguacacggagacgacuacggaggacccggugagaaaaucacaaucugcaacggcucgaccauugucgaucaacgacuagggagcgaacucggauguuacaccaucaacagaauaaaauccuucaaacuaugugaaaacucagcccaggggaaaaacugcgaaauagacucagcccccguucaaugccggcaaggauacugccuuaagaucagccaagaaggaagaggccacgucaaacucagccguggcuccgaaaucguacuugacgucugcgauacauccugcgagaucaugaucccgaaaggcacaggagacauccuggucgacuguucaggaggacagcaacacuuucuacaauccaaccuuguagaccucggcugccccaacauaccucuacuaggcaaaauggcaaucuacauuugccgaaugucgaaucaccccaaaacaaccauggcguuccucuucugguuuagcuucggauaugucauaaccugcauccugugcaagacccucuucuacauacucauuauaaucggcacucuaggcaagaaacucaagcaauaccgcgaacucaaaccgcaaacgugcaccaucugcgagucaguccccgucaacgcaauugaugccgaaaugcacgaccuaaacuguucauacaacauaugccccuacugugccucccgacucacauccgaagggcuaacccgucacgucaaccaaugcccaaaaagaaaagagaagguggaggagacagaacuauaccuaaaccucgagcgcauccccuggauuguccgaaaguuacuccaaguaucagaauccaccggcguagcacugaaacgcuccuccuggaugauuguccuccuaauccugcuaauaguaagcaugucacccguccaguccgcaccaauaucacaggagcgcacgguugcccucuaccagagccgcgaagacuacaugggcauuugccuggucauaaugggcucaguauuacucgccguaucacuucucgucagaggcuuaaucgacucaauaucgagcaccuucuuucccggacucucgguaugccgaaccugccacauaggauccauaaacggcuucgaaauagaaucccacaaaugcuacugcggccuacuuugcugcccauacugucgagccugcuccaccgaccaagacgcacaccaguuccaccuuagcguaugcaagaaacgaaaagcaggcuccaacgucaugcuggccguaugcaaacgcauguguuucaaagcaaucauugaagccaguaacaagguucucuucauacggaacguaaucaacacaacauucgucguuugcauccucgucaugguugcaugcauagcaucuagcgccgccgucgaaauggaaaaucucccugccgguacaugggaaagagaagaggaacuaaccaacuucugccaccaagaaugccaaguaaccgagacagaguguuuaugccccuaugagagcuucauccuacgcaaaccucuguuccuugacucgauugccaaaggagucaagaaucuccuuaacucuaccagccuugaaaccucguugucuauagaagcccccuggggagccauaaaugcgcaaucaacuuauaagcccacagccagcuccgcaaauaucgcccuaacauggagcagcguagaacauaggggcaacaaaauccuugucagcggacgauccgaaucaauaaugaaacucgaagaacgcacaggaauaucauggaaccucggagucgaagacgccagcgaaagccggacccucaccauaucagucauggaucugucccaaauguacucccccguauucgaauaucucagcggggaccgucaaguagaggaauggccaaaggcuacuugcaccggaaacugcccagaaaggugcggaugcaccuccaguacuugccucuacaaagaauggccccacucacgaaacuggcgaugcaaccccaccuggugcuggggcguaggaacaggaugcacuugcugcgggcuugacguaaaagagcuauucacagaccacaugcucgucaaauggaaagucgaauacaucaaaaccgaagcuaucgucugcgucgaacucacaucccaagaacggcaauguagccuaauagaagccgguacgcguuucucgcuaggccccgucaccaucacacucagcgaaccccgaaacauacaacagaaacucccgcccgagcuaauaacccuccaccccaaaaucgaagacggcuacuucgaccucaugcacguacaaaaagucaugucagccagcaccgucugcaaacuucaauccugcacgcacgggguccccggcgaccuccaaaucuaccaugucggcaacuuacugaaaggggaccgagucaacggccaccucauccacaaaguagaaccccaucuaaacacgucauggaugucaugggacggcugcgaccuagacuacuucugcaacaugggggauuggccaagcugcacauauacgggagucacacagcacaaccacgcugcauucgcgaaccuacuaaacaucgaaaccgauuacacaaaaacguuccacuuccacucuaaacgaguaacugcacauggcgauacaccacaacuggaucuaaaagcccgaccccgauacggagcgggcgaaauuaccguucuagucgaggucgcggauauggaacuucacaccaagaaagucgaggucacaggacugaaauucgcaagccugaccugcagcggcugcuaugccugcucguccggcauaagcugcaagguacgcauccacgucgacgaaccggaugaacuaacaguccacguaaaaagcagugaccccgauaucgucgccgccuccuccucccuaauggcccguaagaucgaguucggaguagacuccacguucaaagcguuuucaucaaugcccaaagacucccucugcuucuacauaguagaacgcgacuauugcaacuccugcaaaaacgaagagacccaaagaugcgucaacgccaagcuagaacaaccacaauccauccucaucgaacauacaggcacaaucaucggaaaacaaaacgauaccugcggcuccagaaccagcugcuggcucgacagcuucaagagcuucuucuacggccuaaaaagcaugcuauccggcauauucgguaacgucuuccugggaauauuccucuuccucgcccccuuugcacugcuccucuucuucuucuuuuucgguuggcgaaucuuguuuugcuucaaaugcugcaggcgaacccgcgggcuuuucaaauaucggcacauaaaagacgacgaggaggucggauacaagaaaauaauagaacgucugaacaauaaaaagggaaaacaucgccuucuugacggagaacgccuagccgacagaaaaaucgcagagcucuuuucgacgaaaacacacauuggc

SEQ ID NO: 15392 - RNA, 3495 nt, Artificial Sequence
  derived and/or modified CDS sequence (opt11) from CCHVF(CCHVF ArD8194)__DQ211626.1__Gn-NSm-Gc
gcggagggcgggagcaacgacugcgugucccgcacccagcuggucaagaccgagguagccgagauccaugaggacagcuacggcgggccuggcgagaagaucacgaucugcaauggguccaccaucguggaccagcggcucgggagcgagcugggcugcuacaccaucaaccgcguccggacauacaagcugugcgagaacuccgcgacggagaaguccugcgagaucgacagcgugccggugaagugcaagcagggguucugccucaagaucacccaggagggacgcgggcacgucaagcugagccggggcaccgaaaucgugcuggacgugugcgacaccuccugcgagcucaugauccccaagggcacgggcgacauucuugucgacugcagcggcgggcagcagcacuuccugcaggacaaccucaucgaccugggaugccccaacaucccccugcucgggcgcacggcuaucuacgugugccggauguccaaccauccgaagaccacaauggccuuccuauucugguucagcuucggcuacgugaucacgugcgucguguguaaggugcuguucuacuugcugaucguaaucggcacccuggggaagcgccugaagcaguaccgggaguugaagccccagaccugcaucgugugcgaguccauccccgugaacgccaucgacgccgagaugcaugaccugaacugcaauuacaacaucugccccuacugcgcgagccgcuugaccuccgacggccugguccggcacgugacgcagugcccgaagcgcaaggaaaagguggaggagaccgagcuguaccucaaccuggagcggauccccuggcugguccgcaagcuccuccaggugagcgaguccacagggguggcccuaaagcggagcugcuggaugaucacccuccugauacugcucacggucuccaugucgcccguucagagcgcccccgucggucacaaaagggccguggagguauaccagaugcgggaauccuacacagggaucugccucuucguccugggcagcgugcuguucgcggugagcuggcuggucaaggcccugaucgacucuaucggcaacucauucuucccaggguuaagcauaugcaagaccugcuccauuggcagcaucaacggguucgagaucgagucccacaagugcuacugcagcuuguucugcugccccuacugccgcgccugcucuagcgacaagaucacccaccgcaugcaccugaacguaugcaagaagcgcaaggugggcuccaacgucaugcucgccguguguaagcggaugugcuuuaaggccacuaucgaggccagcaaccgcgccaccuucauccgcaacaucauuaacucgaccuucgugauaugcauccugauccuggucaucugcguggugucuaccuccgccgucgacauggagaaccuccccgccgggaucugggagaaggaggaggacuugacgaacuuuugccaccaggagugccaggugaccgagaccgagugccugugccccuacgaagcucucaugcugcggaagccgcuguuccuggaccgcauugcgaagggcaugaagucccuccucaacagcaccagccuggagacgagccucuccaucgaggcccccuggggcgccaucaacguccaaagcaccuucaagcccaccgucuccgccgccaacauugcgcugagcugguccagcgucgaacacaaggggaacaagauacugguguccgggcguagcgaguccaucaugaagcuagaggagcgcaccgggaucagcuggugucugggcgucgaggacgccuccgagucuaagacucugaccguguccguaauggaccucagccagauguauucccccgucuucgaauaccugagcggggaccgccagguagaggaguggccgaaggcgacaugcaccggcgacugccccgagcggugcggcugcaccuccagcacgugccugcacaaggaguggccccacagccggaacuggcgcugcaaccccaccuggugcuggggcguggguaccgggugcacgugcugcgggcucgacgucaaggaccuguucacugacuauaugcuggugaaguggaagguggaguacaucaagaccgaggccaucaucugcgucgagcucaccucccaggagagacagugcagccugaucgaggcuggcacccgcuuuaaccuggggcccgugacgaucacccucagcgagccccggaacgugcaacagcgccugccgcccgagaucaucacccuucaccccaagaucgaggagggcuuuuucgaccucaugcacguucagaaggugaugagcgccuccaccgugugcaagcugcagagcugcacgcacgggguccccggcgaccuccagguguaccacguagggaaccuccugaaaggcgacaaggucaacggccacuccauccacaaaaucgagucccaccugaacaccuccuggaugagcugggaugggugcgaccucgacuacuucugcaacaugggcgacuggcccuccugcaccuacaccggggugacgcaacacaaccacgcagccuuuaucaacaugcugaacaucgagaccgacuacaccaagaccuuccacuuccacagcaagcgggucacggcccacggcgauaccccgcagcuggaccucaaggcgcgccccgccuacggggccggcgagaucacaguacugguggagguggccgaccuggagcuccacaccaagaagaucgaggucaguggccugaaauuugccagccugucaugcagcgggugcuacgcgugcagcucuggcaucucgugcaaggugcggauccacgugaacgagcccgacgaguucacuguccacguuaagagcaacgaccccgaugugguggccgcagggagcucccucauggcccgcaagauugagagcggagccgacuccaccuucaaggcguucagcucuaugccgaaaaacagccuuuguuucuacaucguggagcgggacuacugcuccagcugcaccgacgacgacacccagaagugugucgacaucaagcuggagcacccccaguccauccucaucgagcacaaggguacgaucaucggcaagcaaaacgacacgugcccaaccaagaccagcugcuggcuggaguccaucaagagcuucuucuacggccugaagaacaugcucucagggaucuucggcaacguguuccuggggaugcugcuguuccuggcccccuucauccugcucauccuguucuucuucuucgguuggagguuacuguucugccugaagugcugccggcgcacccgcaagcugcucaaguacaagcaccuccgggacgaggaagagucgggguacaagaagaucaucgagcgccugaaugacaagaagggcaagagccgccucuuugacggcgagcggcuggccgacaggaagaucgccgagcuguucagcaccaagacacacaucggg

SEQ ID NO: 15393 - RNA, 3495 nt, Artificial Sequence
  derived and/or modified CDS sequence (opt11) from CCHVF(CCHVF ArD15786)__DQ211627.1__Gn-NSm-Gc
gccgagggcggcagcaacgauugcgucucccgcacccagcuggucaagaccgaggugacagaaauccacgaggauagcuauggcgggccgggagagaagaucaccaucugcaacgggaguaccaucguggaccagcgacucggcagcgaguugggcugcuacaccaucaaccgcguccggacguauaaguugugcgagaacuccgccaccgagaaaucaugcgagauagacucggugccggugaaaugcaagcaagguuucugccucaagaucacccaggagggccgcgggcacgucaaacuuagccgggggaccgagaucgugcuggacgugugcgacacguccugcgagcucaugauacccaaggggaccggcgacauccuggucgacugcagcggcgggcagcagcacuuucugcaggacaaccucaucgaucucggcugccccaacaucccccugcucgggcaaaccgcgaucuacgugugccgaaugaguaaccacccgaagaccacgauggccuuucuguucugguucucauucggcuacgugaucacaugcgucgugugcaagguguuauucuacuuacugaucgucaucggcacccuggguaagcggcucaagcaguaccgcgagcugaagccccagacuugcauagugugcgaguccauccccgugaacgcaaucgacgccgaaaugcacgaccugaacuguaacuacaacaucugccccuacugcgcuagcaggcucacguccgacggcuuaguccgccacgugacccagugcccgaagcggaaggagaagguagaggagaccgagcuguaccucaaccucgagcgcauccccuggcuggucagaaagcuccuacaggugagcgaguccaccggcgucgcgcucaagagaagcugcuggaucaucacgcuccugauccugcugaccgucuccaugagccccgugcagagcgcccccgucggccacaagcgggcgguggagguuuaccaaauccgcgagucuuacaccggaaucugucuguucguccugggcggcguccucuucgcugugagcuggcuggugaaggcgcuaauagacuccaucgggaacuccuucuucccgggacucuccaucugcaaaaccugcagcaucgggagcauaaacggcuucgagauugagagucacaagugcuacugcucccugcuguguugccccuauugccgggccuguagcucugacaagaucacgcaccgcaugcaucugaacgugugcaagaagcggaagguggggagcaacgugaugcuggccgugugcaaacgcaugugcuuuaaggccaccaucgaagccaacaaccgggcgaccuucauccgcaacaucaucaacuccaccuucgugaucugcauccugauccucgugauaugcguggugucgacguccgccguggacauggagaaccugcccgccggcaucugggagaaggaggaggaccugaccaacuucugccaucaggagugccaagugacagagaccgagugucucugccccuacgaggcccuuaugcugcgcaagccgcugagccuggacucuaucgccaaagguaugaaaagccuccugaacuccacgagccucgagaccagccugucgauagaggccccguggggugcaaucaacguccaaagcaccuucaagcccaccaucuccgcggccaacaucgcccugagcugguccagugucgagcauaaggggaacaagauuuugguaucagggcgaagcgaguccaucaugaagcuggaggagcgcacgggcaucuccuggugccuggggguggaggaugcguccgagucaaagacccucaccguuuccguaauggacuugagucagauguacucccccguguucgaguaccugagcggcgaccggcaggucgaggaguggccgaaggcgaccugcaccggcgacugccccgaacgcugcgggugcacguccagcacaugccuccacaaggaguggccccacagccggaacuggcgcugcaaccccaccuggugcuggggcguggggaccggguguacgugcugcggacuggacgugaaggaccuguucacugacuacaugcucgucaaguggaagguugaguacaucaagaccgaggccaucaucugcguggagcugacuucccaggagcggcagugcagccugaucgaggccgggacacgcuucaaccucggcccggucaccauuacgcuguccgagccacggaacguucagcagcgccugccgcccgagaucaucacccuccaucccaagaucgaggagggguucuucgaccugaugcacguacagaaggucauguccgccucuacggugugcaagcugcaaagcugcacucacggcgugcccggggaccuccaggucuaccacgugggcaaccuccugaagggcgacaaggugaacggacacuccauccacaagaucgagucacaccucaauaccuccuggaugaguugggaugggugcgaccuggacuacuucugcaacaugggggacuggccuuccugcaccuacacgggcgucacccagcacaaccgggcggcauucaucaacaugcuaaacaucgaaaccgacuacaccaagacguuccauuuccacagcaagcgcgugaccgcccacggggacaccccacagcucgaccugaaggcccgucccaccuacggcgcgggcgagaucacggugcuggucgagguggccgaccuugagcugcauaccaagaagaucgagguguccgggcugaaauucgccagccugaccugcuccgguugcuacgccugcagcuccggcauaagcugcaagguccgcauccacgucaacgagcccgacgaguucaccguacacgucaaguccaacgaccccgacgugguggccgcgggcagcucccucauggcccggaaaaucgaguccggggccgacagcacguucaaagccuucuccagcaugccgaagaacucccuguguuucuacaucgucgagcgcgauuacugcagcuccugcacagacgacgacacccagaagugcguggacauaaagcucgagcacccgcaaagcauccugaucgaacacaaaggcaccauuaucggcaagcagaacgacacgugccccacaaaaaccuccugcuggcuggagagcaucaaguccuucuucuacggacucaagaacaugcugagcgggaucuucggcaacaucuucuuaggcaugcuucuguuccuggcccccuucguccuccugauccuguucuucuucuucggguggcggcuccuguucugccugaagugcugucgccggacccgcaagcuccuaaaguauaagcaccugagagacgaggaagagucaggcuauaagaaaaucaucgagcggcucaacgauaagaagggaaagagccgccuguucgacggagagcgguuggcggaccgcaagaucgccgaacucuucuccacgaagacccacgugggc

SEQ ID NO: 15394 - RNA, 3495 nt, Artificial Sequence
  derived and/or modified CDS sequence (opt11) from CCHVF(CCHVF ArD39554)__DQ211628.1__Gn-NSm-Gc
agcgaguccaacaauaacgacugcgugagccgcacccagcugaucaagaccgagaacgccgagauccacggcgacgacuacgggggccccggggagaagaucacgaucugcaacggcuccaccaucgucgagcagcggcucgggagugagcugggcugcuacaccaucaaccgcaucaaguccuucaagcugugcgagaacagcgccuccggcaaggggugcgagaucgacucuaccccggugaagugcaagcagggcuucugccucaagaucacgcaggaggggcggggccacgugaagcugucccgcgggagcgagaucauccuggacgucugcgacuccagcugcgagaugaugauccccaagggcuccggcgacauccucguggacugcagcgggggccagcagcacuuccugcaggacaaccugguggaccucgggugccccaacgucccccugcugggcaagauggcgaucuacaucugccggaugucaaaccacccgaagaccaccauggccuuccuuuucugguucagcuucggcuacgugauaaccugcaucuucugcaaggugaucuucuacguccugaucaucaucgggacccugggcaaacgcaucaagcaguaccgggagcucaagccccagaccugcacaaucugcgaggccacccccgugaacgccaucgacgccgagaugcacgaccugaacugcuccuacaacaucugccccuacugcgcgucgcgccugacguccgaggggcucgugagacacgucacccaguguccgaagcgcaaggagaagaucgaggagaccgagcuguaccuuaaccucgagcggauccccugguucgugcgcaagcugcuccaggugagcgagagcaccggcgucgcccucaagcggucaagcuggcuggugacgcugcucgugcugcugaccgucucccucagccccgugcaguccgcccccaucgggcaggagcgcaccgugguaaccuaccaggugcgggagagcuacacgggcaugugccuguucauccugggcuccgugcuguucgccaucagcuggcugaccaagggccuggucgacuccgugggcaacaucuucuucccggggcucagcgucugcaagaccugcuccaucggaagcaucaacggguuugagaucgagucccacaagugcuacugcagccuguucugcugccccuacugccgguacugcuccgcggaccggggcgcccaccagagccaccuguccgugugcaagaagcgcaagaccggcagcaacguaaugcucgccgucugcaagcggaugugcuuccgcgccacgcugaagguguccagcgaggcccugaucaucagaagcaucaucaacaccaccuuuguggucugcauccucauccugguggugugcgucguguccaccagcgcgguagagauggagaaccugccagccgggaccugggagaaggaggaggacuuaaccaacuucugccaccaagagugccaggucaccgagaccgagugccugugucccuacgaagccuucgugcugcgcaagccgcuuuuccuggacuccacggccaagagcaugaagucccugcugaacucuaccucccuggagaccagccuguccaucgaggcccccuggggcgcgaucaacgugcagagcaccuucaagcccacggccucuaccgccaacaucgcccugagcugguccagcgucgagcaccgcgggaacaagauccucgugacaggccgguccgagagcaucaugaagcuggaggagcgcaccgggaucuccuggaaccugggcguggaggacgccagcgagagcaagacccucacggucuccgugauggaccugagccagauguacuccaccguguucgaguaccugagcggcgaccggcaagucgaggaguggcccaaggcgaccugcaccggggacugcccggagcgcugcggcugcacguccucuaccugccuccacaaggccuggccgcacagccggaacuggcgcugcaaccccaccuggugcuggggcguggggaccggcugcacgugcugcgggcuggacgugaaaaaccuguucaccgacuacaugcucaucaaguggaaggucgaguucaucaagaccgaggccaucgugugcguggagcugaccagccaggagcggcagugcucccugaucgaggccggcacgcgcuucaaccucggucccgucaccaucacccugagcgagccccggaacauccagcagaagcugccgcccgagcuugugacccugcacccccgcguggaggaggguuucuucgaccugaugcacguccagaaggugcucuccgccaguacggugugcaagcugcaguccugcacccacgggguccccggcgaccuccagguguaccacgugggcaaccugcugaagggggacaagaucaacggcaacagcuuccacaagaucgagccuaaccugaacaccuccuggaugagcugggacgggugcgaccucgacuacuacugcaacaugggcgacuggccauccuguaccuauacgggggucacccagcacaaccacgcggccuucgugaaccugcuuaacaucgagaccgacuacaccaagaacuuccacuuccacagcaagcgggugacggcccacggcgagaccccgcaacucgaccugaaggcccgccccaaguacggcgcgggggaggucaccguccugguggaggucgccgacauggagcuacacaccaagaagaucgagaucuccggccugaaguucgccagccugacgugcaccgggugcuacgccuguagcuccggcaucagcugcaaggugcgacuccacguggacgagccugacgagcugaccguccacgugaaguccgacgaccccgacguggucgccgcgagcuccagccugauggcccgcaaaaucgaguucgggaccgacuccaccuucaaggccuucagcuccaugccgaaggacaagcucugcuucuacaucguggaacgggacuacugcagcuccugcagcaaggaggacacccagaagugcgugaacgccaagcuggagcagccccaguccauccugaucgagcacaagggcaccaucaucggcaagcagaacgauaccugcacggucaaggccagcugcuggcucgagucugucaagagcuucuucuacgggcugaagaauaugcugggagggaucuucggcaacgugauccucgggaucaucauguuccuggcgcccuucgcccuacuccugcuguucuuccucuucggcuggcgcauccuguucugccugcggugcugccgccggacccgcggccuauucaaguacaagcacaucaaggacgacgaggaguccggguacaagcgcaucaucgagcggcugaacaacaagaagggcaagaacaaacuguuugacggggagcgcuuggcagacaagaagaucgcagagcuguucagcaccaagacccacaucggc

SEQ ID NO: 15395 - RNA, 3495 nt, Artificial Sequence
  derived and/or modified CDS sequence (opt11) from CCHVF(CCHVF C-68031)__DQ211629.1__Gn-NSm-Gc
agcgaggaauccggcgacgacugcaucagccgcacccagcucucccggacugagacggccgagauccacucggacaacuacgggggccccggugacaagaucaccaucugcaauggcuccaccaucguggaucagcgccucgggagcgagcugggcugcuacaccaucaaccgggucaagucuuucaagcugugcgagaacagcgccacgggcaaguccugcgagaucgacagcaccccgaucaagugccgccaaggguucugccucaagaucacccaggagggcagggggcacgugaagcugucccgcggcagcgagguaguccuggacgcuugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccgaaugagcaaccacccgaagacaaccauggccuuccucuucugguucuccuucggcuacgugaucacgugcauuuuaugcaaggucaucuucuaccugcucaucgugguuggcacccuggggaagaaguucaaacaguaccgcgagcugaaaccccagaccugcacuaucugcgagaccacccccgucaacgccaucgacgccgagaugcacgaccucaauugcagcuacaacauaugccccuacugcgcgucccggcugacgagcgacggccuggcccgccacgugaugcagugcccgaagcggaaggagaagguggaggagaccgagcucuaccugaaccuggagcgcauccccugggucgugcggaagcuccuccaggugagcgaguccaccggggucgcccugaagcgcagcuccuggcucguggugcugcugguccuccugaccgugagccugucccccgugcaaagcgcccccaucggccacgggaagacggucgagaccuaccagacccgggagggcuacaccuccaucugucucuucgugcugggcagcauccuguuuaucguguccugccucaugaaggggcuugucgacagcgugggcaacuccuucuucccggggcuguccaucugcaagacgugcuccaucggcagcaucaacggguucgagaccgagucccacaagugcuacugcagccucuucugcugccccuacugccgccacugcuccgcggaccgggagauccacaagcugcaccugagcaucugcaagaagcgcaagacaggcuccaacgucaugcucgccgugugcaagcggaugugcuuucgcgccaccguggaggucagcaacaaggcccugcugauacggaacaucaucaacacgaccuucguggugugcauccucauccuggccgucugcguggugagcaccuccgcggucgagauggagagccugcccgccggcaccugggagcgcgaggaggaccucacgaacuuuugccaccaggagugccaggugaccgagaccgagugccugugucccuacgaggcccuggugcugcgcaagccccucuucucagacagcaucgucaaggggaugaagaaccuacugaacuccaccucgcucgagacgucccugagcauugaggcccccuggggcgccaucaacgugcaguccaccuucaagcccaccgugagcgcggccaacaucgcccuguccuggagcuccgucgagcaccgggggaacaagauccucgugagcggccguuccgagagcaucaugaagcuggaggaacggaccgggaucuccugggaccugggcguggaggacgccucggagagcaagcuccugaccgucuccaucauggaccugagccagauguacucccccgucuuugaguaccucagcggggaccgccaggucgaggaguggccgaaggccacgugcaccggggacugccccgagcgcugcggcugcaccuccagcacgugccugcacaaggaguggccccacucccgcaacuggcggugcaaccccaccuggugcuggggcgucggcaccggcugcacaugcugcgggcuggacgugaaggaccucuucaccgacuauauguucgugaaguggaaggucgaguacaucaagaccgaggcgaucgugugcguggagcugaccagccaggagcgucagugcucccugaucgaagccggcacccgguucaaccucgggccggucaccaucacgcugagcgagccccgcaacauccagcagaagcugccgcccgagaucgugacccuucacccgcggaucgaggagggguucuucgaccugaugcacgugaagaagguccuguccgccuccaccgugugcaagcuccaguccugcacccacggggugcccggcgaccugcaggucuaccacaucggcaaccugcugaagggggacaaggugaacggccaccuaauccacaagaucgagccccacuucaacacgagcuggauguccugggacgggugcgaccuggacuacuacugcaacaugggcgacuggccgagcugcuccuacaccggggugacccagcauaaccacgccgccuuugucaacaugcucaacauagagaccgacuacacgaagaucuuccacuuccacagcaagcgcgugaccgcgcacggcgacacgccccagcuggaccugaaggcccggcccaccuacggcgcaggggagaucaccgugcucgucgagguggccgacauggagcugcacaccaagaaaaucgagaucuccggccugaaauucgcgagccugaccugcaccgggugcuacgccugcagcuccggcaucagcugcaaggugcggauccacgucgacgaacccgacgaacugacagugcacgugaaguccgaggacccggacaucgucgccgccagcuccagccugauggcccggaagcucgaguucgggaccgacuccaccuucaaggcguucagcgccaugcccaagacgucccugugcuucuacaucguggagcgcgaguacuguaagagcugcuccaaggaggacacgcagaagugcgugaacaccaagcuggagcagccccagagcauccucaucgagcacaagggcaccaucaucggcaagcagaacgacacgugcaccuccaaggccgggugcuggcuggagagcgucaaguccuucuucuacggccugaagaacaugcucagcgggaucuucggcaacguguucaucgggaucuuccuguuccuggcccccuucauucuccugauccuuuucuuuauguucggcuggcggauccucuucugcuucaagugcugccgucggaccagaggacuguucaaguaccgccaccugaaagacgacgaggagaccggguaccggaagaucaucgagcgccucaacaacaagaagggcaagaacaagcugcuagacggggagcgccucgccgaccgcaagaucgcggagcuguucuccaccaagacccacaucggc

SEQ ID NO: 15396 - RNA, 3495 nt, Artificial Sequence
  derived and/or modified CDS sequence (opt11) from CCHVF(CCHVF Drosdov)__DQ211630.1__Gn-NSm-Gc
ucugaggagcccggggacgacugcauaucccgcacucagcugcucaaaaccgaaacagcggagauucaugacgacaacuacggggguccgggggacaaaaucaccaucugcaacggauccacuaucguagaccagcggcugggguccgagcuggguugcuacacuaucaaccgcguuaaguccuucaagcucugcgaaaauuccgccacgggcaaaaccugugagauugacucgacccccguaaagugccgccagggguucuguuuaaaaaucacucaggagggacgcgggcaugugaaauuauccagaggcucagaggucguacucgacgcgugcgacuccagcugcgaggucaugauccccaagggcacgggcgacauacuggucgauugcuccggcgggcagcaacacuuucugaaagacaacuuaaucgaccuggguugcccccauaucccgcugcucgguaagauggccauuuacaucugccggaugagcaaccacccgcggaccaccauggccuuuuuauucugguuuuccuucggcuacgugauaaccugcaucuucuguaaggcucuguucuacagccucaucaucaucgguacccucgggaagaaaaucaagcaguaccgcgagcugaagccccagacaugcaccauaugcgagaccgcccccgugaacgccaucgacgcagagaugcacgaccucaagugcagcuacaacauaugucccuacugcgcaucacggcugacguccgacggccuggccaggcacgucacacagugucccaaacggaaggagaagguggaggagaccgagcucuaccugaaucuggagcgcauccccuggaucguacggaagcuccuccaggugagugaguccacggggguagcucugaagcguagcagcuggcugauagugcuucugguacuucugacggugucgcuuagcccuguccaguccgcgccggucggccacgguaagaccaucgagacuuaccagaccagggagggguucacgucuauuugucucuucaugcugggguccauccuguucauugugucuugccucgugaaagggcuggucgacuccgugagcgacaguuucuucccaggacugagcgugugcaagaccugcuccaucgggagcaucaacggauucgagaucgagucccacaaaugcuacugcucgcuguucugcugccccuacugccgccacuauucagccgaccgugagauccaccagcuccaucugagcaucugcaagaagcgcaagaccggguccaacguaaugcucgcuguguguaagcggauguguuucaaggcgaccaucgaggccagccgccgggcccugcugauccguaguaucauuaacacgaccuucgucaucugcauacuuauccuagccaucugcgugguuagcaccuccgccguggagauggaaaaucugccggccggcaccugggagcgcgaagaggaucucacgaacuuuugccaccaggagugccaggugaccgagaccgaaugccuguguccguacgaggcucugguacuacggaagcccuuauuucuggauuccaccguaaaagggaugaaaaaccugcuaaacucgacgucccuggaaaccucacucucuaucgaggccccuuggggcgccaucaacguccagagcaccuucaagccaacagugagcacagccaacaucgcacugagcuggucgagcgucgaacaccgcgggaacaagauccugguaacgggccgguccgagagcaucaugaagcuagaggagcguacaggcguguccugggaccucggggucgaggacgcaucggaguccaagcugcugaccgugagcaucauggaccucucccagauguacagcccgguguuugaguaucugaguggcgacagacaggucgaggaguggcccaaggcgaccugcacaggcgacugcccugagcgcugugggugcaccaguagcacuugccugcauaaagaauggccccacucccggaacuggcgcugcaacccgaccuggugcuggggcguggggaccgggugcacuugcuguggcguggacgucaaggaccucuucacugaccauauguucgugaaguggaagguggaguacaugaagaccgaggccauugucugcguggagcugaccagccaggagcgucagugcucccugaucgaagccggcacccgcuucaaucucgggccagugacaaucacccugucggagccccggaacauacagcaaaagcugcccccggagaucauaacccuccacccuaagaucgaggagggauucuucgaucugaugcacguccagaaggugcuuuccgccagcacaguguguaagcuccaguccugcacccacggcauccccggggaccugcagaucuaccauaucggcaaccugcucaagggcgaccgcgucaacgggcaccugauccacaagaucgagccccacuucaacaccucauggaugucuugggauggcugcgaccuggacuacuacugcaacauggggaacuggcccucaugcacguacaccggcguuacccagcauaaccacgcggcuuucgugaaccuccugaacaucgagaccgacuauacgaagaccuuccacuuucacuccaaacgagucaccgcccacggugauacgccccagcuggaucucaaggcgcgccccaccuacggugcaggcgagauuaccguacugguagagguggcggacauggaacugcacacgaagaagguggagaucagcgggcugaaguucgcuucgcucgucugcacaggcugcuacgccugcagcuccgggaucagcugcaagguucgcauacauguggacgagcccgacgagcugacggugcacgucaaguccagcgaucccgacguaguggcggcgagcaccucccucauggcccgcaagcucgaguuugguaccgacagcaucuucaaggccuucuccgcaaugcccaagaccucgcuguguuucuacaucgucgagcgugaguacugcaaguccugcagcgaggaugacacgaagaagugcguggacacuaagcucgaacagccccaaaguauccugaucgaacacaaggggaccauaaucggcaagcaaaacgacacaugcaccgccaaggcgucgugcuggcuggaguccgucaagagcuucuucuacggccucaagaacaugcuaggguccguguuuggcaacuucuucguggggauccuccucuuccuggccccuuucgugcugcuaguccuguucuucauguucggcuggaaaauccuauucuguuucaagugcugccgccgaacucgcggucucuucaaguaccgccaucugaaggacgacgaagagaccggguacaggcggaucaucgagcggcugaacagcaaaaagggcaagaaccggcuccuggacggggagcgguuagccgaccguaagaucgccgagcuuuucuccaccaagacccacaucggc

SEQ ID NO: 15397 - RNA, 3495 nt, Artificial Sequence
  derived and/or modified CDS sequence (opt11) from CCHVF(CCHVF Kashmanov)__DQ211631.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgaguuaggcugcuacaccaucaaccgggucaagagcuucaaguuaugcgagaacuccgccacgggcaagaccugcgagaucgauagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcggacagcagcacuuccugaaggacaaccucaucgaccugggcugcccccacaucccgcugcucgggaagauggccaucuacaucugccggaugagcaaucacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcucccgugaacgcgaucgacgccgagaugcacgaccucaacugcuccuacaacaucugcccguacugcgcgagccgccugacguccgauggccuggcccggcacgucccccagugccccaagcgcaaggagaagguggaggagaccgagcucuaccugaaccuggagcggauccccuggaucgugcggaagcuccugcaggucagcgaauccaccgggguggcgcugaaacggagcagcuggcucaucgugcugcugguccuccugaccgugucccugagcccgguccaguccgcccccgucggccacgggaagacgaucgagaccuaccaaacccgcgagggcuucaccagcaucugccucuucaugcugggcuccauccuguuccucgugagcugccuggugaaggggcuggucgauagugugagcgacuccuucuuccccggccucagcgugugcaagacgugcaccaucggguccaucaacggcuucgagaucgagagccacaagugcuacugcucccuguucugcugccccuauugccggcacugcagcgccgaccgcgagauccaccagcugcaccucuccauuugcaagaagcggaagaccgggagcaacgucaugcuggccguaugcaagcgcaugugcuuccgugccaccaucgaggcgucccgccgcgcccugcucauacggucaaucaucaacacgaccuucgucaucugcauccugacucugacgaucugcgugguauccaccagcgccgucgagauggagaaccucccgagcggcaccugggagcgcgaggaggaccugaccaauuucugccaccaggagugccaggugaccgagacggagugccugugccccuacgaggcccuggugcuccggaagccccuguuucuggacuccaucgucaagggcaugaagaacagccuaaacuccaccagccuggagaccagucugagcaucgaggcccccuggggcgcgaucaacgugcaguccaccuucaagccgaccgugagcacggccaacaucgcccucuccuggagcuccgucgagcaucgcgggaacaagauccuggugaccgggcggagcgaguccaucaugaaacuggaggagcguaccggcgugucgugggaccucggggucgaggacgccuccgagagcaagcugcugaccguguccaucauggaccucagccagauguacagccccguguuugaguaccuguccggcgaccggcaagucgaggaguggcccaaggccacgugcaccggcgacugccccgagcggugcgggugcaccagcuccacgugccugcacaaagaguggccacacagccggaacuggcgcuguaaccccaccuggugcuggggcguggggaccggcugcacuugcugcggcguggacgucaaggaccucuucaccgaccacauguucgugaaguggaagguggaguacaucaagacagaggcgaucgucugcguggagcugaccucccaggaacggcagugcagccugaucgaggccggcacccgcuucaaccucggccccgugaccaucacccuguccgagccccggaacauccagcagaagcugccgcccgagaucaucacccuucacccgaagguagaggaaggguucuucgaccugaugcacgugcagaaagugcugagcgcuuccaccgucugcaagcuccagagcugcacccacggcaucccgggggaccuccagguguaccacaucggcaaccugcucaagggcgaccgcaucaacgggcaccugauccacaagauugagccgcacuucaacacuuccuggaugagcugggacggcugcgaccuggacuacuacugcaacaugggggacuggccuuccugcaccuacaccggcgugacccagcacaaccacgccgccuucgucaaccuacugaacaucgagaccgauuacaccaagaccuuccacuuccacagcaagcgggugaccgcgcacggggacacgccccagcuggaccucaaggcccgcccgaccuacggcgccggcgagaucaccgugcuagucgagguggccgacauggagcugcacaccaagaagguggagaucuccggguuaaaguucgcgagccuggcaugcacgggcugcuacgccugcuccagcgggaucuccugcaagguccggauccacguggacgagcccgacgagcugacgguacacgucaagagcagcgaccccgaugugguggccgccuccaccagccucauggcgcgcaagcuggaguucggcaccgacuccacguucaaggcauucagcgccaugcccaagaccucacugugcuucuacaucgucgagcgggaguacugcaagagcugcuccgaggaggacacccagaagugcguggacaccaagcucgagcagccgcagagcauccugaucgagcacaaggggaccaucaucggcaagcagaacgacacgugcaccgccaaggccuccugcuggcuggagagcgugaaguccuucuucuacggccucaagaacaugcuggggagcgucuucggcaacuucuucaucgggauccugcuguuccuggcgcccuucgugcugcucgugcuauucuucauguucggcuggaagauccuguucugcuucaagugcugcaggcgcacccgggggcuccugaaguaucgccaccugaaggacgacgaggagaccggcuaccggcgcaucaucgagcggcucaacaacaagaagggcaaaaaccgacugcuggacggggagcggcucgccgaccgcaagaucgccgagcuguucuccacgaagacacacaucggc

SEQ ID NO: 15398 - RNA, 3495 nt, Artificial Sequence
  derived and/or modified CDS sequence (opt11) from CCHVF(CCHVF Oman)__DQ211632.1__Gn-NSm-Gc
agcgaggagagcggggaggauugcaucagccgcacccagcugcuccggaccgagacagccgagauucauggggacaacuacggcgggcccggcgacaagaucaccaucugcaacggguccaccaucguggaccagcgccugggcagcgagcugggcugcuacaccaucaaccgggucaaguccuucaagcuaugcgagaacagcgccacgggcaagagcugcgagaucgacaacaccccggugaagugcaagcagggguucugccugaagauuacccaggaggggcggggccacgugaagcugagccgggacuccgaggucguguuggacgcgugcgacagcuccugcgagaucaugauccccaaggggacgggcgacauacuuguggauugcagcggcgggcagcagcacuuccucaaggacaaccucaucgaccugggcugccccaacauccccuuacucgggaagauggccaucuacaucugccgcaugucaaaccacccgaagacgaccauggccuuccuguucugguucagcuucggcuacgucaucaccuguauucugugcaaggugaucuucuaccuccugaucguggucggcacgcuggggaagaaguuuaagcaguaccgggagcucaagccccagaccugcaccaucugcgagaccacccccgugaacgccaucgacgccgagaugcacgaccugaacugcucauacaacaucugccccuacugcgcgucucgccugacguccgacggccucgcccggcacgugaugcaguguccgaagagaaaggagaaaaucgaggagaccgagcuguaccugaacuuggagcggauccccugggucgugcggaagcuguuacaggugagcgaguccaccggggucgcccucaagcgcagcagcuggcugaucgugcugcucgugcugcugaccgucucccucagccccgugcaguccgcccccaucggccacgggaagaccaucgagaccuaucagacccgcgaaggguacaccagcaucugccuguucgugcugggcuccauccucuucaucgucagccaccugaugaaggggcugguggacucagugggcaacucuuucuucccggggcucuccaucugcaagacgugcagcaucggcuccaucaacggguucgagaucgaaagccacaagugcuucugcucucuguucuguugcccauacugccggcacugcagugcggacaaagagauccacaagcugcaccucuccauuugcaagaagcgcaaggccggcagcaacgucaugcuggccguguguaagagaaugugcuuccgcgccacgauggaggucuccaauaaggcccuacucauacggagcgucaucaacaccaccuucguggucugcaucuuaauccuggcggugugcguggucuccacgagcgccguagagauggaaagccucccggcgggcaccugggagcgggaggaggaccugaccaacuucugccaccaggagugucaggugaccgaaaccgagugccugugccccuacgaggcccugguccuccggaagccgcuguucuuggauaguaucgccaaggggaugaagaaccuccugaacagcaccucccuggagaccucacucuccaucgaagcgcccuggggcgccaucaacguccagagcaccuucaagcccacgguguccaccgcuaacaucgcccugagcugguccagcguggagcacagggggaacaagauccugguguccggccgcagcgagucaaucaugaagcucgaggagcggaccggaaucucgugggaccugggcguggaggacgccuccgaaagcaagcuguuaaccgucuccgugauggaccugagccagauguacucacccguguuugaguaccuguccggcgacagacaggucgaggaguggccgaaggcgaccugcacgggggacugccccgaacggugcggcugcaccagcuccacgugccuucacaaggaguggccccacagccgcaacuggcggugcaaccccaccuggugcuggggcgucgggaccggcugcacaugcugcgggcuggacgugaaggaccuguucaccgacuacauguucgucaaguggaagguggaguacauaaagaccgaggccaucgugugcgucgagcucacgucccaggagcgccagugcagccugaucgaggcgggcaccagauucaaccuggggccggugacuaucacccucuccgagcccagaaacauccagcaaaaacuaccacccgagaucgugacgcugcacccccggaucgaggagggcuucuucgaccucaugcacguccagaagguucugagcgccuccaccgugugcaagcuacagagcugcacccacggaguccccggcgaccuccagguguaccacaucggcaaucugcugaagggggacaaggugaacggccaccucauccacaaggucgagccccauuucaacaccuccuggaugagcugggacgggugcgacuuggacuacuacugcaacaugggcgacuggccguccugcacguacaccggggugacccagcacaaccacgccgcguucgugaaccugcucaacaucgagaccgacuacacgaagaacuuucacuuccacagcaagagggucaccgcccacggcgacacaccccagcuagaccugaaggcccgccccaauuacggcgccggcgaggugaccgugcucguagagguggcggacauggaauugcacaccaagaagauugagauuucaggccugaaguucgccagccugaccugcaccgggugcuacgccugcucaagcgggaucuccugcaaggugcgcauccacgucgaugagccugacgagcugaccgugcacgucaagucggaggacccggacauuguggccgccucuuccucgcugauggcgcggaaguuagaguucgggaccgacuccaccuucaaggccuucagcgccaugcccaagaccucccugugcuuuuacaucguggagcgcgaguacugcaagagcugcucuaaggaggacacccagaagugcgugaacgccaagcuggagaggccccagagcauccucaucgaacacaaaggcacgaucaucggcaagcagaaugacacgugcaccgccaaggcgaguugcuggcucgagagcgucaaguccuucuucuacgggcugaagaacaugcucagcggcaucuucgggaauguguucaucggcaucuuccuguuccuggcccccuucauccuacugauccuguucuucauguucggguggcgcauccucuucugcuucaagugcugccggcgcacccggggccucuucaaguaccgccaccugaaggacgacgaggagaccggcuaccgcaagaucaucgagagacucaacaacaagaaggggaagaacaagcugcuggacggcgagcgccuagccgaccgaaagaucgccgagcuguucuccaccaagacccacaucggg

SEQ ID NO: 15399 - RNA, 3495 nt, Artificial Sequence
  derived and/or modified CDS sequence (opt11) from CCHVF(CCHVF SPU97/85)__DQ211633.1__Gn-NSm-Gc
agcgaggaguccgacggcgacugcaucagccgcacccagcugcuccggacugagacggccgagauccacuccgacaacuacgggggccccggggacaagaucaccaucugcaacggcucuaccaucguggaccagcgccugggguccgagcugggcugcuacaccaucaaccgggucaagagcuucaaacucugcgagaacuccgccacgggcaagagcugcgaaaucgacuccaccccggugaagugccgccagggcuuuugccugaagaucacccaagagggacgggggcacgugaagcugagucgcggcuccgagaucguccucgacgcgugcgacagcuccugcgagaucaugauacccaaggggaccggcgacauauuaguggacuguagcggcgggcagcagcacuuccugaaggauaaccucaucgaccugggcugccccaacaucccccugcucgggcggauggccaucuacaucugccgcauguccaaccacccgaagacgaccauggccuuccuguucugguucagcuucggcuacgugaucacgugcauccugugcaaggucaucuucuaccuccugaucguggccggcaccguggggaagaaguucaagcaguaccgggagcugcgcccccagaccugcaccaucugcgagaccacccccgucaacgccauugacgcggagaugcacgaccucaacugcuccuacaacaucugccccuacugcgccagccggcucacguccgacggccuggcccgccacgugaugcagugcccgaagcggaaggagaagaucgaggagaccgagcuauaucugaaccuggagcgcauccccugggugguccggaagcuccuccaggugagcgagagcaccgggguggcccugaaacgcuccagcuggcugacaguccugcugguguuacugaucgugucccugagccccguccaguccgcgcccaucggccacgggaagacgaucgagaccuaccaggcccgcgaggguuacaccagcuucugucucuucauccugggcaguauccuguucaucgugagcugccucgugaaggggcugaucgacuccgucggcaacaguuucuucccgggccuguccaucugcaagaccugcagcaucggcuccgugaacggguucgagaucgagagccacaagugcuacugcuccuuauucugcugccccuacugccgccacugcagcgccgaccgggagauccacaagcugcaccuguccaucugcaagaagcgcaaaacgggcagcaacgugaugcucgccgucugcaagcggaugugcuuccgcgccaccaucgagguguccaaccgcgcgcugcugauccggagcaucaucaacaccaccuucgccgucugcauccucacgcuggccgugugcguggucucuaccuccgccguggagauggaaagccugcccgccggcaccugggaacgcgaggaggaccucaccaacuucugccaucaggagugccagguaacggagaccgagugccugugccccuacgaggcgcugguccugcggaagccccucuuccuggacuccauugugaaggggaagaagaaccugcucaacagcaccucccuggagaccagccuguccaucgaggcccccuggggcgcaaucaacgugcagucgacguucaagcccaccgucuccgccgccaacaucgcgcucagcugguccagcguggagcaucgcgggaacaagauccugguguccggccggagcgaguccaucaugaagcuggaggagagaaccgggaucagcugggaccucggcgucgaggacgccuccgagagcaagcugcugaccgugagcgugauggaccucucccagauguacagccccgucuucgaguaccuguccggcgaccgccagguggaggaguggccgaaggcgaccugcacgggggacugcccagagcggugcggcugcaccaguuccacgugccugcacaaggaguggccccacagccggaacuggcgcugcaaccccaccuggugcuggggcguggggaccggcugcacgugcugcgggcucgaugucaaggaccuguucaccgacuacauguucgugaaguggaagguggaguacaucaagaccgaggccauugucugcguggagcugacuucccaggagcggcagugcagccugaucgaggccggcacccgcuucaaccuggggccgguuaccaucacccuguccgagccccggaacauccagcaaaagcucccgcccgagaucaucacgcugcacccgcgcaucgaggagggcuucuucgaccugaugcacguccagaaaguguugagcgccuccaccgugugcaagcugcagagcugcacccacgggguccccggcgaccuccagguguaccacaucggcaaccugcugaagggcgacaaggugaacggccaccugauccacaagaucgagccccacuucaacaccuccuggaugagcugggacgggugcgaccucgacuacuacugcaacaugggcgacuggccguccugcacguacaccggggucacccagcacaaccacgccgccuucgugaaccugcugaacauugagaccgacuacacgaagaacuuccacuuccacagcaaacgggucaccgcccacggugacacgccccagcucgaccugaaggcgcgccccaccuacggcgccggggaggucaccgugcugguggaggucgccgacauggagcuccacaccaagaagaucgaaaucuccggccugaaguucgccagccuguccugcacuggaugcuacgccugcagcagcggcaucaguugcaaggugcggauccacguggacgagcccgaugagcucaccguccacgucaagagcgaggacccggacaucguggcggccggguccagccugauggcccgcaagcucgaguucggcgccgacuccacguucaaggccuucagcgcgaugccaaagaccucucucugcuucuacaucguggaacgggaauacugcaagucgugcucccgcgaggacacccagaagugcgugaacaccaagcuggagcgcccccagagcauccugaucgagcauaagggcacgaucaucgggaagcagaacgacacgugcaccgccaaggccuccugcuggcucgagagcgugaaguccuucuucuacggccucaagagcaugcugucugggaucuucggcaacgucuucaucgggaucuuccuguucaucgccccguucgugcugcugauccucuucuucauguucggcuggcggauccuguucugcuucaagugcugccgccggacccgcggccuguucaaguaccggcaccucaaggacgacgaggagaccggguaccgcaagaucaucgagcggcugaacaacaagaagggcaaaaacaagcugcucgacggggagcgccuggccgaccgcaagaucgcggagcuguucucgaccaagucccacauuggc

SEQ ID NO: 15400 - RNA, 3495 nt, Artificial Sequence
  derived and/or modified CDS sequence (opt11) from CCHVF(CCHVF SPU103/87)__DQ211634.1__Gn-NSm-Gc
agcgaggaguccagcgaugacugcauuucucgcacccagcugcuccggacagagacggccgagauccacggcgacaacuacgggggccccggggacaagaucaccauuugcaacggcagcaccaucguggaccagcgccugggguccgagcugggcugcuacaccaucaaccgggucaagacguuuaaauuaugcgagaacagcgccaccggcaaguccugcgagaucgauagcgugccggugaagugccgccagggguacugccugaagaucacccaggagggccggggucacgucaagcugucccgcggcagcgaggugguucucgacgcgugcgacaccuccugugagguaaugauccccaaggggacuggcgacauacugguggacugcagcggcgggcagcagcauuuucugaaggacaaccucaucgaccugggcugcccgaagaucccccugcuaggaaagauggccaucuacaucugucggaugucgaaccacccgaagaccaccauggccuuccuguucugguucagcuuuggcuacgugaucacgugcguccugugcaaagccaucuucuaccuccugauaaucgugggcacgcuggggaagcgccucaagcaguaccgggagcugaagccccagaccuguaccaucugcgaaaccacgcccguuaacgccaucgacgcggagaugcacgaccugaauugcucuuacaacaucugccccuauugcgccagccgccucaccuccgacggccuggcccggcacgucacucagugcccgaagcgcaaggagaagguggaagagaccgaacuguaccucaaccuggaacggauccccugggugguaagacggcugcuccagguuagcgaguccacggggguggcccuaaaacgcagcagcuggcugaucguccugcuggugcuguucaccgugucccuaagccccguccaguccgcgcccaucagccacggcaagaccguggaggccuaccaggccagggagggguacaccggcaugugccuguucgugcugggcuccauccucuuccuggucagcugccugaugaagggccucguggacuccgucggcaacacguucuucccggggcugaguaucugcaaaaccugcuccaucagcuccaucaacggguucgagaucgagagccacagaugcuacugcucccuguucugcugccccuacugucggcacugcagcgccaauaaggagauccaccagcuccaccuguccaucugcaagaagcgcaagaccgggagcaacgugaugcuggccgucugcaagcggaugugcuuccgcgcgaccauggaggucuccaaccgcgcccucuucauccggagcaucaucaacaccaccuucgugcuguguauccugauccucgccgugugcgucgucuccaccagcgccguggagauggaaagccugcccgcgggcaccugggagcgcgaggaggacuugacaaacuucugccaccaggagugccaggucacagacaccgagugccuaugucccuaugaagcgcucgugcugcgccggccgcuguuccucgacaacaucgugaagggcaugaagaaccugcugaacucaaccagccuagaaacgucccuuagcaucgaggcgcccuggggcgccauaaacguccagaguaccuacaagccgaccgugucaaccgccaacaucgcgcuuuccuggagcuccguggagcacagggggaacaagauccucgucagcgggcgcuccgagagcaucaugaagcuggaggagcguaccggcaucuccugggaccuggggguggaggacgcgagcgaguccaaacuccugacggugucggucauggaccugucccagauguacucuccugucuucgaguaccucagcggcgaccgccagguggaggaguggccgaaggcgacaugcaccggcgacugccccgagcggugcgggugcaccaguagcacgugccugcacaaggaguggccucacucccgcaacuggcggugcaacccuaccuggugcuggggcgucgggaccggcugcacguguugcggccuggacgugaaggaccucuucaccgacuacauguucgugaaguggaagaucgaguacauuaaaaccgaggccauugucugcgucgagcugaccagccaggagcgccagugcucgcugaucgaggccgggacccgguucaaccuaggccccgugacgaucaccuugagcgagccccgcaacauccaacaaaagcugcccuccgagaucauaacccuccacccccggaucgaggagggguucuucgaccugaugcauguccagaaggugcugagcgcauccaccgugugcaaguugcagagcugcacgcacggcguaccgggggaccuucagguguaccacaucggcaaccugcugaagggcgacaaggugaacgggcaccugguccacaagaucgaaccccacuucaacaccuccuggaugagcugggacggaugcgaccuggacuacuacugcaacaugggagacuggcccuccugcaccuacacuggcgucacgcagcacaaccacgccagcuucgugaaccuccuaaacaucgagacggauuacaccaagaacuuccacuuccauuccaagcgcgucaccgcccacggggacacgccgcagcuggaccucaaggcacggcccaccuauggcgccggugagaucaccgugcugguggaggucgcggacauggagcugcacaccaagaaaaucgagaucagcgggcucaaauucacgucccugacuugcacuggcuguuacgccugcagcuccgggaucagcugcaaggugagaauccacguggacgagcccgacgagcugaccguccacgucaagagcgacgaccccgacguaguggcugccaguagcucccuuauggccaggaagcuggaguucggaacggacagcaccuuuaaggcguuuuccgccaugccgaagaccagccuguguuucuacaucguggaacgcgaguacugcaaguccuguagcgaggaggacacccagaagugcgugaacacgaagcucgagcagccccagaguauccugaucgagcauaaagggaccaucaucggcaagcagaacaauacgugcaaggcccgcgccggcugcugguuggagagcgucaaguccuucuucuacgggcucaagaacaugcuuagcgguaucuucgggaacguguucaucggcaucuuccuguuccuugcccccuucauccugcugauccucuucuucauguucggguggcggauccuguucugcuucaagugcugccgccggacccgcggccuguucaaguaccggcaccucaaggacgacgaggagaccggcuaccgcaagaucaucgagcggcugaacaacaagaaggggaagaacaagcuguuggacggcgagcgccuggcggaccggcgcaucgccgagcuguucucuaccaagacccacaucggg

SEQ ID NO: 15401 - RNA, 3495 nt, Artificial Sequence
  derived and/or modified CDS sequence (opt11) from CCHVF(CCHVF SPU415/85)__DQ211635.1__Gn-NSm-Gc
agcgaggaguccgacggcgacuguaucagccggacccaacugcuccggacugagacgaccgagauucacuccgacaacuacgggggccccggggacaagaucaccauuugcaacggcagcaccaucguggaccagcgcuugggguccgagcugggcugcuacacgaucaaccgggucaagagcuucaaguugugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgauagcaacugcgagaucaugauccccaaggggacgggcgacauccugguggauugcuccggcgggcaacagcacuuccugaaggacaaccucaucgaccugggcugccccaacaucccgcugcucgggaagauggcgaucuacaucugccggaugagcaaccacccgaagaccaccauggccuuccuguucugguucuccuucggcuacgugaucacgugcauccugugcaaggucaucuucuaccuccugaucguggccggcaccguggggaagaaguucaagcaauaccgcgagcugcggccccagaccugcaccaucugcgagaccauccccgucaacgccaucgacgccgagaugcacgacuugaacugcagcuacaacaucugccccuacugcgcgucccgccugacgagcgacggccuggcccggcacgugaugcagugcccgaagcgcaaggagaagguggaagagacggagcucuaccugaaccuggagcggauccccugggucgugcgcaagcuccuccagguguccgagagcaccggggucgcccuaaagcggagcuccuggcugacugugcugcugguacuccugaucgucagccugucccccgugcagagcgcccccaucggccacgguaagacgaucgagaccuaccaggcccgcgagggcuacaccuccuucugccucuucauccugggcagcauccuguucgugguguccugccucgugaaggggcugaucgacagcgugggcaacuccuucuuuccggggcuaagcaucugcaagaccugcuccaucggcagcaucaacggguucgagauugagucccacaagugcuacugcagccucuucugcugccccuacugccggcacugcuccgcggaccgcgagauucacaaguuacaccucucaaucugcaagaagcggaagacgggcuccaacgucaugcucgccguguguaagcgcauguguuuccgggccacaaucgaggucagcaaccgcgcccugcugauccgcaacaucaucaacaccaccuucgugguuugcauccucacgcucgcggucugcgugguguccaccagcgccgucgagauggagagccugcccgccggcaccugggagaaggaggaggaccucaccaacuucugccaccaggagugccaggugacggagaccgagugccucugccccuacgaggcgcuggugcugcggaagccccucuuccuggacuccaucgucaaggggaugaagaaccugcucaacagcaccucccuggagaccagccuguccaucgaggcccccuggggcgccaucaacgugcagagcacguuuaagcccaccguguccgccgccaacauugcccucagcugguccagcgucgagcaccgcgggaacaagauccugguguccggccggagcgaguccaucaugaagcuggaggagcgcaccgggaucagcugggaccucggcguggaggacgccuccgaguccaagcugcugaccgucuccgugauggaccucagccagauguacagccccguguucgaguaccuguccggcgacagacaggucgaagaguggccgaaggcgaccugcacgggggacugccccgagcgcugcggcugcaccagcuccaccugucugcacaaggaguggccccacagccggaacuggcgcugcaaccccaccuggugcuggggcguggggaccggaugcacgugcugcgggcucgacgugaaggaccuguucaccgacuacauguucgucaaguggaagguggaguacaucaagaccgaggccauugugugcgucgagcugaccucccaggagcggcagugcagccucaucgaggccggcacccgguucaaccuggggccggugaccaucacccuuuccgagccccggaacauccagcagaagcucccgcccgagaucaucacgcugcacccgcgcaucgaggaaggcuucuucgaccugaugcacgugcagcggguccucagcgccuccaccgugugcaagcugcagagcugcacccacggggugcccggcgaccuucaggucuaccacaucggcaaccuccugaagggggacaaagugaauggccaccugauccacaaaauugagccccacuucaacacguccuggaugagcugggacgggugcgaccucgacuacuacugcaacaugggcgacuggccguccugcacguacaccggggucacccagcacaaccacgccgcguucgucaaccugcugaacaucgagaccgacuacacgaagaacuuccacuuccacagcaagcgcgugaccgcccacggcgacacgccccagcucgaccugaaggcccggcccaccuacggagccggggaagugaccguccugguggagguggcggacauggagcuccacaccaagaagaucgagaucuccggccugaaguucgccagccugaccugcaccgggugcuacgccugcuccagcggcaucuccugcaaggucaagauccacguggacgagcccgacgagcuuacggugcacgucaagagcgaggacccggacaucguggccgccgggagcucccugauggcgcgcaagcuggaguucggcgccgacagcaccuucaaggccuucuccgccaugcccaagaccagccucugcuucuacaucguugagcgggaguacugcaaguccuguagccgcgaggacacccggaagugcgucaacacgaagcuggaccgcccccaguccauccugaucgagcacaagggcaccaucaucgggaagcagaacaacacgugcaccgccaaggcgagcugcuggcucgaguccgucaagagcuucuuuuacggccugaagaacaugcugucagggaucuucggcaauguguucaucgggaucuuccucuuuaucgcccccuucgugcugcugauccucuucuucauguucggcuggcgcauccuguucugcuuuaaaugcugccggcgcaccagaggccuguucaaguaccgucaucucaaggacgacgaggagaccggguaccggaagaucaucgagagacugaacaacaagaagggcaagaacaagcugcucgacggggagcggcuggccgaccgcaagauagccgagcuguucagcaccaagucccacaucggc

SEQ ID NO: 15402 - RNA, 3495 nt, Artificial Sequence
  derived and/or modified CDS sequence (opt11) from CCHVF(CCHVF Turkey200310849)__DQ211636.1__Gn-NSm-Gc
agcgaagaacccggcgacgacugcaucucucgcacccagcuguugcggacugagacggccgaaauccacgaugacaauuacgguggcccgggggacaagaucaccauaugcaacggcagcaccaucguggaccagaggcugggcuccgaguuaggcugcuacaccauuaaccgagucaagagcuucaagcugugcgagaacuccgccacgggaaagaccugcgagguggacaguacgcccgugaagugccgucaggguuucugucugaagaucacccaggagggccggggucacgugaaguuauccagaggcagcgagguggugcucgacgcgugcgacuccagcugcgagguaaugauccccaaggggacgggggacauccugguagacuguuccggugggcagcagcacuuccuaaaggacaaccucaucgaccugggcugcccccacaucccgcuccucgggaagauggccaucuacaucugccggaugagcaaccacccacgcacaaccauggccuucuuauucugguuuuccuuuggcuacgugaucacgugcaucagcugcaaggcccuguucuacagucucaucaucauuggcacccuagggaagaagaucaagcaguaccgggagcuaaagccgcagaccugcaccaucugcgagaccgcgcccgucaacgcgauagacgccgagaugcacgaccucaacugcagcuacaacaucugcccguauugcgccucgcgccugacgagcgacggccuggcccggcacgugacccaaugccccaagagaaaggagaagguggaagagaccgagcucuaccugaaccucgagcggaucccauggaucguccgcaagcuccuucaggugagcgagagcaccgggguggcgcugaagcggagcuccuggcugaucguccugcugguacuccugacagugagccugagucccguucagagcgccccggugggccacggaaagaccaucgagaucuaccagacccgcgagggauucgccuccaucugccucuuuaugcugggcaguauccuguucaucguaucgugccucgucaagggucugguggacagcgugucugacagcuucuucccuggcuuguccgucuguaagaccugcagcaucggguccgugaacggcuucgagaucgaaucccacaaguguuacuguucacucuucugcugccccuacugcaggcauugcagugccgaccgcgaaauccaccaacugcacuugagcaucugcaagaagcggaagacggggucaaauguuauguuagccguaugcaagcguaugugcuuccgggcgaccaucgaggccucucgccgagcccugcucauccguucaaucaucaacacaaccuucgugaucugcauccucacguugaccaucugcgucgugucaaccuccgcgguggagauggagaaccugcccgccggcaccugggagcgcgaggaggaccucacaaacuucugucaccaggagugccaggucaccgaaaccgagugccugugcccguacgaagcgcuggugcuucggaagccccucuuccucgacagcaucgugaagggcaugaagaaccuguuaaacuccaccagccuggagacaucccugagcaucgaggcccccuggggcgccaucaacguccagucgaccuucaagccugccgucagcaccgcuaauaucgcgcuaucauggagcucaguggagcaccgcggcaacaagauacuggucaccgggcggagcgaguccaucaugaagcuggaagaacgcaccggcguuagcugggaccugggggucgaagacgccuccgagagcaaacuucuuacggucuccaucauggacuugagccagauguacagcccgguguuugaguaccuguccggcgaccgccagguggaggaguggcccaaggcgaccugcaccggcgacugcccggaacggugugggugcacaagcuccacgugucugcacaaggaguggccccauucucggaacuggcgauguaacccgaccuggugcugggguguggggaccggcugcacgugcugcggcgucgacgugaaggaccucuucaccgaccacauguucgucaaguggaagguggaguacaucaagacagaggcgaucgugugcguggagcugacaucccaagagcggcaaugcagccugaucgaggccgggacccgcuucaaccucggccccgugacgauuacucucuccgagccccggaacauccagcagaagcugcccccagagaucauuacccuccaccccaaaaucgaggagggguucuucgaccucaugcacgugcagaagguccugagcgcauccacagugugcaagcuccagucguguacgcacggcauccccggggaccuccagguguaucauaucggcaaccugcugaagggcgaccgcgucaacggacaccugauccacaagaucgagucccacuucaacaccagcuggaugaguugggacggcugcgaccuggacuacuacugcaauaugggggacuggccuagcugcacguacaccggagugacgcagcacaaccacgccgccuucgugaaccuccugaacaucgagacggacuacacuaagacguuccacuuccacuccaagcgggucacugcccacggggacacgccacagcuagaccucaaagcccgccccacguacggcgccggcgagaucaccgugcugguggagguagccgacauggagcugcacaccaagaaggucgagaucagcgggcuuaaguucgccuccuuagccugcaccggcugcuaugcgugcagcagugggaucagcuguaaggugcggauccacgucgacgagccagacgaguugaccgugcacgucaagagcuccgauccggacgugguagcugccaguacaucccucauggcucgcaaacuggaguucggcacggacuccaccuucaaggccuucuccgcgaugccuaagaccagccugugcuucuacauuguugagagggaguacuguaaguccugcucagaggacgacacccagaagugcguagacacgcgccucgagcagccccaguccauccugauugagcacaaagggaccauaauaggcaaacagaacgacacuugcaccgccaaagcgucgugcugguuagaguccguaaagagcuuuuucuauggccucaagaacaugcugggguccguguuugggaaccuguucaucgguauacuccucuuccuggccccuuucgugcucuuagugcuguucuucauguucggcuggaagauauuguucugcuucaaguguugccgccggacacgcggacuguucaaguaucggcaucugaaggacgacgaggagaccggcuaccgccggaucaucgagcgccucaauuccaagaaaggcaagaaccgccuacuggacggggaccgccucgccgaccggaagaucgcggagcuguucuccaccaagacccacaucggc

SEQ ID NO: 15403 - RNA, 3495 nt, Artificial Sequence
  derived and/or modified CDS sequence (opt11) from CCHVF(CCHVF Iran-52)__DQ446215.1__Gn-NSm-Gc
uccgaggaguccggcgacgacugcaucagucgcacccagcugcuccgcaccgagacggcugaggugcacggggacaacuacggcgggcccggcgacaagaucaccaucugcaacggguccaccgucguggaccagcgccugggcagcgagcugggcugcuacaccauaaaccgggugcgcuccuucaagcucugcgagaacagcgcuacggggaaguccugcgagaucgacagcaucccggucaagugcaagcagggcuauugucugaagaucacccaggaggggcggggccacgugaagcugucccgcggcagcgaggugguccucgacgugugcgacuccagcugcgaggugaugauccccaagggcaccggcgacauccuggucgacugcucagggggccagcagcacuuccugaaggacaaccucguggaucuggggugccccaagaucccccugcucggcaagauggcgaucuacaucugucggaugagcaaccacccgaaaaccacuauggcuuuccuguucugguucuccuucggcuacgucaucacaugcauccugugcaaggccaucuucuuucuccugaucaucuucgggacccuaggcaagcgcuucaagcaguaccgggagcugaagccccagaccugcacaaucugcgagaccacccccgucaacgccaucgacgccgagaugcacgaccugaacugcagcuacaacauaugccccuacugcgcgucccgccugaccagcgacgggcucgcacggcaugugacgcagugcccgagacggaaggagaagguggaggagaccgagcuguaccugaaucuggagcgcauccccugggucgugcggaagcugcuucaaguguccgagagcaccggcaccgucuugaagcgcagcuccuggcugaucgugcugcucgugcuguuuacggucagccugucccccgugcagucggcccccaucgggcauggcaagacgaucgagaccuaccgggugcgcgaggaguauaccuccaucugcuuguucguccugggcagcauccuguucaucguguccuuccucaugaaggggcuggucgacggcguugggaacaucuucuucccgggucugagcgugugcaagacgugcuccaucgggagcaucaacggcuucgagaucgagucccacaaguguuacugcagccucuucugcugccccuauugcaggcacugcuccgccgacggcgagauccaucagcugcaccugucgaucugcaagaagcgcaagacgggguccaacgucaugcucgcggugugcaagcggaugugcuucagagccaccauggaggugagcaacaaggcccuguucauccgcucaaucauuaauaccacguucguuguguguauccugaucuuagccgugugcgucgugagcaccuccgcgguggagauggagagccugcccgcgggcaccugggagcgggaggaggaucugaccaacuucugccaccaggagugccaggucacggagaccgagugccucugccccuacgaggcccuggugcugcgacggccgcuguuccucgacagcaucgugaaggggaugaagaaccugcugaacuccaccagccuugagaccucccugagcaucgaggcccccuggggcgccaucaacguccaguccacguacaagcccaccgugagcaccgccaacauagcgcuguccuggucgucuguggagcaccgcgggaacaagguccucgugucuggccgguccgagucuaucaugaagcuggaggagcgcaccggcaucuccugggaccuggggguggaggaugccagcgaguccaagcuccugaccgucagcgugauggaucucucccagauguacagccccguguucgaguaccucagcggcgaccggcaggucgaggaguggccgaaggccacgugcaccggggacugucccgaacggugcggcugcaccuccagcacgugccuacacaaggaguggccccacuccaggaacuggcgcugcaaccccaccuggugcuggggcguggggaccggcugcacguguugugggcuggauguaaaggaccucuucaccgauuacauguucgucaaguggaaggucgaauacaucaagaccgaggccaucgucugcgucgagcugaccagccaggagcggcagugcucccugaucgaggccggcacccgcuucaaccuggggagugugaccaucacacuguccgagccgcggaacauccagcagaaacuaccgccagagaucaucacccuccauccuaagaucgaggagggcuuuuucgaccucaugcacgugcaaaagguccugucugcguccaccgugugcaagcuccagagcugcacccacggcgugcccggggaccugcaggucuaccacaucggcaaucuguugaaaggggaccgcgugaacggccaccugauccacaagaucgagcagcacuucaacacuucauggauguccugggacggaugcgaccuggacuacuacugcaacaugggcgacuggcccaguugcacauacaccggcgugacccagcacaaccacgccagcuucgucaaccucuuaaacaucgagaccgacuacaccaagacuuuccacuuccacuccaagcgcgugaccgcacacggggacacgccccagcuggaccucaaggcccgcccgaccuacggcgccggggagaucaccguguugguagagguagcggacauggagcugcacacuaagaagaucgagauaagcggccucaaguucgccggucuuacgugcaccggcugcuacgccugcuccagcggcaucuccugcaaggugcggauccacgucgaggagcccgacgaguuaaccgugcacgucaaaagcgacgaccccgacgucguggccgcgagcuccagccucauggcccgaaagcucgaguucgggaccgauuccacuuucaaggccuucuccgccaugcccaagaccucccugugcuucuacauaguggagcgggaguacugcaaaagcugcuccaaggaggacacccagaagugcguuaacaccaagcucgagcagccgcagagcauccucaucgagcacaagggcacaaucaucggcaaacagaacaacacgugcacagccaaggcaaguuguugguuagagagcgugaaguccuucuucuacggccugaagaacaugcucgggggcaucuucggcaacgucuucaucgggaucuuuaccuuccugaccccauucauccugcugauccuguuuuucauguucggcuggcggauccucuucugcuucaagugcugccgccggacccgcgggcuguucaaauaccgucaccuaaaagacgacgaggaaaccggcuaccgcaagauaaucgagcggcuaaacaacaagaagggcaagaaccgccuguuggacggggagcggcucgccgaccgcaagaucgcagagcuguucagcaccaaaacccacaucggc

SEQ ID NO: 15404 - RNA, 3495 nt, Artificial Sequence
  derived and/or modified CDS sequence (opt11) from CCHVF(CCHVF Iran-53)__DQ446216.1__Gn-NSm-Gc
agcgaagaguccggcgaugacugcaucagccgcacccagcugcuccggaccgaaacggccgaggugcacggagacaacuauggcgggcccggugacaagaucaccaucugcaacgguucuaccgucguggaccagcgccucggaagcgagcugggcugcuacaccaucaaccgggugcguuccuucaagcucugcgagaacagcgccacggggaaguccugcgagaucgacagcaucccggucaagugcaagcagggauacugcuuaaagaucacccaggaggggcggggacacgugaagcugucacgagggagcgaggugguacucgacgugugcgacuccagcugcgaggugaugauccccaagggcaccggcgacauccuggucgacugcuccgggggccagcagcacuuccugaaggacaaccucguggaccuggggugccccaaaaucccccugcucggcaagauggcgaucuauaucugucggaugagcaaccacccgaagacaacgauggccuuccuguucugguucuccuucggcuacgugaucacgugcauccugugcaaggccauauucuuuuuacucaucaucuucggaacccugggcaagcgcuucaagcaguaccgggagcucaagccccagaccugcacgaucugcgagaccacccccgucaacgccauugacgccgagaugcacgaccugaauugcagcuacaacaucugccccuauugcgcuucccgacugaccagcgacgggcucgcccggcaugugacgcaaugcccgcgccggaaggagaagguggaggagaccgagcuguaccugaaccucgagcgcauccccuggguggugcggaaguuacugcaaguguccgagagcacuggcaccgucuugaagcgcagcuccuggcuaaucgugcuguuaguguuguucacggucagccugucccccgugcagagcgcgcccaucgggcacggcaagaccaucgagaccuaccgggugcgcgaagaguacaccuccaucugccucuucguccugggcagcauccuguucaucguguccuuccucaugaaggggcuggucgacggcguagggaacaucuucuucccgggccugagcguaugcaagacgugcuccauugggagcaucaacggcuucgagaucgagucccacaagugcuauugcagccucuucugcugccccuacugccggcacuguagcgccgacggcgagauucaccagcugcaccugagcaucugcaagaagcgcaagaccgguuccaacgucaugcucgccguuugcaagcggaugugcuuccgcgccaccauggaggugagcaacaaggcccuguucauccgcucaaucauuaacaccacuuucgucguguguauccugauccucgccgugugcgucgugagcaccuccgccguggagauggagagccugcccgcggggaccugggagcgggaggaggaccugaccaacuucugccaucaggagugccaagucacggagaccgagugccucugcccuuacgaggccuuggugcugcgccggccgcuguuccucgacagcauagugaaggggaugaaaaaccuucugaacuccaccagccucgagaccucccugagcauugaggccccuuggggcgccaucaacguccaguccacguauaagccgaccgugagcaccgccaacaucgcgcuguccuggagcuccguggagcaccgcgggaauaaaguccucgugucaggccgcuccgagagcaucaugaagcuggaggaacgcacaggcaucuccugggaccuggggguugaggacgccagcgagucaaagcuccugacggucagcgugauggaccucucccagauguacagccccguuuucgaguaccucagcggcgaccggcaggucgaggaguggccgaaggccacgugcacuggugacugccccgagcgcugcggcugcacguccagcacgugccugcacaaggaguggccccacucccggaacuggcgcugcaaccccacguggugcuggggcguggggaccggcuguacaugcugcgggcuggacgugaaggaucucuucacagacuacauguucgucaaguggaagguggaguacaucaagaccgaggccaucgugugcgucgagcugaccagccaggagcggcagugcucccuaaucgaggccggcacucgcuucaaccucgggagcgucaccaucacgcuguccgagccgcggaacauccagcagaagcugccgcccgagaucaucacccuccaucccaagaucgaggagggcuucuucgaccugaugcaugugcagaaaguccugagcgcguccaccguguguaagcuccagagcugcacccacggcgugcccggggaucugcaggucuaccacaucggcaaccugcuuaagggggaccgcgugaacggccaccucauccacaagaucgaacagcacuucaacacguccuggaugagcugggacgggugcgaccuggacuacuacugcaacaugggcgacuggcccuccugcaccuacacaggcgugacccaacacaaccaugccagcuucgucaaccuccuuaacaucgagacggauuacaccaagaccuuccacuuucauuccaagcggguuaccgcccacggggacacgccccagcuggacuuaaaggcccgcccgacauacggcgccggggaggugaccguccuggucgagguggcggacauggagcugcacaccaagaagauugagauaagcggccucaaguucgccgggcugacgugcacaggcugcuacgccugcuccagcggcaucuccugcaagguccggauccacguggacgagccugacgaacugacagugcacgucaagagcgacgaccccgacgugguggccgcgagcuccagccucauggcccgcaagcuggaguucgggaccgacuccacguucaaggcauucucagccaugcccaagacaucccuguguuucuacaucgucgagcgggaguacugcaaaucuugcucgaaggaggacacccagaagugcgugaacaccaagcucgagcaaccgcagagcauccugaucgaacacaagggcacgaucaucgggaagcagaacaacacgugcaccgcuaaggcguccugcuggcuggaaagcgucaaguccuucuucuacggccucaagaacaugcucgggggcaucuucggcaacguguucaucgggaucuucaccuuccugacccccuucauucugcugauccuguucuucauguucggcuggcgcauccucuuuugcuucaaaugcugccgccggacccgcgggcuguucaaguaccgccaccugaaggacgacgaggagaccggcuaccgcaagaucaucgagcggcucaacaauaagaagggcaagaaccgccugcuggacggggaacggcucgccgaccgcaagaucgcggaguuguucagcaccaagacccacaucggc

SEQ ID NO: 15405 - RNA, 3495 nt, Artificial Sequence
  derived and/or modified CDS sequence (opt11) from CCHVF(CCHVF Kosova Hoti)__EU037902.1__Gn-NSm-Gc
agcgaggaacccggcgacgacugcaucucccgcacccagcugcuccggaccgagacggccgagauucacgacgacaacuacgggggcccgggggacaagaucaccaucugcaacggcagcaccaucguggaccagcgccugggguccgagcugggcugcuacaccaucaaccgggucaagagcuucaaacucugcgagaacuccgccacgggcaagaccugcgagaucgacagcacccccgugaagugccgccagggguucugccugaagaucacccagaagggccgggggcacgugaagcugucccgcggcagcgaggucgugcucgacgcgugcgacuccaacugcgaggugaugauccccaaggggacgggcgacauccuggucgauugcagcggcgggcagcagcacuuccugaaggacaaccucauugaccugggcugcccccacaucccgcugcucgggaagauggccaucuacaucugccggauguccaaccaccccaaaaccaccauggccuuccuguucugguucagcuucggcuacgugaucacgugcaucuucugcaaggcccuguucuacucccucaucaucaucggcacccugggcaagaaaaucaagcaguaccgcgagcugaagccccagaccugcaccaucugcgagaccgcccccgugaacgcgaucgacgccgagaugcacgaccucaacuguagcuacaacaucugcccauacugcgccucccggcugacgagcgacggccuggcccgccacgucaagcagugccccaagcggaaggagaagguggaggagaccgagcucuaccugaaccuugagcgcauccccugggugguccggaagcuccuccagguguccgagagcaccgggguugcgcugaaacgcuccagcuggcucaucguccugcuggugcuccugaccgugagccugucccccguccagagcgccccgguaggccacgggaagacgaucgagaccuaccagacccgggagggcuucaccuccaucugccucuucaugcugggcagcauccuguuuaucguguccugccucgucaaggggcugguggauagcguguccgacagcuucuuccccggccuguccgucugcaagacgugcagcaucggguccaucaacggcuucgagaucgagagccacaagugcuacugcucccucuucugcugccccuacugccgccacugcagcgccgaccgggagauccaccagcugcaccugaacaucugcaagaagagaaagaccggguccaacgugaugcucgccgucugcaagcggaugugcuuccgcgccaccaucgaggcgagccggcgcgcccugcugauccgcuccaucaucaauaccacguucgugaucugcauccucacccugaccaucugcguggucagcacuuccgccguggagauggagaaccugcccgccggcacgugggagcgugaggaggaccucaccaacuucugucaccaggagugccaagugaccgagaccgagugccugugcccguacgaggcccugguccugcgcaagccccucuuccuggacagcaucguuaagggcaugaagaaccugcucaacagcacgucccuggagaccagccugagcaucgaagcgcccuggggcgccaucaacgugcaguccacguucaagcccaccgucuccaccgccaacaucgcccucagcugguccucgguggagcaccgggggaacaagauccuggugacggggcgcuccgaaagcaucaugaagcuggaggagcggaccggcaucuccugggaccucggggucgaggacgccuccgaguccaagcugcugaccguaagcaucauggaccucucccagauguacagcccgguguucgaguaccuguccggcgaccgccaggucgaggaguggcccaaggcgaccugcacgggcgauugcccccagcggugcgggugcaccagcagcacgugccuacacaaggaguggccccacucccgcaauuggcggugcaacccgaccuggugcuggggcguggggaccggcugcacgugcugcggcguggacgucaaggaccucuucaccgaccacauguucgugaaguggaagguggaguacaucaagacagaggccaucgucugcguggagcugaccagucaggagcgucagugcucccugaucgaggccgggacccgguucaaccucggccccguuaccaucacccugagcgagccccgcaacauccagcagaagcugcccccggagaucaucacgcuccaccccaagaucgaggagggguucuucgaccugaugcacguccagaaggugcuguccgccagcaccgugugcaagcuccaguccugcacccacggcauccccggggaccugcaggucuaccacaucggcaaucugcucaagggcgaccgggugaacgggcaccuaauccacaagaucgagccgcacuucaacaccagcuggauguccugggacggcugcgaccuggacuacuacugcaauaugggggacuggcccagcugcacguauaccggcgugacccagcacaaccacgccgcguucgucaaccuccugaacaucgagaccgacuacacgaagaccuuccacuuccacuccaagcgcgugaccgcgcacggggacacaccgcagcuggaccucaaggcccggcccaccuacggcgccggcgagaucaccgugcuggucgagguggcggauauggagcugcacaccaagaagguggagaucagcgggcucaaguucgccucccuggccugcaccggcugcuacgccugcagcuccgggaucagcugcaagguccgcauccacguggacgagcccgacgagcugacggugcacgucaaguccagcgaccccgacgugguggccgcgggcaccucccucauggcccggaagcuggaguucgggaccgacagcaccuucaaggccuucagcgccaugcccaagacgucccugugcuucuacaucgucgagaaggaguacuguaagaguuguuccgaggacgacaccaagaagugcguagacaccaagcucgagcagccccagagcauccugaucgagcaccgcggcaccaucaucggcaagcagaacgacacgugcaccgccaaggcguccugcuggcuggagagcgugaaguccuucuucuacgggcucaagaacaugcugggcuccgucuucgggaauuucuucaucggcauccuccuguuccuggcgccguuuguccuguuagugcuguucuucauguuuggguggaagauccuguucugcuucaagugcugccggcgcacccgcggccucuucaaguaccgacaucugaaggacgacgaggagaccggcuaccgccggaucaucgagcgccugaacaacaagaaggggaagaaccggcuccuggauggcgagcgccuggccgaccggaagaucgccgagcuguucuccaccaagacgcacaucggg

SEQ ID NO: 15406 - RNA, 3495 nt, Artificial Sequence
  derived and/or modified CDS sequence (opt11) from CCHVF(CCHVF YL04057)__FJ562094.1__Gn-NSm-Gc
gccgagggcgggagcuccgacugcaucagccgcacccagcuggugaagaccgaggucgcagagauccacgaagacuccuacggcgggcccggcgagaagaucacgaucugcaacggcagcaccaucguggaccagcggcucggucgcgagcugggcugcuacaccaucaaccgggugcgcuccuacaagcugugcgagaacagcgcguccggaaagagcugcgagaucgacuccaucccggucaagugcaagcagggguucugccucaagaucacccaggaggggcggggccacgugaaacugagccgcgggacggagaucgugcuggaugucugcgacuccagcugcgagcucaugauccccaaggguaccggcgacauccugguggacugcuccgggggccagcagcacuuccugcagaacaaccucaucgaccuggggugccccaacgugccccugcucggcaagauggcgaucuacgucugccggaugagcaaccacccgaagaccaccauggccuuccuguucugguucuccuucggcuacgugaucacgugcaucgccugccgcgugcuguucuaccuccugaucgcaaucgggaccgucggcaagaagcugaagcaguaccgggagcucaagccccagaccugcaucgugugcgagagcgugcccgucaacgccauugacgccgagaugcacgagcugaacugcuccuacaacaucugccccuacugcgccagccgccuguccaccgacgggcucauccggcacgugacgcagugcccgaagcgccgggagaagguggaggagaccgagcuauuccuuaaccucgagcgcauuccguggcugguccggaagcugcuccaggugagcgagagcaccggcauggcccugaagcgcuccuguuggaugaucacacugcucauccugcugcuugugagcaucucccccguccagagcgcgcccguggggaaggagcgggccauagagacguaccaggcccgcgagaccuacacaggcaucugccuguucguucugggcuccguccucuucgccgugagcuggcugaccaaggcccugauugacgggaucggcaacuccuucuuuccggggcucagcgucugcaagacgugcuccaucggcagcaucaauggguucgagaucgagucccacaagugcuacugcagccuguucugcugccccuauugccgugcgugcuccagcgacaaaaacacccaccgcaugcaccuuaacgugugcaagaagcggaagaugggcuccaacgugaugcucgccgucugcaagcgcaugugcuuccgcgccaccaucgaggcuagcaacaaggcccugcugauccgguccaucaucaacagcaccuucgugaucugcauccucauccugacgaucugcguggucucgaccagcgcgguggacauggagaaccugcccgccggcaucugggagaaagaggaggaccucaccaacuucugccaccaggagugccaggugaccgagacggagugccucugccccuacgaggccaugguccugcgcaagccgcuguuucucgacagcaucgccaaggggaagaagucccugcugaacuccaccucccucgagacgagccuguccauugaggcccccuggggcgcgaucaacgugcagagcaccuucaagcccacgguguccgccgccaacaucgcccuaagcugguccagcguggagcaccgggggaacaagauccucguguccggccgcagcgaguccaucaugaagcuggaggagcggaccggggugagcuggaaccugggcgucgaggacgccuccgagagcaagacacucaccguguccgugauggaccugucccagauguacagccccgucuucgaguaccuguccggcgaccgccagguagaggaguggccgaaggcgacgugcaccggggacugccccgagcggugcggcugcaccagcuccacgugccuccacaaggaguggccccacucccgcaacuggcggugcucccccaccuggugcuggggcguggggaccggcugcacgugcugcgggcuggacgucaaggacuucuucaccgacuacaugcuggugaaguggaagguggaguacaucaagaccgaggccaucgucugcguggaguugaccagccaggaacgccagugcucccugaucgaggccggcacccgguucaaccuggggccggugaccaucacccucagcgagccccgcaacguccagcagcggcugccgcccgagaucgugacgcugcaccccaagaucgaggagggcuucuucgaccucaugcacgugcagaagauccuguccgccagcaccgucugcaagcugcaguccugcacccacggggugcccggcgacuuccagguguaccacgucggcaaccuccuucgcggggacaaggugaacggccacagcauccacaagaucgagccccacuucaacacguccuggaugagcugggacgggugcgaccuggacuauuucugcaacaugggcgacuggccguccugcacguacaccggggugacucagcacaaccgggcggccuucaucaacaugcucaacauagagaccgacuacacgaagaccuuccacuuccacagcaagcgcgucaccgcccacggcgacacgccccagcuggaucugaaggcccggcccgccuacggcgcgggggaggugaccgugcucgucgagguggccgaccuggagcugcacaccaagaagcucgagguguccggccugaaaaucgccagccugaccugcuccgggugcuaugccugcagcagcggaaucuccugcaagguccgcauccaugugaacgagcccgacgaguucaccgugcacguccggagcuccgacccggacgugguggccgcagggagcucccucauggcccgcaagaucgaguucggcgccgacagcacguuuaaggccuuuuccagcaugccgaaggacucccugugcuucuacaucgucgagaaggacuacugcagcuccugcaccgacgacgacacccagaagugcgugaacaccaaacuugaccacccccagagcauccucaucgagcacaagggcacgaucaucgggaagcaaaacgacacgugcuccaccaagaccagcugcuggcuggaguccgugaagggcuucuucuacgggcugaagaacaugcucagcggcaucuucgggaacgucuuccugggcauccuccuguuccuggcccccuucgugcugcuuauuuucuucuucuucuucggcuggcgccugcuguucugccucaagugcugccggcgcacccgggggcugcucaaguacaagcaccucaaggacgaggaggaggcgggcuacaagaagaucaucgagcgccuuaacgggaagaagggcaagucccaguuauucgacggcgagcggcucgccgaccgcaagaucgcagagcuguucagcaccaagauccacaucggg

SEQ ID NO: 15407 - RNA, 3495 nt, Artificial Sequence
  derived and/or modified CDS sequence (opt11) from CCHVF(CCHVF V42/81)__GU477490.1__Gn-NSm-Gc
ucgaaggaacccggcgacgacugcaucagucggacacagcugaugcggacagaaacggccgagauccacgacgacaacuacggcggcccgggggacaagaucacgaucuguaauggcagcaccaucguagaccagcggcucgggucugagcuggguugcuacaccauaaaccgagucaagagcuucaagcucugcgagaacuccgcaaccgggaaagcaugcgaaguggacucaaccccggugaagugccgccagggcuuuugccucaagaucacccaagagggacggggucacgucaaacugucucgcggcagcgagguagugcuggaugccugcgacuccagcugcgaggucaugauccccaaggggaccggagacauccucguggacugcuccggcgggcagcagcacuuccuuaaggacaaccuaauagaccucgaguguccccacaucccguuacuggguaaguuggccaucuacaucugccggaugucgaaccacccccgcacuaccauggccuuccuguuuugguucggguuuggcuaugugaucacguguauccugugcaaggcccucuucuacucucugaucaucauugggaccuuagguaagaagaucaaacaguaccgcgagcucaagccccaaaccugcacaaucugcgagacggcgcccgucaacgccaucgacgccgaaaugcaugaccugaacuguagcuacaacaucugcccguacugcgccucccgccugaccagcgacggucucgcccgucacgugacacagugccccaagcgcaaggagaagguggaagagaccgaauuguaccuuaauuuagagcggauccccuggaucguccgcaaacuccuacagguguccgagagcaccggcgugguccugaagagaagcucgugguugaucgugcugcucgugcuccugaccgucagccucuccccgguucaaagcgccccggucggccacgggaagacgauagaaacauaccagacccgcgagggauuuaccucgauuugucuguucaugcugggcagcauccucuucauuguauccuguaucgugaaggggcugguagacagcguuuccgacucguucuuccccggacugucggugugcaagacaugcucgaucuccagcaucaacggguuugagaucgaaagucacaagugcuauugcagcuuauucugcuguccguacugccggcacugcuccgccgaccgagagauccaucaacugcaccugagcaucugccggaagcgucggaccggcuccaacgucaugcucgccgucugcaagcgcauguguuuccgcgcaaccaucgaagugagccgacgugcccugcugauacgguccaucaucaacacgacguucgucaucugcaucuugacccuuaccauauguguggugucgaccagcgccgucgagauggagaauuugccugccgggacgugggagcgggaggaggaccucaccaacuucugccaccaggagugccaggugaccgagaccgagugccugugcccguaugaggcgcugguuuuacgcaaacccuuguuccuagacucgaucgucaagggcaagaagaaccugcugaacagcacgucacucgagaccagccuguccaucgaggcucccuggggcgcgaucaacauccagucgaccuucaagcccaccguaucggccgccaacaucgcccucagcugguccaguguugagcaccgcgguaacaagauccugguuuccggccggagcgagagcaucaugaagcuggaggagcgcaccggcgugagcuggaaccuugggguggaggaugcgucagagucaaagcucuuaacagucuccaucauggaccucagccagauguacagcccgguguucgaauaccugucgggcgaccgccaggucgaggaguggcccaaggcgaccugcaccggcgauugccccgagcggugcggcugcaccagcuccacgugccugcacaaggaguggccccacagccggaacuggcggugcaacccuaccuggugcuggggcgucggcacagggugcacgugcugcggaguugacgugaaggaccucuucaucgaccacauguucgucaaguggaagguagaguacaucaaaaccgaggccaucgucugcgucgagcuuaccucccaggagcggcagugcagccucauagaggccggcacucguuucaaccucgggcccgucacuauuacgcugagcgagccccggaacauccagcagaaguugcccccggagauuauuacccuccaucccaagaucgaggagggcuucuucgacuugaugcaugugcaaaagguccugagcgccuccaccgugugcaagcuccagagcugcacgcacgggauccccggcgaccuccaggucuaccacauagggaaccugcucaagggcgaccgcgucaacggccaucugauccauaagaucgaaccucauuuuaacacgagcuggaugagcugggacgggugugaccuggauuacuacugcaauaugggugacuggcccuccuguaccuauaccggggugacccagcauaaccacgccgcguucguaaaccuccugaacaucgaaacggauuacaccaaaacguuccacuuccacagcaagcgggucaccgcccacggggagacgccccagcuggaccucaaggccagacccgccuacggcgcgggggagauuaccgugcugguggaggucgccgacauggaguugcauaccaagaaaguagagauauccggccuaaaauucgcaucgcuggccugcaccgggugcuacgccugcuccucuggcauauccugcaaggugagaauccacgucgacgagccggacgagcugaccgugcacgucaagagcaacgaccccgacgugguugcggcuagcacaucccuaauggcccgaaagcucgagagcgggaccgacuccaccuucaaggccuucagcgccaugcccaagacgucccucuguuuuuauaucguagagcgugaguacugcaagagcugcuccgaggacgauacgcagaagugcgucgagaccaagcucgaacagccccagucgauccugaucgagcacaaggggacgauuaucgggaagcagaacgacacgugcaccgcgaaggccuccugcuggcuggaaagcgugaaguccuucuucuauggccucaaaaacaugcugggauccguguucggaaacuucuucaucggcauccugcuguuccuggcgccuuucguccugcucgugcuguucuucauguucggguggaagaucuuguucugcuucaaguguugcagacgcacccggggccucuuuaaguaccgccaccugaaggaggacgaggaaaccggcuaccggcgcauaaucgagcggcugaauaguaagaagggcaaaaaucgucuccuagacggggagcggcuggcagaccguaagaucgcagaacucuucagcaccaagacgcacauuggg

SEQ ID NO: 15408 - RNA, 3495 nt, Artificial Sequence
  derived and/or modified CDS sequence (opt11) from CCHVF(CCHVF 79121M18)__GU477493.1__Gn-NSm-Gc
gccgagggcgguagcuccgacugcauuagccgcacccaacuggugaagaccgaggucgcagagauccacgaggacuccuacggcgguccuggugagaaaaucacgaucugcaacggguccacgauuguggaccagggacucggcagugagcuggggugcuacaccaucaaccggguccgcagcuacaagcugugcgagaacuccgcgagcggcaaguccugcgagaucgauagcauccccgucaagugcaagcagggguucugccugaagaucacccaggagggccgggggcacgugaagcugucacgcggcacggagaucgugcuggacgugugcgacucuuccugcgagcugaugauccccaagggcaccggggauauccugguggauugcagcggcgggcagcagcacuuucugcaaaacaaccucaucgaucugggcugccccaacgugccgcuacucggcaagauggccaucuacguaugccggaugucaaaccacccuaaaacuaccauggccuuccucuucugguuuagcuuuggguacgugaucacuugcaucgcuugccgcgugcuguucuaccucuuaaucgcuaucggaacagugggaaagaagcugaagcaguaccgagagcucaagccccagaccugcaucgugugcgaguccgugcccgucaacgcgaucgacgccgagaugcacgagcugaacuguucguacaacauuugccccuacugcgccucccgccugagcacugacggccucauacggcacgugacgcagugcccgaagcgccgggagaaaguggaggagacggaacuguuccugaaccucgagcgcauucccuggcugguacgaaagcugcuccaggugagugaguccacagggauggcacugaaacgcagcugcuggaugaucacccuccucauucugcugcucguguccaucagccccguccagucagcucccgugggcaaggagcgggccaucgagacguaccaggcccgagagaccuacaccggcaucugccuguucgugcuggggucuguccucuucgccgugucguggcugacgaaggcccugaucgacggcaucggcaacagcuucuccccuggccucagcgucugcaagacguguuccauugggaguauaaaugguuucgagaucgagucccacaagugcuauugcucacuguucugcugccccuacugccgggcguguuccagcgacaagaacacccaccgcaugcaccugaauguguguaaaaagcggaagaugggcucaaacgugaugcucgccgucuguaagcgcaugugcuuccgggccaccaucgaggccaguaacaaagcccugcugauccgcuccaucaucaacagcaccuucgugaucugcauccucauccugacgauaugcguggucagcaccagugcgguggacauggagaaucugcccgcagggauaugggagaaggaggaggaccucaccaacuucugucaccaggagugccaggugaccgagacggaaugccugugccccuacgaggccaugguccuucgcaagccgcuguuucuagacucaaccgccaagggcaugaagucccugcugaacagcaccucccucgaaacaucgcuauccaucgaggcccccuggggcgcgauuaacgugcagagcacguuuaaacccaccguguccgccgccaacaucgcgcugucaugguccagcguggagcaccggggaaacaagauccucguguccgggcgcagcgagagcaucaugaagcuagaggagcggaccggcguaagcuggaaccugggcgucgaggacgcuagugagagcaagacccucacgguaagcgugauggaccugucccagauguacagccccgucuucgaguaccuguccggggaccgccaaguggaggaguggccgaaagcgaccugcaccggcgacugucccgagcggugcgggugcaccagcuccacgugcuugcacaaggaguggccccacagccggaacuggcgaugcaaccccaccuggugcuggggcgugggcaccgggugcacgugcugcggccuggacgucaaggauuucuucaccgacuacaugcuggugaaguggaagguggaguacauaaagaccgaggccaucgucugcguggaacucacgucccaggaacgccaguguucgcugaucgaggccgggacgcgcuucaaccugggcccggugaccaucacgcucuccgagccccgcaacguccagcagcgacugccgcccgagauagugacccugcaccccaagaucgaggagggguucuucgaccugaugcacgugcagaagauucugagcgccagcaccgucugcaagcugcagagcuguacccauggugugcccggcgacuuccaaaucuaccacgucgggaaccuucuccgcggcgauaaggucaacgggcacuccauccacaagaucgagccccacuucaacacuagcuggauguccugggauggcugcgacuuggacuacuucugcaacaugggggacuggccgagcugcacguacaccggcgugacccagcacaacagggcggccuucaucaacaugcucaacaucgagacggacuacacaaaaaccuuccacuuccacuccaagcgugugaccgcccauggcgacacgccucagcuggaccugaaggcccggcccgccuacggggcaggcgaagucacugugcucguggaggucgccgaucuggagcugcacaccaaaaagcucgaaguuagcggguugaagaucgccucccugaccugcagcggcugcuaugccugcagcagcggcaucagcuguaaggugcgcauacacguaaacgagcccgacgaguucacgguacacgugcggagcagcgacccugacgucguggcagcgggcuccagccucauggcccgcaagaucgaguucggcgccgacuccaccuucaaggcguucagcuccaugcccaaggacagccugugcuucuacaucguggaaaaggauuacugcucgagcugcacugacgacgacacacagaagugcgucaacacuaaacuugaccacccccaguccauccucaucgagcacaaggggaccaucaucggcaagcagaacgacacgugcagcaccaagaccuccugcuggcuggagagcguuaaggguuucuucuauggucugaagaauaugcucuccgggaucuucggcaacguuuuccugggcaucuuccuguuccucgcccccuucguacugcugaucuucuucuucuucuucggguggcggcuccuguucugccugaaguguugccgccgcacccggggccuccugaaauacaaacaccugaaggacgaagaggaggcgggguacaaaaagauuaucgagcgacucaacggcaagaagggcaagagccagcuguucgacggggagcggcuggccgaccgcaaaaucgcagagcuguucuccaccaagauccacaucggc

SEQ ID NO: 15409 - RNA, 3495 nt, Artificial Sequence
  derived and/or modified CDS sequence (opt11) from CCHVF(CCHVF Afg09-2990)__HM452306.1__Gn-NSm-Gc
agcgaggaguccggcgacgacugcaucagccgcacccagcugcuccggaccgagacggccgaggugcacggggacaacuacggcggucccggcgacaagaucaccaucugcaacggguccaccgucguggaccagcgccugggcucagagcugggcugcuauaccaucaaucgggugcgcuccuucaagcucugcgagaacagcgccacggggaagucuugcgagaucgacagcauccccguaaagugcaagcagggcuauugccugaagaucacccaggaggggcggggccacgugaaguugucccgcgggagcgaagugguccuggacgugugcgacuccagcugcgaggugaugauccccaagggcaccggcgacauccuggucgacuguuccggaggccagcagcacuaccugaaggacaaccucguggaccuggggugccccaagaucccccugcucggcaagauggcgaucuacaucugucggaugagcaaccacccgaagaccacgauggccuuccuguucugguucaguuucgguuacgugauuacgugcauccugugcaaggccaucuucuuccuccugaucaucuucgggacccugggcaagcgcuucaagcaguaccgggagcucaaaccccaaaccugcaccaucugcgagaccacccccgucaacgccaucgacgccgagaugcacgaccugaacugcagcuacaacauaugccccuacugcgcgucccgccugaccagcgacgggcucgcccggcacgugacgcagugcccgcgccggaaggagaagguggaggagaccgagcuguaccugaaccucgagcgcauucccugggucgugcggaagcugcuccagguguccgagagcaccggcaccguccugaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccucagcgugugcaagacgugcuccaucggcagcaucaacggcuucgagaucgagucccacaagugcuacugcagccucuucugcugccccuacugccggcacugcuccgccgacggcgaaauccaccagcuccaccugagcaucugcaagaagcgcaagaccggguccaacgucaugcucgcggugugcaagcggaugugcuuccgcgccaccauggaggugagcaacaaggcccuguucauccgcuccauaaucaacaccacguucgucgugugcauucugauccucgccgugugcgucgugagcaccuccgccguggagauggagagccugcccgcgggcacgugggagcgggaggaggaccugaccaacuucugccaucaggagugccaggucacggagaccgagugccucugccccuacgaggcccuggugcugcgccggccgcuguuccucgacagcaucgugaaggggaugaagaaccugcugaacuccaccagccucgagaccucccuaagcauugaggcccccuggggcgcaaucaacguccaguccacguauaagcccaccgugagcaccgccaacaucgcgcuguccuggagcuccguggagcaccgcgggaacaagguucucgugagcggccgguccgagagcaucaugaagcuggaggagcgcaccggcaucuccugggaccuggggguggaagaugccagcgaguccaagcuccugaccgucagcgugauggaccugucccagauguacagccccguguucgaguaccucagcggcgaccggcaggucgaggaguggccgaaagccacgugcaccggggacugccccgagcgcuguggcugcaccuccagcacaugccugcacaaggaguggccacacuccaggaauuggcgcugcaaccccaccuggugcuggggcguggggaccggcugcacgugcugcgggcuggacgugaaggaccucuucaccgacuacauguucgucaaguggaaggucgaguacaucaagaccgaggccaucgugugcgucgagcugaccucccaggagcggcagugcucccugaucgaggccggcacccgcuucaaccucgggagcgugaccaucacgcuguccgagccgcggaacauccagcagaagcugccgcccgagaucaucacccuccaccccaaaaucgaggagggauuuuucgaccugaugcacgugcagaagguccuuagcgcguccaccgugugcaagcuccagucaugcacccacggagugcccggggaccugcaggucuaccacaucggcaaccugcucaagggggaucgugugaacggccaccugauccacaagaucgagcagcacuucaacacguccuggaugagcugggacgggugcgaccuggacuacuacugcaacaugggcgacuggcccuccugcaccuacaccggcgugacccagcacaaucacgccagcuucgucaaccuccugaacaucgagacggacuacaccaagaccuuccacuuccacagcaagcgggugaccgcccacggggacacaccccagcuggaccucaaggcccgaccaaccuacggcgccggcgagaucaccgugcuggucgagguggcggacauggagcugcacaccaagaagaucgagaucagcggccucaaguucgccgggcugaccugcaccgguugcuacgccugcuccagcggcaucuccugcaaggugcggauccacgucgacgagcccgacgaacugaccgugcacgucaagagcgacgaccccgacgugguggccgcgagcuccagcuugauggcccgcaagcuggaguucgggaccgacuccacguucaaggccuucagcgccaugccuaagaccucccugugcuucuacaucguggagcgggaguacugcaagucaugcuccaaggaggacacccagaagugcgucaacaccaagcucgagcagccgcaaagcauccugaucgagcacaagggcacgaucaucggcaagcagaacaacacgugcaccgccaaggcguccugcuggcuggagagcgugaaguccuucuucuacggacucaagaacaugcucgggggcaucuucggcaacgucuucaucgggaucuucaccuuccugacccccuucauccugcugauccuguucuucauguucggcuggcgcauccucuucugcuucaaguguugccgccggacccgcgggcuguucaaguaccggcaccugaaggacgacgaggagaccggcuaccgcaagaucaucgagcggcucaacaacaagaaaggcaaaaaccgccugcuggacggggagcggcucgccgaccgcaagauagccgagcuguucagcaccaagacccacaucggc

SEQ ID NO: 15410 - RNA, 3495 nt, Artificial Sequence
  derived and/or modified CDS sequence (opt11) from CCHVF(CCHVF Sudan Al-Fulah 3-2008)__HQ378184.1__Gn-NSm-Gc
agcgaggagccauccgacgacugcaucagccgcacccagcugcuccggaccgagacggccgagauccacggugacaacuacgggggcccgggggacaagaucaccaucugcaacggcuccaccaucguggaccagcgccuggggagcgagcugggcugcuacaccaucaaccgggucaaauccuucaagcucugcgagaacagcgccacgggcaaguccugcguaaucgacagcgugccggucaagugccgccaaggguacugccugcggaucacccaggagggccgcgggcacgugaaguuaucccggggcagcgaagugguccucgacgcgugcgacaccucuugcgaaaucaugaucccgaaggggaccggcgacauccugguggacugcagcggcggccagcagcacuuccugaaggacaaccucguggaccugggcugccccaagaucccgcugcucgggaagauggccaucuacaucugccgcauguccaaccaccccaaaaccaccauggccuuucuguucugguucagcuucggcuacgucaucacgugcauccugugcaaggccaucuucuaccuccugaucaucauaggcacccuggggaagcgguuccgccaauaccgggagcucaagccccagaccugcaccaucugcgagacgacccccgugaacgccauagacgccgagaugcacgaccugaacugcaguuacaacaucugcccguacugugccagccggcugacguccgacggccucgcccggcacgugacacagugccccaagcgcaaggagaagguggaggagaccgagcuguaccugaaucucgagcggauccccuggguggugcgcaagcugcugcaagucagcgaguccaccgggguggcccucaagcggagcagcuggcuaaucguucugcuaguccuguucacggugucgcugagccccgugcaauccgcgccuaucggccacggaaagaccaucgaggccuaccgcgcucgggagggcuacaccagcaucugccucuucguccugggauccauccuguucaucgugagcugccucaugaagggucugguugacuccgucggcaacagcuucuucccagggcuguccauaugcaagaccugcagcaucucgagcaucaacggguucgagaucgagucacacaaaugcuacugcagucucuucugcugccccuacugccgccacuguuccgcagacaaggagauccacaagcugcaucugagcaucugcaagaaacgaaagacgggguccaacgugaugcucgccgucugcaagcgcaugugcuuccgcgcuaccauggagguaagcaaccgggcacuguucauacgauccaucaucaacaccaccuucgugcugugcauccucauccuggccgugugcguggugagcacgagcgccgucgagauggagaaccuucccgccggcaccugggagcgggaggaggaccucaccaacuucugccaccaggagugccaggugaccgagacggagugcuuaugcccauacgaggcgcuggugcugcgccggccccucuuccuagacuccaucgugaagggcaugaagaaccugcucaacagcaccucccuggaaaccagccuguccaucgaggccccguggggcgcuauuaaugugcagagcaccuacaagcccacgguguccaccgcaaacaucgcccucagcugguccagcgucgagcaccgcgggaacaagauccugguguccgggcggagcgaguccaucaugaagcuggaggagcgcaccggcaucagcugggaccucgggguggaggacgcguccgagucaaagcugcugaccgucuccgugauggaccucagccagauguacagcccgguguucgaguaccuguccggcgaucggcaggucgaggaauggcccaaggcaaccugcacgggcgacugccccgaacgcugugggugcaccagcucgacgugccugcacaaagaguggccccacagccggaacuggcgcugcaauccuaccuggugcuggggcguagggaccggcugcacgugcugcggccucgacgugaaggaccuguucaccgacuacauguucgucaaguggaagguggaguacaucaagaccgaggccaucgugugcgucgagcugaccucacaggagcggcagugcagccucaucgaggccgggacccgcuucaaccugggccccgugacuaucacccuguccgagccccggaacauccagcagaaacugcccccagagaucaucacgcuccacccccgcaucgaggagggguucuucgaccugaugcacgugcagaagguccucagcgccucaaccgugugcaagcugcaguccugcacccacggggugccaggggaccugcaggucuaccacaucggcaaccuccugaagggcgacaaggugaacggacaccugauucacaagaucgagccgcauuucaacaccuccuggaugagcugggacggcugcgaccucgacuacuacugcaacaugggggacuggcccuccugcacguacaccggcgugacccagcacaaccaugccagcuucgucaaccuacugaacaucgagaccgacuacacgaagaauuuccacuuccauucaaagcgggugaccgcccacggggacacgccccagcucgaccugaaggcccgccccacguacggagccggcgagaucaccgugcuggucgagguggcggacauggagcuccacaccaagaagaucgagaucagcgggcugaaguucgccucccugaccugcaccggcugcuacgccugcagcuccgguaucagcugcaaggugcgaauccacgucgacgagccggacgagcucacgguccacgucaagagcgacgacccggacgugguggcugcguccagcucccugauggcccgcaagcuggaguucggcaccgacagcacguucaaggccuucuccgccaugcccaagacaagccucugcuucuacaucguggaaaaggaguacuguaaguccugcagcgaggaagauacgaagaagugcgucaacaccaagcuggagcagccucaguccauccugaucgaacacaaggguaccaucaucggcaagcagaacucuacgugcaccgccaagguguccugcuggcuggagagcgccaaguccuuuuucuauggccugaaggacaugcugagcgggaucuuuggcaacguguucaucgggaucuuccucuuccucgcgccguucguccugcucgugcuguucuucauguucggcuggcgcauccugcucugcuuccggugcugccgccggacccgcggacuguucaaauaccggcaccugaaggacgacgaggagaccggcuaccgccggaucaucgagcgccucaacaacaagaagggcaagaacaagcugcuggacggugagcggcucgccgaccgcaagaucgcugagcuguucuccaccaagacccacaucggc

SEQ ID NO: 15411 - RNA, 3495 nt, Artificial Sequence
  derived and/or modified CDS sequence (opt11) from CCHVF(CCHVF Sudan AB1-2009)__HQ378187.1__Gn-NSm-Gc
agcgaggagccuuccgacgacugcaucagccgcacccagcugcuccgcaccgagacggccgagauccacggcgacaacuacggcggcccgggggacaagaucaccaucugcaacggcucuaccaucguggaccagaggcuggggagcgagcugggcuguuacaccaucaaccggguaaagaguuucaagcucugcgagaacagcgccacgggcaagaacugcgagaucgacuccgugccugugaagugucgccagggguacugccugcggaucacccaggagggccgcgggcacgucaagcugagccggggcuccgaggucgugcucgacgcgugcgacaccucaugcgagaucaugauccccaaggguaccggcgacaucuuagucgacugcuccggcgggcagcaacacuuccugaaggacaacuuaaucgaccuggggugccccaagaucccgcugcucgggaagauggccaucuacaucugccgcaugagcaaucaccccaagacgaccauggccuuccuguucugguucuccuucggcuaccugaucacgugcauccucugcaaggccaucuucuaccugcugaucaucaucggcacccucgguaagcggcugaagcaguaccgcgagcugaaaccccagaccugcaccaucugcgagaccaccccugugaacgccaucgacgcggagaugcacgaccucaacugcagcuacaacaucugcccguacugcgccuccaggcugacgagcgacggccuggcccgccacgugauccagugccccaagcggaaggagaaggucgaggagaccgagcucuaccugaaccuggagcgcauccccuggguggugcggaagcuccugcaagucuccgagagcaccgggguggcccugaagcgcuccagcuggcucaucgugcugcugguccucuucaccgugagccugucccccgugcagagcgcgccgaucggccaggggaagaccaucgaggccuaccgggcccgcgagggcuacaccuccaucugccuguucguccucggcagcauucuguucaucguguccugccugaugaaggggcucguggacagcgucggcaacuccuucuuccccgggcugagcaucugcaagaccugcuccauaagcucgaucaacggcuucgagaucgagagccacaagugcuacugcucccuguucugcugccccuacugccggcauugcagcaccgacaaggagauccacaagcuccaccuguccaucugcaagaagcgcaagacggggagcaacgugaugcuggccgugugcaagcggaugugcuuccgugccaccauggagguauccaaccgcgcccucuucauccggagcaucaucaacaccaccuucguccugugcauccugauccucgccgucugcgugguguccacgagcgccgucgagauggagaaccugcccgcgggcaccugggagcgcgaggaagaccugaccaacuucugccaccaggagugccaggugaccgagacggagugccugugcccguacgaggcccucgugcugcggaagccccuguuccucgacagcauugcgaagggcaugaagaaccuucugaacuccaccagccucgagaccucccugagcauugaggcccccuggggcgccaucaacguccaguccaccuacaagcccacggugagcaccgccaacaucgcccugucguggagcuccguggagcaccgcgggaacaaaauccucgucagcggccgguccgagagcaucaugaagcuggaggagcgcaccggcaucuccugggaccuggggguggaggacgcgagcgaauccaagcuccugaccgugagcgucauggaccugucccagauguacagcccgguguucgaguaccucagcggcgaccgccagguggaggaguggcccaaggcgaccugcacgggcgacugccccgagcggugcgggugcaccuccagcacgugccugcacaaggaguggccccacucccggaacuggcgcugcaacccgaccuggugcuggggcgucgggaccggcugcacgugcugcggccuggacgugaaggaccucuucaccgacuacauguucgugaaguggaaggucgaguacaucaagaccgaggccaucgugugcguggagcugaccagccaggagcggcagugcucccugaucgaggccgguacccgcuucaaccuuggccccgucaccaucacccugagcgagccccggaacauccagcagaagcugcccccggagaucaucacccuucacccccgcaucgaagagggguucuucgaccugaugcacgugcagaagguguuauccgccagcaccgucugcaagcugcaguccugcacccacggcgugcccggggaccuccagguguaccacaucggaaaucugcugaagggcgacaaggucaacgggcaccugauccacaagaucgagccgcacuucaacacuagcuggauguccugggacggcugcgaccuggacuacuacugcaacaugggggacuggcccagcugcacguacaccggcgugacccagcacaaccacgcguccuucgugaaccuucugaacaucgagaccgacuacacgaagaacuuccacuuccacagcaagcgcgucaccgcccacggggacacgccccagcuggaccucaaggcgcgccccaccuacggcgccggcgagaucaccgugcugguggaggucgcggauauggagcuacacaccaagaagaucgagaucuccgggcucaaguucgccagccugaccugcaccggcugcuacgccugcuccagcgggaucuccugcaaggugcggauccacguggacgagccggacgagcuaacgguccacgucaagagcgacgacccugacguuguggccgccagcuccagccucauggcgcgcaagcuggaguucggcaccgacuccacguucaaggccuucagcgccaugcccaagaccuccuuaugcuuuuacaucguggagcgggagcacuguaagagcugcaacgaggaggacacgaagaagugcgugaacaccaagcucgagcagccacaguccauccugauagagcacaagggaaccaucaucggcaagcagaacagcacgugcaccgcccgcgccuccugcuggcuggagagcgucaaguccuucuucuacggccucaagaacaugcugagcgggaucuuuggcaacguguucauggggaucuuccuguuccucgcgccguuuauccugcugauccucuucuucauguucggcuggcgcauccuguuuugcuucaagugcugccggcgcacccgggggcuguucaaauaccgccaccucaaggaugacgaggagaccggcuaccggcgcaucaucgagcggcugaacaacaagaaggggaagaacaaguugcucgacggggagcgccuggccgaccggcgcaucgccgagcuguucuccaccaaaacccacaucggc

SEQ ID NO: 15412 - RNA, 3495 nt, Artificial Sequence
  derived and/or modified CDS sequence (opt11) from CCHVF(CCHVF NIVA 118595)__JN572083.1__Gn-NSm-Gc
uccgaggaaucuggcgacgacugcaucuccagaacgcaacuccuacgcacagaaaccgcggagguccacggcgacaacuacggaggaccaggggauaaaauaaccaucugcaacggcuccacuguggucgaccaaagacuaggcagcgaacuaggcugcuacacgaucaacaggguuaaauccuucaaacucugcgaaaacucagcaaccggaaagagcugcgaaauagauucgauccccgucaagugcaggcaaggcuacugccuaaaaaucacacaagaaggacguggccacgucaaacucucccgcggcagcgaagucguccuagacgccugcgacagcaguugcgaagucaugauaccuaaggguaccggcgacauccuagucgacugcuccgggggucagcagcacuuccuaaaagacaaccuaaucgaccugggcugcccaaagauuccucuacucggaaaaauggccaucuacaucugccgcaugagcaaccaccccaaaaccacuauggcauuccuauucugguucagcuuuggcuacgugauuaccugcauccucugcaaggugaucuucuaccuccuuaucauuuuugguacccucggaaagcgguucaagcaauaccgagaacucaaaccccaaacaugcacaaucugcgaaacuacucccgugaacgccauagacgccgaaaugcacgacuuaaacugcuccuacaacauuugccccuacugcgcguccaggcuaacuagcgacggacucgcacgccacgucacccaaugcccuaaacgaaaagaaaaagucgaggaaaccgagcuguaccucaaccuagaacgcauaccaugggucguacgcaaacuccugcaggucagugaaagcaccggaaucgcccuaaaacggaguucguggcucauuguuuuacucguacuauucacggucagcauaacccccguacagucagcaccaaucggccacggcaagacgaucgaagcauaccgagcacgagaagaauacacauccaucugccucuucguccucggcuccguacuuuucgucgucagcugccuuaugaaaggccugguagacucagucggcaacauauucuuccccggacucuucaucugcaaaacuugcagcaucggauccauuaacgguuuugaaauagaaagccacaagugcuacugcucccucuuuugcugccccuacugucgccacugcuccgccgaccgggaaauccaucagcuccaccuguccaucugcaagaaacgaaagacaggguccaacgugaugcuagcaguuuguaaacguaugugcuuucggacuaccauggaggucucaaacaaagcucuuuucgucagaagcaucauaaacacgacuuucguaguauguauacuaauccuugcaguaugcgugguaucgaccagugccguggagauggagagcuugcccgccggaaccugggaacgcgaagaggaucuaaccaacuucugccaccaagaaugccaagugacugagaccgagugccuaugcccauacgaggcccucguucuacgaagaccacuguuccuagauagcauugucaaaggcaugaaaaaccuccuaaacucuaccucccucgaaacaucgcucucaauagaggccccguggggugccaucaacguacaauccacuuauaaaccaaccgucuccgcagccaacauagcccucucauggucuuccgucgaacaccgggggaacaaaauacuggucucgggcagguccgagagcauaaugaaacuggaagaacgcaccgggaucucaugggaucucggcguugaggacgcgagcgaaucaaagcuacucaccguaucaguaauggaucuaucacaaauguacucgcccgucuucgaauaccucucuggcgaccgccaagucgaagaauggccuaaggcaacuugcacgggcgacugccccgaacgcugcgggugcaccucgagcacgugccuccacaaagaauggccccacucacgcaacuggcguugcaaucccaccuggugcuggggagucgggacaggcugcacauguugcgggcucgacgugaaggaccucuuuaccgacuacauguucgugaaauggaaagucgaguacauaaaaaccgaagcgaucguaugcguagaacuaacaucgcaggagagacaaugcucccugaucgaagcuggaacacguuucaaccucggguccgucacaauaacacucucugagccucgcaacauucaacaaaaacugcccccagaaauaaucacccuacacccacgaauagaagaaggguucuucgaccugaugcacguacaaaagguauugagcgccucuacuguaugcaaacuacaaucgugcacccauggagucccaggcgaccuccaagucuaccacaucggcaaccuucuuaaaggcgaccggguaaacggccaccucauccacaaaaucgaacaacaccugaacacaucauggaugagcugggacggcugugaccuagacuacuauugcaacaugggugacuggccaucgugcaccuacacaggcgucacacaacacaaucacgcaucuuuuguaaacuuacucaacaucgaaacagacuauacgaagaccuuccacuuccacuccaagcgggucacagcccacggagacacaccccagcucgaccuuaaagccaggccaaccuacggagccggcgagaucaccguacucgucgaagucgcggacauggaacuccacaccaaaaagauagaaauaagcggacuuaaauucgccucacucucaugcacaggcugcuacgcaugcagcucaggcauauccugcaagguacggauccacgucgaugagccagacgaacuaaccguccacgugaaguccgacgaccccgaugucgucgcagcaagcagcucgcuaauggcccggaaguuagaauccggcacagacuccacauucaaagcauucucggccaugccaaagacaucccuauguuucuacauaguagagcgcgaauacugcaaagguugcagcaaagaagauacccaaaaaugcgucaacaccaaacuugaacagccccagagcauccugaucgaacacaagggcacaauaauaggaaaacaaaacaauaccugcacagccaaagccuccugcuggcuagaaucggucaaaucuuucuucuacggccucaagaacaugcucuccggaaucuucggaaacgucuuucucgguaucuucagcuuccuggcaccauucguacuacugauacucuucuuuauguucggauggcgaauacucuucugcuuuaagugcugucgcagaacuagaggccuauucaaauaccgccacuuaaaggacgacgaagaaacaggauaccgaaagaucaucgagcgccugaacaacaagaaagggaaaaacaaacugcucgauggcgaacgccuugccgaccgaaaaauagccgagcuguuuagcacaaaaacccauauugga

SEQ ID NO: 15413 - RNA, 3495 nt, Artificial Sequence
  derived and/or modified CDS sequence (opt11) from CCHVF(CCHVF NIV 112143)__JN572085.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguagaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacgcaggaggggcggggccacgugaagcuaucccgcggaagugaggugguccucgacgcgugugacaguagcugcgaggugaugauccccaagggcaccggcgacauccugguggacugcagcgggggucagcagcacuuccugaaggacaaccucaucgaccuggggugccccaagaucccccugcucggcaagauggcgaucuacaucugccggaugucgaaccacccgaagaccacgauggccuuccuguucugguucuccuucggcuacgucauuaccugcauccugugcaaggugaucuucuaccuccugaucaucuucgggacccugggcaagcguuucaagcaguaccgggagcucaagccccagaccugcacgaucugcgagaccacccccgugaacgccaucgacgccgagaugcacgaccugaacugcagcuacaacaucugccccuacugcgcgucccgccugacuagcgacgggcucgcccggcacgucacgcagugcccgaagcgcaaggagaagguggaggagaccgagcuguaccugaaccucgagcggauccccugggugguacgcaagcugcuacagguguccgagaguaccgggaucgcccucaagcggagcuccuggcugaucgugcugcuaguucuguucacggugagcaucacgcccgugcaguccgcccccaucgggcacggcaagaccaucgaggcguaccgcgcccgggaggaguacaccagcaucugccuguuuguccucggguccgugcuguucguggucagcugccugaugaaggggcucguggacuccguuggcaacaucuucuuuccggggcuguucaucugcaagaccugcagcaucggcuccaucaacggguucgagaucgagagccacaagugcuacugcucccuuuucugcugccccuacugccgccacugcagcgccgaccgggagauccaucagcuccaccuguccaucugcaagaagcgcaagacgggcagcaacgucaugcuggccgugugcaagcggaugugcuuccgcgccaccauggaggucuccaacaaggcgcucuuugugcgcagcaucaucaacaccaccuucguggucugcauccugauccuggccaucugcgugguguccacgagcgccgucgagauggagucccuccccgccggcaccugggagcgggaggaggaccugaccaacuucugucaccaggagugccaggugacagagacggagugccugugcccuuacgaggcccucgugcugcgccggccgcuguuccuggacucgaucgucaaggggaugaagaaccuccugaacagcaccucccuggagaccagccucuccaucgaggcgcccuggggcgccaucaacgugcagagcaccuacaagcccacaguguccgccgccaacaucgcucugagcugguccagcgucgagcaccgcgggaacaagauccugguguccggccggagcgaguccaucaugaagcucgaggagcggaccgggaucagcugggaccugggcguggaggacgcguccgagagcaagcugcucaccgucuccgugauggaccugagccagauguacucccccguguuugaguaccugagcggcgaccggcaggucgaggaguggccgaaggcuaccugcaccggggacugccccgagcgcugcggcugcacgagcuccacuugccuccacaaggaguggccccacagccggaacuggaggugcaaccccaccuggugcuggggaguggggaccggcugcacgugcugcgggcuggacgugaaggaccuguucaccgacuacauguucgucaaguggaagguggaguacaucaagaccgaggccaucgugugcgucgagcucaccucccaggagcggcagugcagccugaucgaggccggcacgcgcuucaaccugggguccgugaccaucacccucagcgagccgcggaacauccagcagaagcugccgcccgagauuaucacccugcacccccgcaucgaagagggcuucuucgaccucaugcacgugcagaagguucuguccgccagcacggugugcaagcugcagaguugcacccacggggugcccggcgaccuccaggucuaccacaucggcaaccugcugaagggggaccgggugaacggccaccucauccacaagaucgagcagcaccugaauaccucuuggauguccugggacgggugcgaccuggacuacuacugcaacaugggagacuggcccagcugcaccuacacgggggugacccagcacaaccacgcguccuucgucaaccuccugaacaucgagaccgacuacaccaagacguuccacuuccacagcaagcgcgugaccgcccacggcgacacgccccagcuggaccucaaggcccggcccaccuacggcgccggggagaucaccgugcuggucgagguggcggacauggagcuacacaccaagaaaaucgagaucuccggccucaaguucgccagccuguccugcaccgggugcuacgccugcagcuccggcaucagcugcaaggugcgcauccacgucgacgagcccgacgagcugaccgugcacgucaagagcgacgaccccgacgugguagccgccuccagcucccucauggcgcggaagcuggaguucgggacggacucaacauucaaggccuucuccgccaugcccaagaccagcuuaugcuucuacaucguggagcgcgaguacugcaagggcugcuccaaagaggacacccagaagugcgucaacacgaagcucgagcagccgcagagcauccugaucgagcacaagggcaccaucaucggcaagcaaaacaauaccugcacagccaaggccagcugcuggcuggagucagugaaguccuucuucuacggccucaagaacauguuaagcgggaucuucggcaacguguuccuggggaucuucuccuuccucgcgcccuucguccugcugauccucuucuucauguucggcuggcgcauccuguucugcuucaagugcugccggcgcacgcggggccuuuucaaauaucgccaccucaaggacgacgaggagaccggguaccggaagaucauugagcgccucaacaacaagaagggcaagaacaagcugcucgacggggagcggcuggccgaccgcaagaucgccgagcuguucagcaccaagacccacaucggc

SEQ ID NO: 15414 - RNA, 3495 nt, Artificial Sequence
  derived and/or modified CDS sequence (opt11) from CCHVF(CCHVF SCT ex Afghanistan)__KC344856.1__Gn-NSm-Gc
ucagaagagagcggcgacgacugcaucucccgaacccaacuccuacggacagaaacagccgagguacacaacgacaacuacggcgguccaggggacaaaauaaccaucuguaacggaagcacuauaguggaccaacgccucggcagcgaacuuggcuguuauacuauaaaucgcgucaagagcuucaaacucugcgaaaacagcgccacggggaagaguugcaaaaucgacagcacgcccgucaaaugccgacaaggauucugccucaaaauaacacaagaaggacgggggcauguaaagcuaucacgcgguuccgaaguaguguuggacgcgugcgauucaagcugcgaaauaaugauaccaaagggcaccggagacauucucgucgauugcucuggaggacaacaacacuuccucaaagacaaccuaaucgaccuaggcugucccaacauuccgcuacuaggcaaaauggcgauauacauaugccgcaugucaaaccaccccaaaaccacaauggcauuccuauucugguucagcuucgguuacgucaucacuugcauuuucugcaaagucauauucuaccugcucauaguagucggcacccuaggcaagaaauucaagcaauacagagaacucaaaccacagacguguaccaucugcgaaacuacuccaacaaacgccaucgacgccgaaaugcaugaccuaaacuguaguuacaacauaugccccuauugcgcaucucguuuaaccuccgacggccuggcgcgacauguaacccaauguccuaaaagaaaagaaaaggucgaagagacagaacuauaccugaaucucgaacguaucccuuggauuguccgcaaacuucuccaagucucagaaucaacaggaguagcacuaaaacgcagcagcugguuaauaguccucuuaguucucuugacaguaucccuaagucccguacaaucagcacccaucgggcacggcaaaacuauagagacauaccagacgcgggagggauacauauccguaugccuauucguacucggcggaauccuauucguuguuaguugccugaucaaagggcugguagauucugugggaaacuccuuuuuccccggacucagcauaugcaaaaccugcucuauaggauccgucaacggcuucgagauagagucacauaagugcuacugcucucuacuaugcugcccguacugccgucacugcuccaccgaccgggagauccaccaacuacaccuaucgauaugcaaaaagcgcagaacaggaggaaacgugaugcucgccgugugcaagcgaaugugcuuccgcgccaccauggagguaagcaacaagguccuauucauaaggaacauaauaaacaccacauucguuaucugcauucucauccuagcaguaugcgucguaucaacaagcgccgucgaaauggaaagccucccggccgggacuugggaaagggaagaagaccuuacaaacuucugccaccaggagugucaagugaccgagaccgaaugccuaugccccuacgaagcccuaguccuccgcaagccccuauuucuaaauucaauagucaaagguaugaagaaccuccuaaacagcaccaaccucgaaacaagccucucaauagaagcacccuggggagcuauuaacguacaaagcaccuuuaaacccaccguuucgacagccaacaucgcccuguccuggagcucgguagaacaccgggguaacaaaauccucgucucaggacgcucggaauccaucaugaaacuagaggaaagaaccggaauaagcugggaucucggcgucgaggacgcgagcgaaucgaaaucacucaccguauccgugauggaccuaagucaaauguacucacccgucuucgaauaucuaagcggcgacagacaggucgaagaguggcccaaagccacaugcaccggagacugcccggaaagaugcggaugcaccucguccacaugccuacauaaagaguggccgcacucccgcaacuggcggugcaacccgaccugguguuggggcgucggaacgggauguaccugcugcggucuagacguaaaagaccuguuuaccgacuacauguucguaaaauggaagguagaauacaucaaaaccgaagccaucgucugcgucgaacucacaagucaagaacgacaaugcucgcucaucgaagcaggcacccgauucaaucugggacccgucaccaucacccuaagcgaacccagaaacauacaacaaaaacucccaccagaaauaauaacgcuacacccaagaauagaggaaggauucuuugaccucaugcacguacaaaaaguccuaucggccuccacggucugcaagcuccaaagcugcacacacggaguccccggcgaccuccaagucuaccacaucggaaaccuccucaaaggugacaaacugaacggacacaugauccacaagaucgaaccucacuucaacaccucauggaugucaugggacggcugcgaccuagacuacuacugcaacaugggagacuggcccucaugcacauacaccggcgugacacaacacaaccacgcagccuucguaaaucuccucaacaucgaaaccgacuauaccaaaaacuuucacuuccacuccaaacgaguuacagcccacggagacacaccccaacuugaccucaaggcccggccaacuuauggagccggcgagaucacaguucuagucgagguagccgacauggaacuccauaccaagaaaauagacauuuccggucucaaauucgcgucccucacaugugccggcugcuacgccugcagcucuggaauaucaugcaaaguaaggauacacgucgacgaacccgacgagcugaccguacacgucaagucagaagauccagacaucguagccgcuagcacaucacugauagcccgcaaacucgaacucggcaccgacagcaccuucaaggcuuucuccgccaugcccaagaccagccucugcuucuacauagucgaacgagaauacuguaaguccugcuccaaagaggacacccaaaaaugcguuaacacgaagcucgagcacccccagggaauacucauugaacacaaaggaacgaucaucggaaaacaaaacgauaccugcacugcuaaagcuggcugcuggcucgagucaguaaaaucauucuuuuacggccugaaaaacauguuaagcggaauuuucggcaacguauucaucgguauauuuuuauuccucgcccccuucguccuacucauccucuucuucauguucggcuggcgucuccuauucugcuucaaaugcugccgccgcaccagaggccuauucaaauaccggcaccuuaaagaggacgaagagagcgguuacagacgaaucauugaacgccuaaacaacaagaaaggcaaaaacaaacuucucgacggagaacgccuagcagaccgccgaauugcugaacuauucucgaccaaaacccacaucggc

SEQ ID NO: 15415 - RNA, 3495 nt, Artificial Sequence
  derived and/or modified CDS sequence (opt11) from CCHVF(CCHVF Zahedan 2007)__KC867273.1__Gn-NSm-Gc
agcgaggaguccggcgacgacugcaucagccgcacccagcugcuccggaccgagacggccgaggugcacggcgacaacuacggcgggcccggcgacaagaucaccaucugcaacggguccaccguaguggaccagcgccucggcagcgagcugggcugcuacaccaucaaccgggugcgcuccuucaagcucugcgagaacagcgccacggggaaguccugcgagaucgacagcaucccggucaagugcaaacagggcuucugccucaagauaacccaggaggggcggggccacgugaaacuguccagggggagcgaggugguccucgacgugugcgacuccagcugugaggugaugauccccaagggcacaggcgacaucuuggucgacugcuccgggggccagcagcacuucuuaaaggacaaucucguggaccuggggugccccaagaucccccugcucggcaaaauggcgaucuacaucugccggaugagcaaccacccgaagaccaccauggccuuccuguuuugguucuccuucggauacgugaucacgugcauccugugcaaggcaaucuuuuuccuccugauuaucuucggaacccugggcaagcgcuucaagcaguaccgggagcucaagccccagaccugcacuauaugcgagacuacccccgucaacgccaucgacgccgagaugcacgaccugaauuguagcuacaacaucugccccuacugcgcgucccgccugacaagcgacgggcucgcccggcaugugacgcaaugcccgcgccggaaggagaaaguggaggagaccgagcucuaccugaaccucgagcgcauccccugggucgugcggaagcugcuccaggucuccgagucaaccggcaccguacucaagcgcaguuccuggcugaucgugcuucucgugcuguucacggucagccugucccccgugcagucggcccccaucgggcacggcaaaaccaucgagaccuaccgggugcgcgaagaguacaccuccaucugccucuucguccugggcagcauccuguucaucguguccuuccucaugaagggacuggucgacggcguagggaacaucuucuucccgggccugagcgugugcaagacgugcuccaucgggagcaucaacggcuucgagaucgagucccaccggugcuacugcagccucuucugcugccccuacugcaggcacuguuccgccgacggagagauacaccagcugcaccugagcauaugcaagaagcggaagaccgguaguaacgucaugcucgcggugugcaagcgcaugugcuuccgcgccaccauggaggugagcaauaagguacuguucauccgguccaucaucaacaccacguucguggugugcauccugauccucgccgucugcguggugagcacuuccgccgucgagauggagagccugcccgccggcaccugggagcgggaggaggaccugaccaacuucugccaccaggagugccaggucacggagacugagugccucugccccuaugaggcgcuggugcugcggcgcccccucuuucucgacagcauagucaaggacaugaagaaccugcugaacuccaccagccucgagaccucccugagcaucgaggcccccuggggcgccaucaacgugcaguccacguacaagcccacagugagcaccgccaacaucgcccuguccuggagcuccgucgagcaucggggaaacaaagugcuagugagcgggcgcuccgagagcaucaugaagcuggaggagcggaccggcaucuccugggaccugggcgucgaggacgcgagcgaguccaaacuccugaccgugucagugauggaccuuucccaaauguacagccccgucuucgaguaccucagcggggaccgccagguggaggaguggccgaaggccacgugcaccggcgacugccccgagcggugcgggugcaccuccaguacgugucugcacaaggaguggccccacucacgcaacuggcgcugcaaccccaccuggugcuggggcguggggaccggguguaccugcugcggccuggacgucaaggaccucuucacggacuacauguucguaaaguggaagguggaguauaucaagaccgaggccaucgucugcguggagcugaccagccaggagcgccagugcucccuaaucgaggccggaacccgcuucaaccucggcagcguuaccaucacgcuguccgagccgcgcaacauucagcagaagcugccgcccgagauuaucacccuccacccuaagaucgaggagggguucuucgacuugaugcacguccagaaggugcugagcgccuccaccgugugcaagcuccagagcugcacccacgggguccccggugaccuccagguguaccacaucggcaaccuccugaaaggcgaccgggugaaugggcaccugauccacaagaucgagcagcacuucaacaccuccuggaugucgugggauggcugcgaccuggacuacuacugcaauaugggggacuggcccuccugcaccuacaccggcgucacccagcacaaccacgcgagcuucguaaaccucuuaaacaucgagacggacuacaccaagaccuuccacuuccacuccaagcgcgugaccgcccacggcgacacgccccaguuagaccucaaggcccggccgaccuacggggccggggagaucaccgucuuaguggaaguggccgacauggagcuccacaccaagaagaucgagaucagcgggcucaaguucgcgggccugacguguaccgggugcuacgccugcagcucgggcaucucgugcaagguccgcauccacguggacgagcccgacgagcugaccguccacgucaagagcgacgaccccgacgugguggcagccagcuccagccucauggcgcggaagcucgaguucggcaccgacuccacguucaaggcauucagcgccaugcccaagaccucccucugcuucuacauagucgagcgcgaguacugcaagaguugcuccaaggaagacacccagaagugcguuaacaccaagcucgagcagccgcagagcauccugauagagcacaaggggacgaucaucggcaagcagaacaacacgugcaccgccaaggccuccugcuggcuggagagcgucaaguccuucuucuacgggcucaagaacaugcugggcgggaucuucggcaacguguucaucggcaucuucaccuuccugacccccuucauucuccugauuuucuucuucauguucggguggcgcauccuguucugcuucaagugcugccggcgcacccggggccucuucaaguaccgccaccugaaggacgacgaggagaccggguaccggaagaucaucgaacgucugaacaacaagaagggcaagaaccggcuucuggacggcgagcgccuggcggaccgaaagaucgccgagcuguuuucaacgaagacccacaucggg

SEQ ID NO: 15416 - RNA, 3495 nt, Artificial Sequence
  derived and/or modified CDS sequence (opt11) from CCHVF(CCHVF SPU 44/08)__KJ682805.1__Gn-NSm-Gc
agcgaggaguccaacgacgacugccugagccgcacacagcuccuucggaccgagaacgccgagauccauuccgacaacuacggcgggccuggcgacaagaucacgaucugcaacgggagcaccaucguggaccagcgccugggcuccgagcucgggugcuacacgaucaaccggguaaagagcuucaagcugugcgagaacagugccaccggcaagagcugcgagaucgacuccacgccggugcgcugccggcagggcuucugccugaagaucacccaggaggggcgcggccacgugaagcucagccgggggagcgaggucgugcuggacgcgugcgacagcuccugcgagaucaugauccccaagggcaccggggacauccugguggacugcagcggcggccagcagcacuuccucaaggacaaccuggucgacuuagggugccccaacaucccgcuccugggcaagauggccaucuacauuugccgcauguccaaccacccgaagacgaccauggccuuccuguucugguucagcuuuggguacgugauaacgugcauccucugcaaggccaucuucuaccugcuaauaguggucggcacccucggcaagaaguucaagcaguaccgggagcugaagccacagaccugcaccaucugcgagaccaaccccgugaacgccaucgacgcggagaugcacgaccugaacugcuccuacaacaucugccccuacugcgccagccgccucaccuccgaugggcuggcccggcacgugaugcaguguccgaagcgcaaggagaagauagaggaaaccgagcuguaccucaaccuggagcggauacccugggucgugcgcaagcuacuccaggugagcgagagcacuggcgucgcccugaagagguccagcuggcuggugauccuccuggugcugcucaccgucucccugagccccgugcaguccgcgcccaucagccacggggagaccgucgaggucuaccagacccgcgagggcuacacguccaucugccuguucgugcucgggagcauccuguuccugguguccugccucaugcggggccuggucgacagcguguccaacuccuucuucccgggccugaguaucugcaagaccugcucaaucggguccaucaacggcuucgagaucgagagccacaagugcuacugcucccuauucugcugccccuacugccgccacugcagcgccgacaucgagauccacaagcugcaccuguccauuugcaagaagcggaagaccgggagcaaugucauguuagccgugugcaagcgcaugugcuuccgggccaccguggaggucagcaacaaggcccugcugauccgcaauaucaucaacacaaccuucguggugugcauccucauccuggcggucugcgugguguccaccagcgccgucgagauggagaaccugcccgccggcaccugggagaaggaggaggaccugacgaacuucugccaccaggagugccaggugaccgagaccgagugccucugccccuacgaggcccuggugcugcgcaagccccucuuccuggacuccaucgucaaggggaugaagaaccugcucaacagcaccucccuggagacgagccuguccaucgaggccccauggggugcgaucaaugugcagagcaccuucaagcccaccguguccgccgccaacaucgcccucagcugguccagcgucgagcaccggggcaacaagauccuggucuccgggcgcagcgaguccaucaugaagcuggaggagcggaccgguaucagcugggaccucgggguggaggacgccuccgagagcaagcugcugacugucagcgugauggaccucucccagauguacagccccguguucgaguaccuguccggcgaccgccaggucgaggaguggccgaaggcgaccugcaccggggauugccccgagcggugcggcugcaccagcuccacgugccugcacaaggaguggccccacagccgcaacuggcggugcaaccccaccugguguuggggcguggggaccggcugcacuugcugcgggcucgacgugaaggaccuguucacugacuacauguuugucaaguggaagguggacuacaucaagaccgaggccaucgugugugucgagcugaccucccaggagcgccagugcagccuuaucgaggccggcacccguuucaaccugggcccggugaccaucacgcuguccgagccccgcaacauccagcagaagcucccgcccgagaucgugacccugcacccgcggaucgaggaaggguucuucgaccugaugcacauccagaagguccucagcgccuccaccguaugcaagcugcagagcugcacccacggcgugcccggggaccugcagaucuaccacaucggcaaccuccugaagggggacaaggucaacggccacuuaauccacaagaucgagccccacuucaacacguccuggaugagcugggacggcugcgaccucgacuacuacugcaacaugggggacuggccguccugcagcuacaccggcguaacccagcacaaccacgccgcguucgugaacaugcugaacaucgagaccgacuacacuaagaacuuccacuuccacuccaagcgcgucaccgcucacggggacacgccccagcuggaccucaaggcccggcccaccuacggcgccggggagaucaccgugcugguggaggucgcggacauggagcugcacaccaagaagaucgagaucagcggccucaaguucgccucccugaccugcaccggcugcuacgccugcagcucggggaucuccugcaaggugcgcauccacguagacgagcccgacgagcugaccguccacgucaagagcgaggacccggacaucguggccgccuccagcucccucauggcgcggaagcuagaguucggcaccgacucaaccuuuaaggccuucuccgccaugcccaagaccucucugugcuucuacaucguggagcgcgaguacugcaaguccugcagcaaggaggacacgcagaagugcgugaacaccaagcucgagcagccccaguccauccugaucgagcacaaggggaccaucaucggcaagcagaacgacacgugcaccgccaaggccagcugcuggcuggaauccaucaagagcuucuuuuacgggcucaagaacaugcuguccggcaucuuuggcaacguguucaucgguaucuuccuguuccucgcgccauucaucaugcugauccuguucuucauguucggcuggcggauccucuucugcuucaagugcugccgccggacccgcgggcuguucaaguaccgccaccugaaggacgacgaggagaucggcuaccggaagaucaucgagcgcuugaacaacaagaaggggaagaacaagcugcuggacggcgagcggcucgccgaccgcaagaucgccgagcuguucagcaccaagacccacauaggc

SEQ ID NO: 15417 - RNA, 3495 nt, Artificial Sequence
  derived and/or modified CDS sequence (opt11) from CCHVF(CCHVF SPU 383/87)__KJ682806.1__Gn-NSm-Gc
uccgaggaguccaacgacgacugccucagccgcacccagcuccugcggaccgagaacgccgagauccacuccgacaacuacggcgggcccggcgacaagaucacgaucugcaaugggagcaccaucguggaccagcgccugggcuccgagcucggguguuauacuauuaaccgggucaagagcuucaaacugugcgagaacuccgccacaggcaagagcugcgagauagacuccacaccggugcgcugccggcagggcuucugccugaagaucacccaggagggucgcggccacgugaagcucagccggggguccgaggucgugcuggacgcgugcgacagcuccugcgagaucaugauccccaaaggcaccggcgacauccugguggacugcagcggcggccagcagcacuuccucaaggacaaccugguggaccuggggugccccaacaucccccuccugggcaagauggccaucuacaucugccgcauguccaaccacccgaagaccacgauggccuuucuguucugguucagcuucgguuacgugaucacgugcauccucugcaaggugaucuucuaccuguuggucguagugggcacccucggcaagaaguucaagcaguaccgcgaguuaaagccccagaccugcaccaucugcgagaccaaccccgucaacgccaucgacgccgagaugcacgaccuaaacugcuccuacaacaucugccccuacugcgcgagccgcuuaaccuccgacggucuggcccggcacgugauccagugcccgaagcgcaaggagaagaucgaggagaccgagcuguaccucaaccuggagcggauccccugggugguccgcaagcugcuccaggugagcgagagcacgggcguggcccugaagcgguccucauggcuggucauccuccuggugcugcucaccgugucccugagccccguccaguccgcccccaucagccacggggagaccguggagguguaccagacccgggagggcuacacguccaucugccuguucgucuuagggagcauccuguuccugguguccugccucaugaagggccuggucgacagcgugggcaacuccuucuucccggggcugagcaucugcaagaccugcuccaucggcagcaucaacggguucgagaucgagucccacaagugcuacuguagccucuucugcugccccuacugccggcacugcuccgcggacaucgagauccaucgccugcaccugagcaucugcaagaagcggaagaccggcucuaacgugaugcucgccgucugcaagcgcaugugcuuccgggccaccguggaggugagcaacaaggcccugcugauccgcaacaucaucaacacgaccuucgucgugugcauccucauccuggccgugugcgucgugagcaccuccgcgguggagauggagaaccugcccgccgggaccugggagaaggaggaggaccugacgaacuucugccaccaggagugccaggugaccgagacggagugccucugccccuacgaagcccuggugcugcgcaagccccuauuccuggacagcaucgugaagggcaugaagaaccugcucaauuccaccagccuggagacgucccugagcaucgaggcccccuggggcgccaucaacguccaguccaccuucaagcccaccgugagcgcggccaacaucgcccucuccuggagcuccguggagcaccgggggaacaagauccuggucagcggccgcuccgagagcaucaugaaacuggaggagcggaccgggauauccugggaccucggcguggaggacgccagcgaguccaagcugcugacggugagcguaauggaccucagccagauguacucccccguguucgaguacuuaagcggggaccgccagguggaggaguggccgaaggcgaccugcaccggcgacugccccgagagaugcggcugcaccuccagcacgugccuucacaaggaguggccccacucccggaacuggcggugcaaccccaccuggugcuggggcgucgggaccgggugcacgugcugcggccucgacgugaaggaccuguucaccgauuacauguucgugaaguggaaggucgacuacaucaagaccgaggccaucgugugcguggagcugaccucccaggagcgccaguguucccucaucgaggccggcacccgguucaacuuagggccggucaccaucacacuuagcgagccccgcaacauccagcagaagcucccgcccgagaucgugacccugcacccgcggaucgaggagggcuucuucgaucugaugcacauccagaaggugcucuccgccagcaccgucugcaaacugcaguccugcacccacggggugcccggcgaccugcagaucuaccacaucgggaaccuccuuaagggcgacaaggugaacggccaccugauccacaagaucgagccccauuucaacacgagcuggaugucaugggacgggugcgacuuagacuacuacuguaacaugggcgacuggccgagcugcuccuacaccggggucacccagcacaaccacgcugccuucgugaacaugcugaacaucgagacagacuacacgaagaacuuccacuuccacagcaagcgcgucaccgcgcacggcgauacuccccagcuggaucucaaggcccggccuaccuacggggccggcgagaucaccguccugguggagguggccgauauggagcugcacaccaagaagaucgagaucuccggccugaaguucgcgagccugaccugcaccgggugcuacgccugcuccagcggcaucuccugcaagguccgcauccacguggacgagcccgacgagcugacggugcacgucaaguccgaggacccggacaucguggccgccagcuccucccucauggcccggaagcuggaguucgggacggauuccacguucaaggcguucagcgccaugcccaagaccucccugugcuucuacaucguggagcgcgaguacuguaagagcugcuccaaggaggacacgcagaagugcgucaacaccaagcucgagcagccccagucuauccugaucgagcacaagggcaccaucuucgggaagcagaacgacacgugcaccgccaaggccuccugcuggcuggagagcgugaaguccuucuucuacggccucaagaacaugcugagcggcaucuucgggaacguguucaucggcgucuuccuguuccucgcccccuucaucaugcugauccuguucuucauguucggcuggcggauccucuucugcuucaaauguugccgccggacccgcggccuguucaaguaccgccaccugaaggacgacgaggagaucggguaccggaagaucaucgagcgccucaacaacaagaagggcaagaacaagcugcuggacggcgagcggcucgccgaccgcaagaucgccgagcuguuuuccaccaagacccacaucggg

SEQ ID NO: 15418 - RNA, 3495 nt, Artificial Sequence
  derived and/or modified CDS sequence (opt11) from CCHVF(CCHVF SPU 130/89)__KJ682807.1__Gn-NSm-Gc
agcgaggagcccaacuacgacugccuuagucgcacccagcuccugcggaccgaaaacgcggagauccacagcgacaacuacggcgggccgggcgacaagaucacgaucuguaacggcuccaccaucguggaccagcgccugggcagcgaguuagggugcuacaccaucaaccggguaaaguccuucaagcugugcgagaacagcgccaccggcaagagcugcgagaucgacucgacccccgugcgcugccggcaaggguucugccugaagaucacccaggaggggcgcggccacgugaagcucuccagagggagcgaggucguguuggacgcgugcgacucuagcugcgagaucaugauccccaagggcaccggggacauccugguggacugcuccggcggccagcagcacuuccucaaggacaaccuggucgaccuggggugccccaacaucccgcuccuggggaagauggccaucuacaucugccguaugagcaaccaccccaagacgacgauggccuuccuguucugguucuccuucggguacgugaucacgugcauccucugcaaaguuaucuucuaccuguuaauugucguuggcacccucggcaagaaguucaagcaauaccgggagcuaaagccccagaccugcaccaucugcgagaccaaccccgugaacgccaucgacgccgagaugcacgaccuuaacugcagcuacaacaucugcccguacugcgcgucccgccucaccagcgacgggcuggcccggcacgucaugcagugccccaagcguaaggagaagaucgaagagaccgagcuguacuugaaucuggagcggauucccuggguggugcgcaagcugcuccaggucuccgagagcacgggcguggcccugaagcggagcuccuggcuggugguccuccuggugcugcucaccgugucauuaucccccguacagagcgccccgaucucccacggcgagaccguggagguguaccagacccgcgagggcuacacgagcaucugccuguucguccucggguccauccuuuuccuggugagcugccucaugaagggccuggucgacuccgugggcaacagcuucuuccccgggcuguccaucuguaagaccugcagcaucggcuccaucaauggguucgagaucgagagccacaagugcuacuguucccucuucugcugcccguacugccggcacugcagcgcggacauagagauccacaaacugcaccuguccaucugcaagaagcgaaaaaccggcucaaacguaaugcucgccgucugcaagcggaugugcuuccgcgccaccguggaggucuccaacaaggcccugcugauccgaaauaucaucaacacgaccuucgucguguguauucuaauccuggccgugugcgucgugagcaccagcgcgguggaaauggagaaucuacccgccgggaccugggagaaggaggaggaccugacgaacuucugccaccaggagugucaggucaccgaaaccgagugccugugcccguacgaggcccugguccugcgcaagccccucucccuggacagcaucgugaaaggcaugaagaaccugcucaacuccaccagccuggagacguccuuaagcaucgaggcccccuggggcgccaucaacguccaguccaccuucaagcccaccgugucugcggccaacaucgcccuguccuggagcuccguugagcaccgcgggaacaagauccuggucagcggccggagugagagcaucaugaagcuggaggagcgcaccgggaucuccugggaccugggcguggaggacgcaagcgaguccaaacuucugacggugagcgugauggaccucagccagauguacucaccgguguucgaguaccugaguggggaccgccaaguggaggaguggcccaaggcgaccugcaccggcgacugccccgagcgguguggcugcaccuccagcacgugccugcacaaggaguggccccacucccggaauuggcgcuguaacccgaccuggugcuggggugucgggaccggauguacgugcugcggccucgacguaaaggaccuguucaccgacuacauguucgugaaguggaaggucgauuauaucaagaccgaggccaucgugugcgucgagcugaccagccaggagcggcagugcagccuaaucgaggccggcacccgcuucaaccuggggcccgucaccauuacgcugagcgagccccggaacauccagcagaagcugcccccggagauugugacccuccacccccgcaucgaggagggguuuuucgaccugaugcacauccagaagguccucagcgccagcaccgucugcaagcugcaguccugcacccauggggugcccggcgaccugcagaucuaccacaucggaaaccuguugaagggcgacaaggugaacggccaccugauucacaagaucgagccgcacuucaauacgagcuggauguccugggacgggugcgaccuggacuacuacugcaacaugggcgauuggcccagcuguuccuacaccggggucacccagcacaaccacgccgccuucgugaacaugcugaacaucgagaccgacuacacgaagaacuuccacuuccacucuaagcgggugaccgcgcacggcgacacgccccagcuggaccucaaggcccgccccaccuacggggccggcgagauuaccguccugguggagguggcugacauggagcuucacaccaagaaggucgagaucuccggccucaaguucgcgagccugacuugcaccgggugcuacgccugcuccagcggcaucagcugcaaggugagaauccacguggacgagccggacgagcugacgguccacgugaaguccgaggaccccgacaucguggccgccagcuccagccucauggcccgcaagcuggaguucgggaccgauuccaccuucaaggcguucagcgccaugcccaagaccucccugugcuucuacaucguagagcgggagcacugcaagagcugcuccaaggaagacacgcagcgcugcgugaacaccaagcucgagcagccccagucaauacugaucgagcacaagggcaccaucaucgggaagcagaacgacacgugcaccgccaaagcauccugcuggcuggagagcauuaaguccuucuucuacggccucaagaacauguuaagcggaaucuuugggaacguguucaucggcgucuuccuguuccucgccccguucaucauccugauccuguucuucauguuuggguggcggauccucuucugcuucaagugcugccggcggacccgcggucugcugaaauaccgccaccucaaagacgacgaagagaucggguaccggaagaucaucgagcgccuuaacaacaagaaaggcaagaacaaacuacucgacggcgagcgacuggcggaccgcaagaucgccgaguuauuuuccaccaagacccacaucggg

SEQ ID NO: 15419 - RNA, 3495 nt, Artificial Sequence; identical to SEQ ID NO: 12133
  derived and/or modified CDS sequence (opt11) from CCHVF(CCHVF SPU 497/88)__KJ682808.1__Gn-NSm-Gc

SEQ ID NO: 15420 - RNA, 3495 nt, Artificial Sequence
  derived and/or modified CDS sequence (opt11) from CCHVF(CCHVF SPU 18/88)__KJ682810.1__Gn-NSm-Gc
agcgaggaguccaacgacgacugucugagccgcacccagcuccugcggaccgagaacgcggagauucacuccgacaacuacggcgggcccggcgacaagauaacaauaugcaacgggagcaccaucguggaccaacgccugggauccgagcucgggugcuacaccaucaaccgggucaagagcuucaagcugugcgagaacagugccacgggcaagagcugcgagaucgacuccacgccggugcgaugccgccagggguucugccugaagaucacccaggaggggcgcggccacgugaaguugagccggggcuccgaggucguacuagacgcgugcgacagcuccugcgaaaucaugauccccaagggcaccggggacauccugguggacugcagcggcggccagcagcacuuccucaaggacaaccuggucgaccuggggugcccuaacaucccccuccugggcaagauggccaucuacaucugccggauguccaaccauccaaaaaccacaaugggguuucuguucugguucagcuucggcuacguaaucacgugcauccugugcaaggugaucuucuaucugcugaucgugguaggcacccucgggaagaaguucaagcaguaccgggagcuuaagccccagaccugcacuaucugcgagacgaaccccgugaacgcuauugacgccgaaaugcacgaccugaauugcuccuacaacaucugcccuuacugcgccagccgccucaccuccgacggccuggcccggcacgucaugcagugcccaaagcgcaaggagaaaauagaggagaccgagcuguacuuaaaucuggagcggauccccuggguagugcgcaagcugcuccaggugucggagagcacggggguggcccugaagcgguccagcuggcuggugauucuccugguccugcucaccgugucccugucgcccgugcagucugcccccaucagccacggcgagaccgucgagguauaucaaacccgcgagggguauaccuccaucugccuguucgugcucggcagcauccuguuccuggucuccugucuuaugaagggccugguggacagcguggggaacuccuuuagcccgggccugucgauaugcaagaccugcagcaucggguccaucaauggcuucgagaucgagagucacaagugcuacuguucccucuucugcugucccuacugccgucacugcagcgccgacaucgagauccacaagcugcaucuguccaucugcaagaaacgcaagacaggaaguaacgugaugcuagcagugugcaagcggaugugcuucagagccaccgucgaggugagcaacaaggcccugcugauccggaacaucauuaacaccaccuucguagucugcauccucauccuugcggucugcguggucuccaccagcgccguggagauggagaaccugcccgcagggaccugggagaaggaggaagaccugacgaacuucugccaucaagagugccaggugaccgagaccgagugccucugccccuacgaggcccugguccugcgcaaacccuuguuccuggacuccaucgugaagggcaagaagaaccuucucaacagcacgucccuggagacgagccuguccaucgaggcccccuggggcgccaucaacgugcaaagcaccuucaagccaaccgucagugccgcgaacaucgcccucagcugguccagcguggagcaccgcgggaacaagauucuagugucggggcggucugaguccauaaugaagcuggaggagcgcaccggcauuucaugggaucucggggucgaggacgccucugagagcaagcugcugacggucagcgugauggaccucucccaaauguacagccccgucuucgaguaccuguccggcgauaggcaggucgaggaguggccgaaggcgaccugcaccggcgacugccccgagcggugcgguugcaccagcuccacgugccugcacaaggaguggccccacagcaggaacuggcgcugcaaccccaccuggugcuggggcguggggaccgggugcacaugcugcggccucgacgucaaggauuuauucaccgacuacauguucgugaaguggaagguggacuacaucaagacggaggcgauagucugcguggagcugaccucccaagagcggcagugcagccuaaucgaggccgggacucgcuucaaucugggcccggugacaauaacccuguccgaaccccggaacauccagcagaagcucccgcccgagaucgucacccugcauccgcguaucgaggagggguucuucgaccugaugcacauccagaaggugcucagcgccuccacggugugcaagcugcagagcuguacccacgggguacccggggaccugcaaaucuaccacaucggaaacuugcugaagggcgacaaggugaacgggcaccugauacacaagaucgagccucacuucaacacguccuggaugagcugggauggcugcgaucucgauuacuacugcaacaugggggacuggccuuccugcagcuacacgggcgugacccagcacaaccacgccgccuucgucaacaugcugaauaucgagaccgacuacacgaagaacuuccacuuccacuccaagcggguuacugcucacggggacacgccucaguuggaccucaaggcgcgcccaacauacggcgccggagaaaucaccgugcuggucgagguggccgacauggagcugcacacgaagaaaauagagaucagcgggcucaaguucgccucccugacaugcaccggcugcuacgcgugcucuagcgggaucuccugcaaagugaggauccacgucgacgaacccgacgaacugacggugcacgucaagagugaggacccggauaucguggccgcguccagcucccucauggcccgcaaacucgaguucggcaccgacagcaccuucaaggccuucuccgcgaugccgaagacgagccugugcuucuacauaguggaacgggaguacugcaaguccugcagcaaggaggacacgcagaagugcgugaacaccaaacucgagcaaccucaguccauccuuaucgagcacaaagggaccaucaucggcaagcagaacgacacgugcaccggcaaggcagggugcuggcuggagagcaucaagucuuucuucuacggccucaagaacaugcugagcgggauauucggcaacgucuucaucgggaucuuccuguuccucgcccccuucaucauguugaucuuguuuuucauguucggauggcgcauccucuucuguuuuaagugcugucgacggacccggggccuguucaaguaccgccaccugaaggacgacgaggagaucggguacagaaagaucaucgagcggcucaaaaacaaaaagggcaagaacaagcugcuggacggggagcgccucgcugaccgaaagaucgccgaacuguucuccacaaagacccacaucggc

SEQ ID NO: 15421 - RNA, 3495 nt, Artificial Sequence
  derived and/or modified CDS sequence (opt11) from CCHVF(CCHVF SPU 556/87)__KJ682811.1__Gn-NSm-Gc
uccgaggaguccgacggcgacuguaucagccgcacacaguuacuccguaccgagacggccgagauccacuccgacaacuacgggggccccggggacaagaucaccaucugcaacggcagcaccaucguggaccagcgccugggguccgagcugggcugcuacaccaucaaccgggucaagagcuucaagcucugcgagaacuccgccacgggcaagagcugcgagaucgacuccacgccggugaagugccgccagggguucugccugaagaucacccaggagggccggggucacgugaagcugagccgcggcuccgaaaucguccucgacgcgugcgacagcuccugcgagaucaugauccccaaggggaccggcgacauccugguggacugcagcggcgggcagcagcacuuccugaaggacaaccucaucgaccugggcugccccaacaucccccugcucgggcggauggccaucuacaucugccgcauguccaaccacccgaagacgaccauggccuuccuguucugguucagcuucggcuacgugaucacgugcauccugugcaagguuaucuucuaccuccugauuguggccggcaccguggggaagaaguucaagcaguaccgggagcugcgcccccagaccugcaccaucugcgagaccacccccgucaacgccaucgacgcggagaugcacgaccucaacugcaguuacaacaucugccccuacugcgccagccggcugacguccgacggccuggcccgccacgugaugcagugccccaagcggaaggagaagaucgaggagaccgagcucuaccugaaccuggagcgcauccccugggugguccggaagcuccuccaggugagcgagagcaccgggguggcccugaagcgcuccagcuggcugaccgucuuacuggugcuccugaucgugucccugagccccguccagagcgcccccaucggccacgggaagacgaucgagaccuaccaggcccgagagggcuauaccagcuucugccucuucauccugggcuccauccuguucaucgugagcugccucgugaaggggcugaucgacuccgucggcaacagcuucuucccggggcuguccaucugcaagaccugcagcaucggcuccgugaacggguucgagaucgagagucacaagugcuacugcucccucuucugcugccccuacugccgccacugcagcgccgaccgggagauacacaagcugcaccuguccaucugcaagaagcgcaagacgggcagcaacgugauguccgcggucugcaagcggaugugcuuccgugccaccaucgagguaagcaaccgcgcgcuccugauccggagcaucaucaauaccaccuucgccgucugcauccugacgcucgccgugugcguggucuccaccagcgccguggaaauggagucccugcccgccggcaccugggaacgcgaggaggaccugaccaacuucugccaccaggagugccaggugacggagaccgagugccucugccccuacgaggcgcugguccugcggaagccgcuguuccucgacagcaucgugaaggggaagaagaaccugcugaacuccaccucacucgagaccucccugagcaucgaggcccccuggggcgccaucaacgugcaguccacguucaagcccaccgucagcgccgccaacaucgcgcuguccuggagcucgguggagcaccgcgggaacaagauccucgugagcggccgguccgagagcaucaugaagcuggaggagcgaaccggcauuuccugggaccuggggguugaggacgccagcgagucgaagcuccugaccguguccgugauggaccugagccagauguacucccccgucuuugaguaccucucaggcgaccgccagguggaggaguggccgaaggcgaccugcacgggggacugccccgagcggugcggcugcaccuccagcacgugccugcauaaagaguggccccacucccggaacuggcgcuguaaccccaccuggugcuggggcguggggaccggcugcacgugcugcgggcuggacguaaaggaccucuucaccgacuacauguucgugaaguggaagguggaguacaucaagacggaggccauagucugcguggaguugaccagccaggaacggcagugcucccugaucgaggccggcacccgcuucaaccuagggccggugaccaucacccugagcgagccccggaacauccagcagaagcugccgcccgagaucaucacgcuccacccccgcauugaggagggcuucuucgaccugaugcacguccagaagguucuguccgccagcacugucugcaaacuccaguccugcacccacgggguccccggcgaccugcagguuuaccacaucggcaaccugcugaagggggacaaggugaacggacacuugauccauaagaucgagccccacuucaacaccagcuggauguccugggacgggugcgaccuggacuacuauugcaacaugggcgacuggccgagcugcacguacaccggggucacccagcacaaccacgccgccuucguuaaccuccugaacaucgagaccgacuacacgaagaacuuccacuuccacuccaagcgggugaccgcccacggcgacacgccccagcuggaccuuaaggcgcgccccaccuacggcgccggggaggucaccguguuaguggaggucgccgacauggagcugcacaccaagaaaaucgagaucagcggccucaaguucgccucccugagcugcaccgggugcuaugccugcagcuccggcaucagcugcaaggugcggauccacguggacgagcccgacgagcugaccguccacgucaagagcgaggacccggacauuguggcggccgggagcucccucauggcccgcaagcuggaguucggcgccgacagcacguucaaggccuucuccgcgaugcccaagaccagccugugcuucuacaucguggagcgggaguacugcaaauccugcagccgcgaggacacccagaagugcgugaacaccaagcucgaacgcccccaguccauccugaucgagcacaagggcacgaucaucgggaagcagaacgacacgugcaccgccaaggccagcugcugguuggaguccgucaagagcuuuuucuacggccucaaguccaugcugagcgggaucuucggcaacguauucaucgggaucuuucuguucaucgccccguucguucuccugauccuguucuucauguucggcuggcggauccuguucugcuucaagugcugccgccggacccgcggccuguucaaguaccggcaccugaaggacgacgaggagaccggguaccgcaagaucaucgagcggcucaauaacaagaagggcaagaacaagcugcuggacggggagcgccucgcggaccggaagaucgcggagcuguucuccaccaagucucacauuggc

SEQ ID NO: 15422 - RNA, 3495 nt, Artificial Sequence
  derived and/or modified CDS sequence (opt11) from CCHVF(CCHVF SPU 431/85)__KJ682812.1__Gn-NSm-Gc
agcgaggaguccgacggagacugcaucagccgcacccagcugcuccggaccgaaacgaccgagauccacuccgauaacuacgggggccccggggacaagaucaccaucugcaacggcagcaccaucguggaccagcgcuuaggguccgagcugggauguuacacgaucaaccgggucaagagcuucaagcucugcgagaacuccgccaccgggaaaagcugcgagaucgacuccaccccggugaagugccgccagggguucugccugaagaucacccaggaaggccgggggcacguuaagcugagccgcggcuccgagaucguccucgacgccugcgacagcaacugcgagaucaugauccccaaggggacgggcgacauccugguggacugcucaggcgggcagcagcacuuucugaaggacaaucucaucgaccugggcugccccaacaucccgcugcucgggaagauggcgaucuacaucugccggaugucaaaccacccgaagaccaccauggccuuccuguucugguucuccuucggcuacgugaucacgugcauccugugcaaggucaucuucuaccuccugaucguggccgguacaguggggaagaaguucaaacaguaccgcgagcugcggccccagaccugcaccauaugcgagaccauccccgucaacgccauagacgccgagaugcacgaccucaacugcagcuacaacaucugcccauauugcgcgucccgccugacgagugacggccuggcccggcacgugaugcagugcccgaagcgcaaggagaagguggaggagaccgagcucuaccugaaccuggagcggauucccuggguagugagaaagcuccuccagguguccgagagcacgggggucgcccugaagcggagcuccuggcucaccgugcuucuggugcuccugaucgucagccugucccccgugcagagcgcccccaucggacacgggaagacgaucgagaccuaccaggcgcgcgagggguacaccuccuucugccucuucauccugggcagcauucuguuuguugucucgugccucgugaaggggcugaucgacagcgugggcaacuccuucuucccggggcugagcaucugcaagaccugcaguaucggcuccaucaacggguucgagaucgagucccacaagugcuacugcagccucuucuguugucccuacugccggcacugcccugccgaccgcgagauccacaagcugcaccugucaaucugcaagaagcggaagacgggcagcaacgucaugcucgccgucugcaaacgcaugugcuuccgggccaccaucgaagucuccaaucgcgcccugcugauccgcaacaucaucaauaccaccuucguggugugcauccuuacgcuggcggucugcguggugagcaccuccgccgucgagauggagagccuacccgcaggcaccugggagaaggaggaggaccucaccaacuucugccaccaggagugccaagugaccgagaccgagugccugugcccguacgaggcccuggugcugcggaagccccucuuccuggacagcaucgucaagggucgcaagaaccugcucaacuccaccagcuuggagaccucccugagcaucgaggcccccuggggcgcgaucaaugugcaguccacguucaaacccaccgugagcgccgccaacaucgcccucaguuggucauccgucgagcaccgggggaacaaaauacuggugagcggccgcuccgagagcaucaugaagcuggaggaacggaccggaaucuccugggaccucgggguggaggacgccagcgaguccaagcugcugaccgucagcgugauggaccucucccagauguacucaccuguguucgaguaccugagcggcgacaggcaggucgaggaguggcccaaggcgaccugcacgggggacugcccagaacgguguggcugcaccuccagcacgugccugcauaaggaguggccccacucccgcaacuggcggugcaacccuaccuggugcuggggcguggggaccggcugcacgugcugugggcucgacgugaaggaccuguucaccgacuacauguucgugaaguggaagguggaguacaucaagaccgaggcuaucgugugcgucgaguuaaccagccaggagcgccagugcucccucaucgaagccggcaccagguucaaccuggggcccgugaccauuacccugagcgagccccgcaauauccagcagaagcugcccccggagaucaucacgcugcacccccggaucgaggaaggcuuuuucgaccugaugcacgugcaacgcguccucuccgccagcaccgugugcaagcugcaguccugcacccacggggugcccggcgaccugcaggucuaccacaucggcaaccuccuuaagggcgacaaggugaacggccaccugauccacaagaucgagccgcacuucaacaccagcuggauguccugggacgggugcgaccucgacuacuacugcaacaugggcgacuggcccagcuguacguacaccggugugacccagcauaaccacgccgcguucgucaaccugcugaacaucgagaccgacuacaccaagaacuuccauuuucacuccaagcguguuaccgcgcacggcgacacgccccagcucgaucugaaggcccgccccaccuacggagccggggaagugaccgugcugguggagguggcggacauggagcuccacaccaagaagaucgagauaagcggccugaaguucgccucccuaaccugcaccgggugcuacgccugcagcuccggcaucagcugcaaggucaaaauccacguagacgagccggaugagcucacggugcacgucaaguccgaggaccccgacaucguggcggccgggagcucucugauggcgcggaaacuugaguucggcgccgacuccaccuucaaggccuucagcgccaugccuaagaccucccucuguuucuacaucguggagcgcgaguacuguaagagcugcucccgggaggacacccgcaagugcgucaacacgaagcucgaccgcccccagagcauccucaucgagcacaagggcaccaucaucgggaagcagaacaacacgugcaccgccaaagcguccugcuggcucgagagcgugaaguccuucuucuacggccugaagaacaugcugagcgggaucuucggcaacguuuucaucgggaucuuccucuucaucgccccguucgugcugcugauccucuucuuuauguucggcuggcggauccuguucugcuuuaagugcugccgccggaccagaggccucuucaaguaccggcaucucaaagacgacgaggagaccgguuacagaaagauuaucgagcggcugaacaacaaaaagggcaagaacaagcugcucgacggggagcgccuggccgaccggaagaucgccgaacuguucuccaccaagagccacaucggc

SEQ ID NO: 15423 - RNA, 3495 nt, Artificial Sequence
  derived and/or modified CDS sequence (opt11) from CCHVF(CCHVF SPU 48/90)__KJ682813.1__Gn-NSm-Gc
agcgaggagccaagcgacgacugcauaagccgcacacagcuccuacgaaccgaaacagccgaaauacacggcgacaauuacggagggccaggugacaaaaucaccaucugcaacggaucaacuauuguagaccaacggcuaggcucagaacuaggaugcuacacaaucaaccgugucaagucauucaaacucugcgagaacagugccaccggaaaauccugcguaauagacucgguaccagucaaaugccgacaagguuacugccuccgcaucacccaagaaggccgcggccacguaaaacuaucucgugguucugaagugguccuggacgccugugacacgaguugcgaaauaaugauccccaaagggacaggcgacauccuaguagacugcagcggcggucaacagcacuuccucaaggacaaccucaucgacuuaggcugccccaaaauaccacuccuuggcaagauggccauauacauaugccgaaugagcaaccaccccaccaccaccauggcauuucucuucugguuuagcuucggauacgucauaaccugcauacuguguaaagcaauauucuaccuacucauaauuauaggcacccuaggcaagcgcuuccgacaauaccgagaacucaaaccucaaaccugcacaaucugcgagaccacuccugucaacgccauagacgccgaaaugcacgaccucaacugcuccuauaacaucugcccauacugcgcgucgagacuaaccagcgacggccuugcccgccacgucacgcaaugccccaaaagaaaagaaaaagucgaagaaaccgaauuauaccucaaccucgaacgcaucccauggguaguccgaaagcuacuacaggucagugaauccacagguguggcuuugaaacgcuccucauggcuuauuguacuacucguccucuuuacggugucccucucccccguccaguccgcccccaucggccacggcaaaaccauagaggccuacagagcccgcgaaggauacacauccaucugcuuauuuguacuagggucaauacuauucguugucuccugccucaugaaacgccucgucgacucuguaggcaacucauucuuccccggccuaagcauuugcaaaaccugcagcauaagcuccauaaacggauucgagauugaaagccacaagugcuacugcucccuauucugcugcccauacugccgucacugcagcgcagacaaagaaauccacaagcuccaccucuccaucugcaagaagcgaaaaaccggcucuaauguaaugcucgcagucugcaagcgaauguguuuccgggcuaccauggaagucagcgaccgcgcccucuucauacgaagcaucauaaacacaacauucguccucugcauccuuauccuagcagucugcguagucuccacuagcgcggucgaaauggaaaaccuccccgcgggcaccugggaacgcgaagaagaccuaacuaacuucugccaccaagagugucaggucacagaaaccgaaugucucugccccuacgaagcccuaguacuacggaaaccccuuuuccgcgacagcauaguaaagggcaugaaaaaccuccucaacuccaccagccuggaaacaagccucuccauagaagccccuuggggcgccaucaacguacaaucuaccuauaaaccaacagucucuaccgcaaacauagcacucuccugguccuccguagagcaucgcggaaacaaaauccucgucuccggccgaagcgaaucaaucaugaaacuggaagagaggaccgggauauccugggaccucggaguugaagacgccucggaaagcaaacuucucacagucucggucauggaccuuucgcaaauguauucaccagucuucgaguaccucuccggugacaggcaaguugaagaauggcccaaagcaaccugcaccggggacugccccgagcgcugcggcugcacaucgagcacaugccuucacaaagaauggccucauucccggaacuggcgauguaacccaacuugguguuggggagugggaacaggcuguaccugcugcggccuugacgugaaagaccuguucacggacuacauguucgucaaguggaaaguagaguacaucaaaacagaagcaaucgucugcguggaacucaccucgcaggaacggcaaugcucccuaauagaagccggcacccgcuucaaccuggguccugucacaaucacccucagcgaaccccgcaacauacagcagaaauuacccccagagauaaucacucuccaucccaggauagaagagggguucuucgaccuuaugcacguccaaaagguauuaucugcaucaaccgugugcaagcuccaaucgugcacacacggaguacccggcgaucuccaaguauaccacauagggaaccuacucaaaggggacaagguaaacggacaccucauccacaaaaucgaaccgcacuucaacaccuccuggaugucaugggacgggugugaucuggacuacuacugcaacaugggagacuggccgucgugcaccuacaccggcguaacccagcacaacagagccagcuucguaaaucuauuaaacaucgagacugacuauaccaaaaacuuccauuuucacaguaaacgaguuaccgcccauggcgacaccccacaacucgaccugaaagcacguccaacguauggagcuggugagaucaccguccuagucgaaguugcagauauggagcuacacacaaagaaaaucgagauuagcggccucaaauucgccucccugaccugcaccgggugcuacgcaugcaguagcggcauaagcugcaaaguccgcauacacguagaugaacccgacgaacucaccguucauguaaaaucagacgaccccgacguugucgccgcgucguccucccuaauggcccgaaagcucgaguucggcacggacuccacguucaaagcguucucagcuaugccgaaaacaucccuaugcuucuacaucguugaaaaagaguacugcaaaagcuguagcgaagaagacaccaagaaaugcgugaacacaaaacuagagcaaccgcaaucgauccugaucgagcacaaaggcaccauuauuggaaagcagaacucaacgugcacugcgaaagucuccuguuggcucgaaagcgcuaaauccuucuucuacgggcucaaagacaugcucucagggaucuucggcaacgucuucaucggaaucuuccuauuccucgcgcccuuuauauugcuaauacucuucuucauguucggcuggcgaauacuacucugcuucaaaugcugucgccgaacccggggacuauucaaauaccgacaccucaaggacgacgaagaaaccggauaucgucgaaucauugaacgacuuaacaauaagaaagggaaaaacaagcuacuugacggugaacgacuagccgaccggcguauagccgaacucuucagcaccaaaacccauaucgga

SEQ ID NO: 15424 - RNA, 3495 nt, Artificial Sequence
  derived and/or modified CDS sequence (opt11) from CCHVF(CCHVF SPU 187/90)__KJ682814.1__Gn-NSm-Gc
agcgaggaacccuccgacgauuguaucagccgcacucagcuccuccggaccgagacagccgagauccacggcgacaacuacgggggcccgggggauaagaucaccaucugcaacggcucaaccauaguggaucagcgccuggggagugaacugggcugcuacaccaucaaccgggucaaguccuucaagcucugcgagaacagcgccacggggaaguccugcgagaucgacagcguucccgugaagugccgccagggguacugccugcggaucacucaggagggccgcgggcacgucaagcugucccggggaagcgagguggugcuagacgcgugcgacaccuccugcgagaucaugauccccaaggggaccggcgacauccuggucgacugcaguggcgggcagcagcacuuucugaaggacaaccucaucgaccuagggugcccaaagaucccgcugcucggcaagauggccaucuacaucugccgcauguccaaucaucccaagacgaccauggccuuccuguucugguucuccuucggcuacgugaucacguguauucugugcaaggccaucuucuaccuccuaauuaucaucggcacccugggaaagcgguucaagcaguaccgcgagcucaagccccagaccugcacaaucugugagaccacccccgugaacgccaucgacgcggagaugcacgaucugaacugcuccuacaacaucugcccuuacugcgcaagccggcugacguccgacggccucgcccgccacgucacccagugccccaagcggaaggagaagguggaggagaccgaguuauaucugaaccucgagaggauacccugggugguccggaagcugcuccaggugagcgaguccaccgggguggcccucaagagaagcucguggcugaucguccugcuaguacuguucacggugucccugucuccgguccaguccgcgccuauuggccacgggaagaccaucgaagccuaccgggcccgcgagggcuacacaagcaucugccucuucgugcuaggcuccauccuguucguggucagcugccucaugaaggggcugguagacuccgugggcaacagcuucuuccccgggcuguccauaugcaagaccugcagcaucggcuccauaaacggguucgagauugaaucucacaagugcuacuguucccucuucugcugcccauacugccggcacugcagcgccgacaaggagauccacaagcugcacuuguccaucugcaagaagcgcaagacgggcagcaacgucaugcucgccgugugcaagcguaugugcuuccgcgcgaccauggaggucuccaacagagcccuguucauucggagcaucaucaacaccaccuucgugcugugcauccucauacuggccgugugcgucguauccacgagcgcagucgagauggagaaccugcccgccggcaccugggagcgcgaggaggaccucaccaacuucugccaccaggagugccaggucaccgagacggagugccugugcccguacgaggcgcugguacugcgccgcccccucuuccuggacagcaucguaaaggggaugaagaaccugcucaacuccaccagccuggagaccuccuuaagcaucgaggcccccuggggcgccaucaacguccaguccaccuacaagcccacgguaagcaccgccaacaucgcccucucauggagcuccguggagcaccgggggaacaaaauccugguuagcggccgcuccgaaagcauuaugaagcuggaggagcggacggggaucuccugggaccucggaguggaggacgcgagcgaguccaagcugcugacugugucagucauggaccucagccagauguacucgccgguauucgaguaccugagcggcgaccgccagguggaggaguggcccaaggcgaccugcacuggggacugccccgagcggugcggcugcacguccagcacgugccugcacaaggaauggccccacucccgcaacuggcggugcaacccgaccuggugcuggggugucgggaccggcugcacgugcugcgggcucgacgugaaggaccuguucaccgacuauauguucgugaaguggaaggucgaauacauuaagaccgaggccaucgugugcguggagcugacaagccaggagcgccaguguucccucaucgaagccggcacccgguucaaccugggucccgucaccaucacccugagcgagccacgcaauauccagcagaaguugcccccggagaucaucacgcugcacccccggaucgaggaaggcuucuucgaccugaugcacgugcagaaggugcucuccgccucaaccgucugcaaacuucaguccugcacccacggggugcccggcgaccuccaaguauaccacaucggcaaccuccugaagggggauaaggucaacggccaccugauccacaagaucgagccgcacuucaacaccagcuggauguccugggacgguugcgaccucgacuacuacugcaacaugggcgacuggcccagcugcacguacaccggggugacccaacacaaccacgccuccuuugugaaccugcugaacaucgagaccgacuacaccaagaacuuccacuuccacagcaagcgcguuaccgcccacggcgacacgccccagcucgacuugaaggcccggcccaccuacggcgccggagaaaucaccgugcugguggaggucgcggacauggagcuccacacaaagaagaucgagaucuccggccugaaguucgccagccuaaccugcaccgggugcuacgccugcuccagcggcauauccugcaaggugcgcauccacgucgacgagccggacgagcucacgguccaugucaagucagacgaccccgacguaguggccgccagcucuagccugauggcgcggaagcuggaguucgggaccgacuccauuuucaaggccuucagcgccaugcccaagaccucccucugcuucuacaucguggagcgcgagcacugcaagagcugcuccgaggaggacaccaagaagugcgugaacacgaagcuggagcagccgcagagcauccugaucgagcacaagggcaccaucaucggcaagcagaacuccacgugcaccgccaagaccaguuguuggcucgaguccgucaagagcuucuucuacgggcugaagaauaugcucuccggcaucuuugggaacguguucaucggcaucuuccuguuccuggccccguucauccugcucauccuguucuucauguucggguggcgcauccuguucugcuucaaaugcugccggcgcacacggggccucuucaaguaccgccauuuaaaggacgacgaggaaaccggcuaccggcgcaucaucgagcggcugaacaacaagaaggggaagaacaagcuccuggacggcgagcgccuggcggaccggcgcaucgcggagcuguucagcaccaagacccacaucggg

SEQ ID NO: 15425 - RNA, 3495 nt, Artificial Sequence
  derived and/or modified CDS sequence (opt11) from CCHVF(CCHVF Haskovo-V46/13)__KR092379.1__Gn-NSm-Gc
agcgaggaacugggcgaugacugcaucucccgcacccagcuccugcggaccgagacggccgagauccacgacgacaacuacgguggccccggggacaagaucaccaucugcaacggcagcaccaucguagaccagcgccugggguccgagcucggcugcuauaccaucaaccggggcaagagcuucaagcugugcgaaaacuccgcaacggggaagaccugcgagaucgacagcaccccggucaagugccgccagggcuucugccugaaaaucacccaggaggggcggggccaugugaagcucucccgcgggagcgaggugguccuggacgccugcgacuccagcugcgaggugaugauacccaagggcacgggcgacauccugguggacugcuccgggggccagcagcacuuccucaaggacaaccugauugaccuggggugcccccacaucccccuccugggcaagauggccaucuacaucugccggaugagcaaccacccgcgcaccaccauggccuuccuguucugguucuccuucggcuacgucaucacgugcaucuucugcaaggcccuauucuacagccugauuauuaucgggacccugggcaagaagaucaagcaguaccgggagcucaagccccagaccugcaccaucugcgagaccacgcccguaaacgccaucgacgcggagaugcacgaccugaacugcuccuacaacaucugccccuacugcgccagccgccugaccuccgacgggcucgcccggcacgugacucaaugcccgaagcgcaaggagaaggucgaggagaccgagcuguaccugaaccucgagcggauccccuggaucgugcgcaagcuguuacaggugagcgaguccacgggcgucgcccucaagaggagcagcuggcugaucgugcugcucgugcugcugcccgucucccucagccccgugcaguccgcgccggugggacacggaaagaccaucgagaccuaccagacccgcgagggcuuuacgagcaucugccuguucaugcugggguccauccucuucaucgucagcugccuggugaagggccugguggacuccgugggggacagcuucuuccccggccucuccgugugcaagaccugcagcaucggaaguaucaacggauucgagaucgagagccacaagugcuauugcucccuguucugcugccccuacugucggcacuguagcgccgaccgcgagauccaccagcugcaccuguccaucugcaagaagcggaagaccggcagcaacgugaugcuggccgucugcaaacgcaugugcuuccgcgccaccaucgaggccucccgccgcgcgcugcucauccggagcaucaucaacacgaccuucgccaugugcauccugacccugaccaucugcguggucucaacgagcgccguggagauggagaaccuccccgccgggaccugggagcgcgaggaggaccugaccaacuucugccaccaggagugccaggugaccgaaacggagugccugugcccguacgaggcccugguccuccggaagccccuguuccuggacagcaucgucaaaggcaugaagaaccuccuuaacuccaccagccuggagaccucccucagcaucgaggcgcccuggggcgccaucaacgugcaguccaccuucaagcccacugucagcacggccaacaucgcccuguccuggagcuccguggagcacagagggaacaaaauccuggugaccgggcggagcgaguccaucaugaagcucgaggagcgcaccggggucagcugggaccugggcguggaggacgccuccgagagcaagcugcucaccguguccaucauggacuuaucccagauguacucccccgucuucgaguaccugucuggggaccgccagguugaggaguggcccaaggcgacgugcaccggcgacugccccgagcggugcgggugcaccagcuccacgugcuugcacaaggaguggccccacagccggaacuggcgcugcaacccgaccuggugcuggggcgugggcaccggaugcacgugcugcggcgucgacgugaaggaccuguucaccgaccacauguucgugaaguggaaggucgaguacaucaagaccgaggccaucgugugcguggagcugaccucccaggagcggcaguguagccucaucgaggccgggacccgguucaaccugggccccgucaccaucacgcuguccgagccccggaacauccagcagaagcugcccccggagaucaucacccugcaccccaagaucgaggagggguucuucgaccugaugcacgugcagaaggugcucagcgccuccaccgucugcaagcugcaguccugcacgcacggcauccccggcgaccuccaggucuaccacaucgggaaucugcuaaagggcgaccgcgugaacgggcaccucauccacaagaucgagccgcacuucaacacguccuggaugagcugggacggcugcgaccucgacuacuacugcaacaugggggauuggcccuccugcaccuacaccggcgucacccagcacaaccacgccgcguucgugaaccugcugaacaucgaaacggacuacacgaagaccuuccacuuccacagcaagcgggugaccgcucacggcgauacgccccagcucgaccugaaggcccgccccaccuacggggccggagagaucaccguucuggucgagguggcggacauggagcuccacaccaagaaggucgagaucuccgggcugaaauucgccagccugacgugcaccggcugcuacgccugcuccagcgggauauccugcaaggugcggauccacguggacgagccggacgagcugaccguccacgucaagagcuccgaccccgacgugguugccgccggcaccagccugauggcgcgcaagcucgaguucggcacggacagcaccuuuaaggccuucuccgccaugcccaagaccagccucugcuucuacaucguggagcgggaguacugcaaguccuguagcgaggacgacacccagaagugcguggacaccaagcuggaacagccccaguccauccugaucgagcacaaggggacgaucaucggcaagcagaacgacacgugcaccgcccgcgcuagcugcuggcucgaguccgucaagagcuucuucuacgggcugaagaacaugcugggcuccguguucggcaacuuccucaucggcauccugcuguuccucgcgccauucgugcugcuggugcuuuucuucauguucggcuggaagauccuguuuugcuucaagugcugccgccggacccgcgggcuauucaaguaccggcaccucaaggacgacgaggagacaggcuaccgccggaucauagagcgccugaacagcaagaaggggaagaaccggcuccucgacggcgagcgccuggccgaccggaagaucgccgagcuuuucuccaccaagacccacaucggc

SEQ ID NO: 15426 - RNA, 3495 nt, Artificial Sequence
  derived and/or modified CDS sequence (opt11) from CCHVF(CCHVF 24-R-2012)__KR814856.1__Gn-NSm-Gc
ucagaggaacccggcgacgacugcaucucucgcacccaacugcucaggaccgagacggcggagauucacgaugacaacuacgggggcccgggggacaaaaucaccauaugcaacggcagcaccaucguggaucagcgccugggguccgagcugggcugcuacaccaucaaccgggucaagagcuucaaguugugcgagaacuccgccacgggcaagaccugcgagaucgauagcacccccgugaagugccgccagggguucugccugaagaucacccaggagggccgggggcacgugaagcucucccgcggcagcgaggucgugcuagacgcgugcgacacguccugugaggugaugauccccaaagggacaggcgacauccuggucgacugcaguggcgggcagcaacacuuccugaaggacaaccucaucgaccuggggugcccccacaucccgcuauugggaaagauggccaucuacaucugccggauguccaaccacccccgcacgaccauggccuuccuguucugguucagcuucggcuacgugaucacaugcaucuucugcaaggcccuguucuacucgcucaucaucaucggcacccuggggaagaagaucaagcaguaucgggaacugaagccccagaccugcaccaucugcgagacggcccccgugaacgcgaucgacgcggagaugcacgaccucaauugcagcuacaauaucuguccguacugcgccucccgccugaccagcgacggccuggcacggcaugucccccagugccccaagcgcaaagagaagguggaggagaccgagcucuaccugaaccucgagcggauccccuggaucgugcguaagcuccugcaggucuccgagagcaccgggguggcccugaaacgguccagcuggcucaucguguuacucguccuccugacggugagccuguccccggugcaaagcgcccccgucggccacgggaagaccaucgagaccuaccagacccgcgaaggcuucacgagugucugccucuuuaugcugggcagcauccuguucuuaguguccugccuagucaaggggcugguggacagcgugucagacagcuucuuccccggcuuaucagucugcaagaccugcagcauuggguccaucaacggcuucgagaucgagagccacaagugcuacugcucacuguucugcugucccuacugucggcacuguagcgccgacagggagauccaccagcugcaccucucgaucugcaagaagcggaagauggggagcaacgugaugcuggccgucugcaagcgcaugugcuuccgggcuaccaucgaggcgucccgacgcgcccugcucauccggagcauaaucaacaccacguucgugaucugcauccugacacugacgauuuguguagucuccaccagcgccguggagauggagaaccugccgucgggcacgugggagcgcgaggaggaccugaccaacuucugccaccaggagugccaaguaaccgagaccgagugccugugccccuacgaggccuuaguccuccggaaaccacuguuccuggacuccauagugaagggcaugaagaaccuccugaacagcacgucucuggagaccagccucucgaucgaggcccccuggggcgcgaucaacgugcagagcaccuucaagccgaccguuuccaccgccaacaucgcccugagcugguccaguguggagcaccgcgggaacaagauccuggugacggggagauccgagagcaucaugaagcucgaggagcgcacaggaguauccugggaccuggguguggaggacgccagcgaguccaagcugcuuacaguguccaucauggaccugucccagauguacagccccgucuucgaauaccugagcggcgaccgccagguggaagaguggcccaaggcgaccuguacgggcgacugccccgagcggugugggugcaccuccuccacgugccuccacaaggaauggccgcacucccggaacuggcgcugcaaccccaccuggugcuggggcguugggaccggcugcacgugcugcggcgucgacgugaaggaccuguucaccgaccacauguucguaaaguggaaggucgaguacaucaagacagaagccaucgugugcguggagcugaccucacaggagcggcagugcucccucauugaggcgggaacacgcuucaaccugggcccgguaaccaucacccugucugagccccggaacauccagcagaagcuaccgcccgagaucaucacgcugcaccccaagguggaggagggguucuuugaccuaaugcacgugcaaaagguccucuccgcaagcacagugugcaagcugcaauccugcacucacgguaucccgggggaccuccaggucuaccacauuggcaaucuccugaagggcgaccgcgucaacggacaucugauccacaagaucgaaccccacuucaacaccucuuggauguccugggacggcugcgaccucgacuacuauugcaacaugggggacuggccaagcugcacguacacuggcgugacccagcacaaccacgcggccuucguaaaccugcucaacaucgagaccgacuacacgaagaccuuccacuuccacucaaaacgggucaccgcacacggggauacgccccagcucgaccugaaggcccgcccgaccuacggcgccggcgagaucaccgugcugguggaggucgccgacauggaacuacacaccaagaagguggaaaucagcgggcugaaguucgcgucgcuggccugcaccggcugcuacgccugcagcuccgggaucagcugcaaggugcggauccacgucgacgagcccgacgagcucacggugcaugugaaguccaacgaccccgaugugguggccgcaucgaccagccugauggcacgcaagcuggaguuuggcaccgacuccaccuucaaggcguucagcgccaugcccaagacgagccucugcuucuacaucguggagagagaguacugcaagagcugcuccgaagaggacacucagaaaugcgucgauaccaagcucgagcaaccgcagagcauccuuaucgagcacaaggggacuauaaucggcaagcagaacgacacgugcacagcgaaggccuccuguuggcucgaguccgugaaguccuucuucuauggccugaagaacaugcucgggagcguguucggcaauuucuucaucgggauccuccuguuccuggcacccuucguccuccuggugcuguucuucauguuuggcuggaagauccuguucugcuuuaagugcugccgccgcacccgggggcugcugaaguaccgccuccuaaaggacgacgaggagaccggcuaccgcagaaucaucgagcgccugaacaacaaaaagggcaagaacagacugcuggacggcgagcggcuugccgaccgcaagaucgccgagcuguucuccacaaagacgcacaucggc

SEQ ID NO: 15427 - RNA, 3495 nt, Artificial Sequence
  derived and/or modified CDS sequence (opt11) from CCHVF(CCHVF 36-ST-2014)__KR814857.1__Gn-NSm-Gc
agcgaggagcccggcgacgacugcauuucccgcacccagcuguuaaagaccgagacggccgagauccacgacgauaacuacggugguccgggggacaagaucacgaucugcaacggcucaaccaucguagaccaacggcuggggagcgagcucggcugcuacaccaucaaucgcgucaaguccuucaaacucugcgagaacuccgccacgggcaagaccugcgagaucgacagcacaccugugaagugucggcagggguucugccucaagauuacccaggagggcagagggcacgugaaacuuucccggggcagcgaggucgugcucgacgcgugugacucuagcugcgagaucaugaucccuaaggggacgggggacauccuaguggacugcuccggcgggcagcaacacuuccugaaggacaaccucaucgaccuuggcugcccucacaucccucugcucggcaagauggccaucuacaucugccgcaugagcaaccauccccggacgaccauggccuuccuguucugguucuccuucggcuacgucauuaccugcaucuucugcaaggcccuguuuuacagccucaucaucaucggcacgcuagggaagaagaucaagcaguaccgcgagcugaagccccagacgugcacaaucugcgagacggcccccgugaacgccaucgacgccgagaugcacgaucucaacugcuccuacaacaucuguccguauugugccagccgguuaacguccgacggccuggcucgccacgugacccagugccccaagcggaaggagaaggucgaggagaccgagcucuacuuaaaccuggagcgcaucccguggaucgugcgcaagcuccuucaggugagcgagaguacaggggucgcgcugaagcguucgagcuggcucaucgugcugcugguccugcugacggucucccugagccccgugcaguccgccccggugggccacgggaagaccaucgagacauaccagacccgggagggcuucacgaacaucugccuuuucaugcugggcagcauccuguucauugucuccugccuugugaaagggcuaguggacagcgucuccgauagcuucuucccgggccuguccgugugcaagaccugcuccauugguuccaucaacggcuucgagaucgagagccacaaaugcuacugcucccucuucugcugccccuacugucgccacugcagcgccgaccgggagauccaccagcugcaccuggggauaugcaagaagcgcaagaccgguuccaacguaaugcucgccgucugcaagagaaugugcuucaaggccacuaucgaggcaagccgccgggcccuguugauccgcuccaucaucaacacgaccuucgugaucugcauucucacacuggccaucugcgucgugagcaccuccgccgucgagauggaaaaccugcccgcgggcacgugggagcgcgaggaggaccucacaaacuuuugccaccaggagugccagguaucagagacagagugccugugcccguacgaggcucuggugcugcguaagccccucuucuuggacagcaucgugaaaggcaugaagaaccugcucaacuccaccagccuggagacgagucugagcaucgaggcgcccuggggcgccaucaacguccaguccacguucaagcccaccguuagcaccgcuaacaucgcccucagcuggagcuccguggagcaccgcgggaacaagauccuggugaccggccggucagagaguaucaugaagcuggaggagcgcacggggguuagcugggaccuaggcguggaggacgccucggagagcaagcugcugacugucuccauaauggaccucucccagauguacuccccgguguucgaguaccuaagcggagaccgucagguggaagaguggccaaaggcgaccugcacaggggacugccccgagcgcugcggcugcacgucaucuaccugccugcacaaggaguggccccacucccggaacuggcgcugcaacccgaccugguguuggggugucgggacuggcugcacgugcuguggcguggacgugaaggaccucuucaccgaccauauguucaucaaguggaaggucgaguauaucaagaccgaggccaucgugugcgucgaguuaacaucgcaggagcggcagugcagccugaucgaggccggcacgcgcuucaacuuagggcccgucaccaucacacuauccgagccccggaacauccagcagaagcugcccccggagaucaucacccuccaccccaagaucgaagagggcuuuuucgaccugaugcacgugcagaaggugcugagcgccuccacggucugcaaacuucaaucgugcacccacgggauccccggcgaccugcagaucuaccacaucggaaaccugcucaagggggaccgccuuaacggccaccugauccacaagaucgagccgcacuucaacaccuccuggaugucgugggacgggugcgaucucgauuacuacuguaacaugggcgauuggcccuccugcaccuacacgggggugacccagcacaaccacgccgccuuuguaaaccugcugaacaucgagaccgauuacaccaagacguuccacuuccacaguaagcgagucacggcccacggcgacacgccccaguuagaccugaaggcgcgccccaccuacggcgcgggggagaucaccgugcugguggaagucgcagacauggagcuccacaccaagaagguugagaucuccgggcugaaguuugcuagccuggccugcaccggguguuacgccugcuccagcggcaucaguugcaaggugcggauccacgucgacgaaccugacgagcucaccgugcacguaaagagcuccgaccccgacgucguggcggccagcacgagccugauggcccgcaaacuggaguucggaaccgacucuaccuucaaggccuucucagccaugcccaagaccucccucugcuucuacaucguggaacgggaguacugcaagagcugcuccgaggacgacacgaagaagugcgucgacaccaagcuggaccagccccagagcauccugaucgagcacaagggcaccaucaucggaaagcagaaugauaccugcacugcgaaggccuccugcuggcucgagagcgugaaguccuucuuuuacgggcugaagaauaugcugggcagcguguucggcaacuucuucgucggaauacuccuguuccuggccccguucguccuccuggugcuguuuuucaugugcggguggaaauuccucuucugcuuuaagugcugccgccggacgcgaggccuguucaaguaccgccaccugaaggacgacgaggagaccgguuaccggcgcaucauagagcggcuaaacuccaagaagggaaagaaccgccugcuggacggcgaacggcucgccgaccgcaaaaucgccgagcuguucagcaccaagucccacaucggc

SEQ ID NO: 15428 - RNA, 3495 nt, Artificial Sequence
  derived and/or modified CDS sequence (opt11) from CCHVF(CCHVF 37-R-2013)__KR814858.1__Gn-NSm-Gc
agcgaggaacccggcgacgacugcauuucccgcacccagcugcuccgcaccgagacggccgagauccacgacgacaacuacgggggcccgggggacaagaucaccaucugcaacggcagcaccaucguggaccagcgccugggguccgagcuaggcugcuacacuaucaaccgggucaagagcuucaagcucugcgagaacuccgccacgggcaagacgugcgagaucgauagcacccccgugaagugccgccagggguucugccugaagaucacccaggaaggccgggggcacgugaagcugucccgcggcagcgaggucgugcucgacgcgugcgacacguccugcgaggugaugauccccaaggggacgggcgacauccuggucgacugcagcggcgggcagcagcacuuccugaaggacaaccucaucgacuuaggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaaaccccagaccugcaccaucugcgagacggcccccgugaacgcgaucgacgccgagaugcacgaccugaacugcagcuacaacaucugcccguauugcgccucccgccugaccagcgacggccuggcccggcacgucccccagugccccaagcgcaaggagaagguggaggagaccgagcucuaccugaacuuagagcggauccccuggaucgugcgcaagcuccuccagguguccgagagcaccgggguggcgcugaagcgguccagcuggcugaucgugcugcugguccuccugaccgugagccuguccccggugcagagcgcccccgucggccacgggaagaccaucgagaccuaccagacccgcgagggcuucacguccgugugccucuucaugcugggcagcauccuguuccucguguccugccuggucaagggacugguggacagcguguccgacagcuucuuccccggccucuccgucugcaagaccugcagcaucggguccaucaacggcuucgagaucgagagccacaaguguuacugcucccuguucugcugccccuacugccgacacugcagcgccgaccgcgagauccaccagcugcaccucuccaucugcaagaagcggaagauggggagcaaugugaugcuggccgucugcaagcgcaugugcuuccgggccaccaucgaggcgucacgccgcgccuuacucauccggagcauaaucaauaccacguuugugaucugcauacuaacccugaccaucugcguggucuccaccagcgccguggagauggagaaucucccgagcggcacgugggagcgcgaggaggaccugaccaacuucugccaccaggagugccaggugaccgagaccgagugccugugccccuacgaggcccugguccuccggaagccccucuuccuggacuccaucgugaagggcaugaagaaccuccugaacucaacgucccuggagaccagccucuccaucgaggcccccuggggcgcgaucaaugugcagagcaccuucaagccgaccgucuccaccgccaacaucgcccugagcugguccagcguggagcaccgcgggaacaagauccuggugacggggcgcuccgagagcaucaugaagcucgaggagcgcaccggcgucuccugggaccuggggguggacgacgccagcgaguccaagcugcucaccgugagcaucauggaccugucccagauguacagccccgucuucgaguaccugagcggcgaucgccagguggaggaguggcccaaggcgaccugcacgggcgacugccccgagcggugcgggugcaccuccagcacgugccuccacaaggaguggccgcacucccggaacuggcgcugcaaccccaccuggugcuggggcgucgggaccggcuguaccugcugcggcgucgacgugaaggaccuguucaccgaccacauguucgugaaguggaaggucgaguacaucaagaccgaggccaucgugugcgucgagcugaccagccaggagcggcagugcucccucaucgaggccgggacccgcuucaaccugggccccgucaccaucacucugagcgagccccggaacauccagcagaagcucccgccugagaucaucacgcugcaccccaagguggaggagggguucuucgaccugaugcacgugcaaaagguccucuccgccucaaccgugugcaaguugcaguccugcacccacggcaucccgggggaccuccagguguaccacaucggcaaucuccugaagggcgaccgcgucaacgggcaccugauccacaagaucgagccccacuucaacaccagcuggauguccugggacggcugcgaccucgacuacuacugcaacaugggggacuggcccagcugcacguauacuggcgugacccagcacaaccaugccgccuucgugaaccugcugaacaucgagaccgacuacacgaaaaccuuccacuuccacuccaagcgggucaccgcgcacggggacacgccccagcucgaccugaaagcccgcccgaccuacggcgccggcgaaaucaccgugcugguggaggucgccgacauggagcuccacaccaagaagguggagaucagcgggcugaaguucgcgucccuagccugcaccggcugcuacgccugcagcuccgggaucagcugcaaagugcggauccacgucgaugagcccgacgagcucaccgugcacgugaaguccaacgaccccgacgucguggccgccagcaccucgcugauggcgcgcaagcuggaguucgguaccgacuccaccuucaaagccuucucagccaugcccaagacgagucucugcuucuauaucguggagcgggaguacugcaagagcugcuccgaagaggacacccaaaagugcgucgacaccaagcuggagcagccgcagagcauccugaucgagcacaaggggaccaucaucggcaagcagaacgugaccugcacggccaaggccucuugcuggcucgagagcgugaaguccuucuucuacggccugaagaacaugcuggggagcgucuucggcaacuuuuucaucgggauccuccuguuccuggcgcccuucguccuacuggugcuguucuuuauguucggcuggaaaauccucuucugcuucaagugcugccgccgcacccgggggcugcugaaguaccgacuccucaaggaugacgaggagaccggcuaccggcgcaucaucgagcggcugaacaacaagaagggcaagaaccgccuccuggacggggagcggcuggccgacaggaagaucgccgagcuguucuccaccaagacgcacaucggc

SEQ ID NO: 15429 - RNA, 3495 nt, Artificial Sequence
  derived and/or modified CDS sequence (opt11) from CCHVF(CCHVF 44-ST-2010)__KR814859.1__Gn-NSm-Gc
agcgaggagcccggcgacgacugcaucucccgcacccaacugcucaagaccgagacggcggagauucacgacgauaacuacggcggcccgggggacaaaaucaccaucugcaacggcagcaccaucguggaccagcggcugggguccgaacugggcugcuacacuauaaaccgcgucaagagcuucaagcucugcgagaacuccgccacgggaaagaccugcgagauagacagcacccccgugaagugccggcagggguucugucugaagaucacccaggagggccgcgggcacgugaagcugucccggggcagcgaggucgugcuagacgcgugcgauuccagcugcgagaucaugauccccaaggggacgggcgacauccucguggacugcuccggcgggcaacagcacuuccugaaggauaaucucaucgaccuggggugcccucacaucccgcugcuagggaagauggccaucuauaucugccgcaugagcaaccacccccggaccaccauggccuuccugcugugguucuccuucggcuacgucauuaccugcauuuucugcaaggcccucuucuacagccugauuaucauuggcacgcuggggaagaaaaucaagcaguacagggagcucaagccccagacgugcaccaucugcgagaccgcccccgugaacgcgaucgacgccgagaugcacgaccugaauugcuccuacaacaucugcccguacugcgccagccggcugacguccgacggccucgcccgccaugugacccagugccccaagcggaaggagaaggucgaggagaccgagcuguaccugaaccuagagcgcauccccuggauagugcggaagcugcuccaggugagcgaguccaccggggucgcgcucaagcgcagcagcuggcugaucguacugcucguccugcugacugucucucugagccccgugcaauccgccccggugggccacgggaagaccaucgagaccuaccagacccgggagggcuucacgaacaucugccuguucauguuaggcagcauccuuuucaucgugucaugccuggugaaagggcugguggacagcgucuccgacagcuuuuuccccggccucuccguguguaagaccuguagcuucggguccaucaacggguucgagaucgagagccacaagugcuacugcuccuuguucuguugccccuauugccgccacugcagcgccgaccgggagauccaccagcugcaccucgggaucuguaagaaaagaaaaaccggcuccaacgugaugcuggccgucugcaagcggaugugcuucaaggccaccaucgaagcaagucgccgggcccugcucauccgcuccaucaucaacacgacauucgugauuugcauccucacccuggccaucugcgucgugagcaccuccgccguggagauggagaaccuccccgccggcacgugggagcgcgaggaggaccugaccaacuuuugccaccaggagugccaggucagcgagaccgagugccugugcccguacgaggcgcugguucuccggaagccccuguuccuggacaguaucgugaaggguaugaaaaaccuccucaauuccaccagucuggagacgucccucagcaucgaggcccccuggggcgccauaaacguccaguccaccuucaagcccaccgugagcacggccaacaucgcccuguccuggagcaguguggagcaccguggaaacaagauccuggucaccggccggagcgaguccaucaugaagcucgaggagcgcacgggggugagcugggauuuaggcguggaggacgcguccgagucuaagcuccucaccgucuccaucauggacuuaagccagauguacaguccaguguuugaguaccugagcggcgaccgccagguggaggaguggcccaaggcuaccugcaccggggauugcccagagcggugcggcugcacgucauccacgugcuuacacaaggaguggccccacagccggaacuggcgcugcaacccgaccuggugcuggggagucggcaccggcugcaccuguugcgggguggacgugaaggaccuuuucacagaccacauguucaucaaguggaaagucgaauacaucaagaccgaggcaaucgugugcguggagcugacaucucaggagcggcagugcagucucaucgaggccggcacgcgcuucaaucuggggcccgugacaaucacccuguccgagccccggaacauccaacagaaacugcccccggagaucaucacccugcacccaaaaaucgaggagggcuucuucgaccugaugcacgugcagaaggugcucagcgccuccacaguaugcaaguugcagagcugcacccacggaauccccggcgaccugcagaucuaccacaucgggaaccuccugaagggggaccgacugaacgggcacuuaauccacaagaucgagccgcacuucaacaccucuuggaugaguugggacgggugcgaccuggacuacuacugcaacaugggcgacuggcccuccugcaccuacacgggggugacccagcauaaccacgcggccuuugugaaccugcucaacaucgagaccgacuacaccaagacguuccacuuccacagcaagcgggucaccgcccacggcgacacgccccagcuggaccugaaagcccgccccaccuacggcgcgggggagaucaccgugcuaguggaggucgccgacauggagcugcacacgaagaaaguggagauauccggccugaaguucgccagccuagccugcaccgggugcuaugccugcuccagcggcaucuccugcaaggugcggauccacgucgacgagccggacgagcugaccgugcacgucaagagcuccgaccccgacgugguggcggccagcacgagccugauggcccgcaagcucgaguucgggaccgauuccaccuucaaggccuucagcgccaugccaaagacgucccugugcuuuuacaucguggagcgggaguacugcaagagcugcuccgaggacgacacgaagaagugcgucgacaccaaguuggaccagccccagucuauacuuaucgagcacaagggcaccauaaucggcaagcagaacgauaccugcaccgcuaaagccucuugcuggcuggagagcgugaaguccuucuucuacgggcugaagaacaugcucggcucuguguucgggaacuucuucgucggaauccuguuauuccucgccccguucguucugcugguucuguucuucaugugcggguggaagauccuguucugcuucaagugcugccgcaggacgcgcggccuauucaaguaccgccaccucaaggacgacgaggagaccggcuaccggcgcaucaucgagcggcugaacuccaagaaggggaaaaaccgccugcucgacggcgagcggcuggcggaccgcaagaucgccgagcuguucagcacgaagucccacaucggg

SEQ ID NO: 15430 - RNA, 3495 nt, Artificial Sequence
  derived and/or modified CDS sequence (opt11) from CCHVF(CCHVF 46-ST-2012)__KR814860.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccggggccacgugaagcuaucccgcggcagcgaggucguguuggacgcaugcgacucgagcugcgaggugaugauccccaaggggacgggcgacauccugguggacugcucuggcggucagcagcacuuccugaaggacaaucucaucgaccugggcugcccccacaucccucugcucgggaagauggccaucuacaucugccggaugagcaaccacccccgcaccaccauggccuuccuguucugguucuccuucggcuacgugauaaccugcaucuucugcaaggcacuguucuacagccucaucaucaucggcacgcuggggaagaagaucaagcaguaccgggaacugaagccccagaccugcaccaucugcgagaccgcccccgugaacgcgaucgacgccgagaugcacgaccucaacuguuccuacaacaucugcccguauugcgccagccgccugacguccgacggccucgcccggcacgucccccagugccccaagcgcaaggagaagguggaggagaccgagcucuaccugaaccucgagcggauccccuggaucgugcgcaagcuccugcaggucucagaguccaccgggguggcgcugaagcggagcagcuggcucauugugcugcugguccuccugaccgugucccugucuccggugcaguccgcccccgucggccacgggaagacuaucgagaccuaccagacacgcgagggcuucaccagcaucugccucuucaugcugggcuccauccuguuccucgugagcugccuggugaaggggcuggucgacagcgugagcgacuccuucuuccccggccucucggugugcaagacgugcuccaucggcagcaucaacggcuucgagaucgagucccacaaguguuacugcagccuguucugcugccccuacugccggcacugcucagccgacagggagauccaccagcugcaccucuccaucugcaagaagcggaagaccgggaguaacgucaugcuggccgugugcaagcgcaugugcuuccgggccaccaucgaggcgagccgucgcgcccugcucauccgguccaucaucaacgccaccuucgucaucugcauccugacgcugaccaucuguguggugagcaccagcgccgucgagauggagucccucccggccggcaccugggagcgcgaggaggaccugacgaacuucugccaccaggagugucaggugacagagaccgagugccugugccccuacgaggcgcuggugcuccggaagccccuauuccuggacagcaucgucaagggcaugaagaaccuccugaacuccaccagccuggagacgucccucagcaucgaggcccccuggggagccaucaacgugcaguccaccuucaagccgaccgugagcaccgccaacaucgcccuguccuggagcuccgucgagcaccgcgggaacaagauccuggugaccgggcggagcgaguccaucaugaagcuggaggagcgcacgggcgugagcugggaccugggggucgaggacgcauccgagagcaagcuguugaccguguccaucauggaccugagccagauguacagccccguguucgaguaccuguccggcgaccggcaggucgaggaguggcccaaggcgaccugcaccggcgacugccccgagcgaugcgggugcacgagcuccacgugccuccacaaggaguggccgcacagccggaacuggcgcugcaaccccaccuggugcuggggcguggggaccggcuguaccugcugcgggguggacgucaaggaccuguucaccgaccacauguucgugaaguggaagguggaguacaucaagaccgaggccaucgucugcguggagcugaccucccaggagcggcagugcagccucaucgaggccgggacccgcuucaaccugggccccgugaccaucacccuguccgagccccggaacauccagcagaagcucccgcccgaaaucaucacccugcaccccaaggucgaggagggguucuucgaccugaugcacguucagaaggugcucagcgccuccacggucugcaagcugcagagcugcacccacggcaucccgggggaccuccagguguaccacaucggcaaccugcugaagggcgacagaaucaacgggcaccuuauccacaaaauugagccccacuucaacaccuccuggaugagcugggacggcugcgaccuagacuacuacugcaauaugggggacuggcccuccugcaccuacacgggcgugacccagcacaaccacgccgccuucgucaaccugcuaaacaucgagaccgacuacaccaagacguuccacuuccacagcaagcgggugaccgcccacggggacacgccccaacucgaccugaaggcccgcccgaccuacggcgcgggcgagaucaccguguuagucgagguggccgacauggagcuccacaccaagaagguggagaucuccgggcugaaauucgccagccuggccugcaccggcugcuacgcaugcuccagcgggaucucaugcaaggugcggauccacguggaugagcccgacgaguugaccgugcacgucaagagcagcgaccccgacgugguggcggccuccacgagccugauggcccgcaagcuggaguucggcaccgacaguaccuucaaggccuucagcgccaugcccaagaccucccucugcuucuacaucgucgagcgggaguacugcaagagcugcuccgaggaggacacgcagaagugcguggacacccgccuggagcagccccagagcaucuuaaucgagcacaaggggaccaucaucggcaagcaaaacgauaccugcaccgcgaaggccuccugcuggcucgagagcgugaaguccuucuucuacggccugaagaacaugcuggggagcguguucggcaacuucuucaucgggauccuccuguuccuggcccccuucgugcuccuggugcuguucuucauguucggcuggaagauccuguucugcuuuaagugcugccgccggacgcgcgggcugcugaaguaccggcaccucaaggacgacgaggagaccggcuaccgccggaucaucgagcgccugaacaacaagaagggcaagaaccggcugcucgacggggagcgccuggccgaccggaagaucgccgagcuguucuccaccaagacccacauaggc

SEQ ID NO: 15431 - RNA, 3495 nt, Artificial Sequence
  derived and/or modified CDS sequence (opt11) from CCHVF(CCHVF 47-ST-2013)__KR814861.1__Gn-NSm-Gc
agcgaggagcccggcgacgacugcaucagccgcacccagcugcucaagaccgagacggccgagauccacgacgacaacuacggaggcccuggagauaagaucaccaucugcaacggcagcacaaucguggaccaacggcugggcuccgagcugggcugcuacaccaucaaccgcguaaagucauuuaaacucugcaagaacuccgccacgggcaagacuugcgagaucgacagcaccccggugaagugccggcagggguucugccugaagaucacccaagagggacgcgggcacgugaagcucucccggggcuccgaggucguucucgaugcgugcgauuccuccugugaaaucaugauacccaaaggaacgggcgauauacuggucgacugcuccggcgggcaacaacacuuccugaaggacaaccucaucgaccucggcugcccccacaucccgcuucucgggaagauggcaaucuacaucugccgcaugagcaaccacccucguaccaccauggccuuccuguuuugguuuucguuuggcuacgucauuacguguaucuucugcaaagcgcuguuuuacagcuuaaucaucauuggaacccuggggaaaaagaucaagcaguaccgagagcugaagccccagaccugcaccaucugcgaaaccgcacccgugaacgcgaucgacgccgaaaugcacgaucuaaacugcucguacaacaucugcccguacugcgccagccggcugacgucagacggccuggcccgccaugugacccagugccccaagcgcaaggagaaagucgaggagacagagcucuaccugaaccucgagcgcauccccuggaucgugcggaaguuacuccagguuagcgaguccaccggggucgcgcugaaacgcagcagcuggcucaucgugcugcuggugcucuuaaccgucucccuaagccccgugcagucugcgccgguuggccacgguaagacaauagagacauaccaaacccgggagggauucacgagcaucugccucuuuaugcuaggguccauccuguucauugugaguugccucgugaaagggcuggucgacuccgucagcgacuccuucuuccccggccugagcgugugccggaccuguucuaucgggaguauuaacggguuugaaaucgaaucccacaaguguuacugcagccucuucuguugccccuacugccgccacugcuccgccgaccgagagauccaccagcugcaccugagcaucugcaagaaacggaaaaccggguccaaugugaugcucgccgucugcaagcgaaugugcuucaaggcgaccaucgaggcaagccggcgcgcacuguuuauccgcuccaucaucaacacgaccuucguaaccugcauccugacccucgccaucugcgucgucucaacgagugccgucgaaauggaagaucugccugccggcacaugggagcgggaggaggacuugacaaauuucugccaccaggaaugccaggucaccgagacggagugucucugcccguacgaggcacugguccugcgcaaaccccuguuccucgacucgaucgugaagggcaugaagaaccuccuaaacagcaccucccucgaaaccucccuuaguauugaggccccauggggcgccaucaacguccagagcaccuucaagcccaccguguccacggccaacaucgcucugagcuggucaagcguagagcaccgggggaauaagauauuagucaccgggcgcuccgaaagcaucaugaagcuggaggagcggacggggguguccugggaccuggggguggaggacgcgagcgaguccaaacuucucacaguuagcaucauggaccugucccagauguacagcccgguguucgaguaccucagcggugaccgccagguggaggaguggcccaaggccacgugcaccggagagugccccgagcggugcgggugcaccuccagcacgugccugcauaaggaguggccccacucccgcaacuggcggugcaacccgaccuggugcuggggcguggguacuggcugcacgugcugcggcguggaugugaaggaccuguucaccgaccacauguucaucaaguggaaggucgaguacaucaaaaccgaggccaucgugugcguggagcucaccagccaggagcggcagugcucccucaucgaggccgggacccgguuuaaucuaggaccggugaccaucacgcuuuccgagccccgcaacauacagcagaagcugcccccggagaucauaacccugcaccccaaaaucgaagagggguucuucgaccucaugcacguccagaaggugcuauccgcaagcaccgucugcaagcuacagucuugcacccacggcauacccggggaccuucagaucuaucauauuggcaaccugcugaagggcgaccgugugaacggucaccucauccacaaaaucgaaccccacuucaacacgagcuggaugaguugggacggcugcgaccuagacuacuacugcaacaugggggauuggccaagcugcaccuacaccggugugacccaacacaaucacgcagccuucgucaaccugcucaacaucgagacggacuauaccaaaacguuccacuuccacuccaagcgggucaccgcucacggugacacgccacagcuggaccucaaagcccggcccaccuauggggcaggagagaucaccgugcucgucgagguugccgacauggagcugcacaccaagaaaguggagguaagcgggcugaaguucgccucccucgccugcacuggcugcuacgccuguaguuccgggaucagcuguaaagugcgcauccacguggacgagccagacgaguuaaccguucacgugaaguccagcgaccccgaugugguagcugccagcacaagucugauggccagaaagcucgaguucggcaccgacagcacguucaaggccuucagcgccaugccaaagaccucgcuguguuuuuacaucguggagcgagaguacugcaaauccugcagcgaggacgacaccaagaagugcguggacaccaaguuggagcagccccaguccauccucaucgagcauaaggggaccauaaucgguaagcagaacgacacauguaccgcaaaagccucaugcuggcuggagaguguaaagagcuucuucuacggccugaagaacaugcucggguccguguucggcaacuuuuucguggggauucugcuguuccucgcccccuucguccugcuggugcuuuucuucauguucgguuggaagauccucuucuguuucaagugcugccggcgaacccgggggcuauucaaguauaggcaccucaaggacgacgaagagaccggauaucgucggaucaucgagcgucugaacagcaagaagggcaagaaccggcugcucgacggggagcgccuggcugaccggaagaucgccgagcuguucuccacgaaaacccauaucggc

SEQ ID NO: 15432 - RNA, 3495 nt, Artificial Sequence
  derived and/or modified CDS sequence (opt11) from CCHVF(CCHVF 52-R-2014)__KR814862.1__Gn-NSm-Gc
agcgaggaacccggagacgacugcaucagccggacccaacuacuacgcaccgagaccgccgaaauccacgacgacaauuacggcgggcccggggacaaaauaacaaucugcaacgguuccaccaucguagaccaacgccucggcagcgagcuaggcugcuacacaaucaaccgcgucaaaucguucaaacugugugaaaauucagcaaccggcaaaacgugcgagaucgacuccacaccgguaaaaugccgccaaggcuucugccuaaaaauaacccaggaaggacgcggccacgucaaacuaagucgaggcuccgagguaguccuagacgccugcgacacuucaugcgaagucaugauacccaagggaacgggagacauccuaguagacugcuccggcgggcaacaacacuuccugaaggacaaucucaucgaccucggaugcccacacgucccccucuuaggcaaaauggccauauacaucugcaggaugucgaaucauccgagaacgaccauggcauuccucuucugguucagcuucggguacgucauaaccugcaucuucugcaaggcacuauucuacucacucauaaucaucggcacccugggaaagaaaauaaaacaguaccgcgaauuaaaaccccaaacgugcaccaucugcgaaacggcaccagucaacgccauagacgccgaaaugcaugaccuaaacugcucguacaacauuugccccuacugugccucacgacucaccuccgacggccucgcacggcacguaccacaaugccccaaacgcaaggaaaaaguagaggaaacagaacuuuaccucaaccucgagcggaucccauggaucguccgcaaacuucuccaggugagcgaaucaaccggcgucgcauuaaaacggagcuccuggcuuauaguauugcuaguacugcuaaccguaagccucucgccaguacaauccgcccccgucggccacggcaaaacaaucgaaaccuaccaaacgcgcgagggguucaccucagucugccuuuuuaugcucggaucgauacucuuccucguaagcugccucguaaaaggacucgucgauuccgucuccgacagcuucuuccccggccucucaguaugcaaaacgugcucaaucgggucgauaaauggguucgagauugagagccacaagugcuacugcucacuauucugcuguccuuacugccgacacugcucagcagaccgcgagauucaccagcuacaccuuuccaucugcaaaaagaggaaaaugggcucaaacgucaugcuugccguaugcaaacgaaugugcuuccgggccacgauugaagccucacgccgagcacuccucauccgaagcaucauuaacaccaccuuugucauuuguauacucacccuaacaauaugugucgucagcaccuccgcaguagagauggaaaaccucccaucaggaacaugggagagggaagaagaccucaccaacuucugccaccaagaaugucaaguaacagaaacagaaugccucugccccuacgaagcgcucguacuccgcaaaccacucuuucucgacucaaucgucaaaggcaugaaaaaccuccugaacagcaccagccucgaaaccucccucagcauagaagccccuuggggagcaaucaacguccagucgacguucaaacccaccgucagcaccgcaaacauagcacucucuuggucguccguagagcaccguggaaauaaaauccuaguaacugggcgcuccgaaucaauuaugaaacuagaggaacgaaccggagugaguugggaccuaggcgucgacgacgccucugaaagcaaacuucuuaccgucaguauaauggacuugucgcaaauguacucgccaguauucgaauaccucucaggcgaccgacaaguagaagaguggccgaaggcaacgugcacgggagacugucccgaacgaugcgguugcacaagcuccaccugucuacacaaggaauggccccacagccggaacuggaggugcaaccccacuuggugcuggggcguaggaaccggguguaccugcugcggcguugauguaaaagaccuuuucaccgaucacauguucguaaaauggaaggucgaauacauaaaaaccgaagccauaguuugugucgagcucacaucccaagaacgccaaugcucacucauagaagccggcacccgauucaaucucggccccgucaccauaacacugucagagccacgcaauauccaacaaaaacucccaccagaaaucaucacucuucaccccaaaguagaagaaggcuuuuucgaccucaugcacguccaaaaagugcucucggcguccacagugugcaaacuccaaucaugcacacacgggauucccggcgaucuccaagucuaucacauaggaaaccuccuaaaaggagacagggucaacggucaucucauccauaaaaucgaaccacacuucaacaccuccuggaugucaugggacggcugcgaccucgauuacuacuguaacaugggggacuggccuucaugcaccuacaccggggugacccaacacaaucacgcagccuucguuaaucuacuaaacaucgaaacagacuauaccaaaaccuuccacuuccacucaaaaagagucacagcccacggcgacacaccacagcucgaccuaaaggcaagacccaccuacggcgcaggagagauaacagugcucguggagguagcagacauggaacuccacacgaagaaaguagaaaucaguggacuaaaauucgcguccuuggccugcacgggaugcuacgccuguucuucuggaaucuccugcaaaguccgcauccacguagacgaaccagacgaacuuacgguccauguaaaauccaaugacccagacgucgucgccgccucgacaucacuaauggcucgaaaacuagaguuugggaccgauuccacauuuaaagcauucuccgccaugcccaaaaccucucuuugcuucuacaucgucgaacgcgaauacugcaaguccugcucagaagaagacacgcaaaagugcgucgacaccaaacuagagcaaccgcaaagcauccucauugaacacaagggcacgauaauaggaaaacagaacgauaccugcacagccaaagcaggcugcugguuagaauccgugaaaucauucuucuacggcuugaaaaauaugcuagguucgguauucggcaacuucuuuaucggcauacuacucuuccuagcccccuucgugcuccucguacuauucuucauguucggcuggaaaauccuguucugcuuuaaaugcugccgucgaaccaggggccuacuaaaauaccgccuacucaaagacgacgaagagaccggcuaccgucgaaucaucgaacgccugaacaacaagaaagggaaaaaccggcuacucgacggagaacgccuugccgaccgaaaaauugcagaacucuucuccaccaaaacacacaucggc

SEQ ID NO: 15433 - RNA, 3495 nt, Artificial Sequence
  derived and/or modified CDS sequence (opt11) from CCHVF(CCHVF 75-R-2012)__KR814863.1__Gn-NSm-Gc
agcgaggaacccggcgacgacugcaucucgcgcacacaguugcuccgcaccgagacagccgagauccacgacgacaacuacgggggcccgggagacaagauaaccaucugcaacggcagcacuaucguagaccaacgacugggguccgagcugggcugcuacaccaucaaccgagucaagagcuucaagcucugcgagaacuccgccacgggcaagaccugcgaaaucgacagcgcgccagugaaaugccgccagggguucugccugaagaucacacaggagggacggggacacgugaagcugucgcgcgguagcgaggucgugcucgacgccugcgacuccaguugugaggugaugauccccaaggggacgggcgacauccuggucgacugcuccggagggcagcagcacuuccugaaggacaaccucaucgaccugggcugcccccacaucccgcugcuuggaaagauggccaucuacaucugcaggaugagcaaccacccccgcacgacaauggccuucuuguucugguucuccuucgguuacgugauuaccugcaucuucugcaaggcccuguucuauagccucaucaucaucggcacauuagggaagaaaaucaagcaguacagagagcugaagccccagacgugcacgaucugcgagaccgcgccggugaacgcaauagaugccgagaugcacgacuugaacugcuccuacaacauauguccguacugcgccagccgccuuaccuccgacggccuggcgcggcacgucccccagugccccaagcgcaaggagaagguggaggagacggagcucuaucugaaccuggagcggauccccuggaucgugcguaagcuccugcaagucagcgagucuaccgggguggcccugaagcguagcagcuggcucaucguccuguugguccuccugaccgugucccugagcccggugcaguccgccccugugggccacgggaagacuaucgagacguaccaaacccgcgagggcuucacuagcauuugccucuucaugcugggcuccaucuuauuccucguuagcugccuggugaaggggcuggucaacuccgugagcgacuccuucuucccaggucucagcgugugcaagacgugcuccaucggaagcaucaacggcuucgagauagagucccacaagugcuacugcagccuuuucugcugccccuacugccggcacuguuccgccgacagggagauacaccagcugcaccucagcaucugcaagaagcggaagacuggguccaacgucaugcuggcugugugcaagcgcaugugcuuuagagcgaccaucgaggcgagccgccgcgcgcugcucauccgguccaucaucaacaccaccuucgucaucugcauccucacgcugaccaucugcguggugagcaccucugcgguugagauggagaaccucccguccggcaccugggagcgcgaggaggaccugacgaacuucugccaccaggagugccaggugaccgagaccgagugccugugccccuaugaggcccuggugcuccggaaacccuuguuccuggacagcaucgucaagggcaugaagaaccugcugaacuccaccagccuggagacuucccucuccaucgaggcgcccuggggcgccaucaacgugcagagcaccuucaagccgacagugucuaccgccaacauagcgcuguccuggucgucggucgagcaccgugggaacaagauccuggugaccgggcggagcgaauccaucaugaagcucgaggagcgcacgggcgugucaugggaccuagggguggaggacgcguccgagagcaagcuguugaccguguccaucauggaccugagccaaauguacagccccguguucgaguaucuguccggcgacaggcaggucgaggaguggcccaaagcgacgugcaccggcgacugccccgagcgaugcgggugcacguccuccacaugccuccacaaggaguggccgcauagccggaacuggcgcugcaacccaaccuggugcuggggcguggggaccggcugcacgugcugcggcguggacguaaaggaucuguucaccgaccacauguuugugaaguggaagguggaguauaucaagacagaggccaucgucugcguggagcuuacaagucaggagcggcagugcagccucaucgaggccgggacucgcuucaaucugggccccgugaccaucaccuuauccgaaccccggaauauucagcagaagcucccucccgagaucaucacacuacaccccaagguggaggagggguucuucgaccugaugcacgugcagaagguccucuccgccuccacggucugcaaacuacagagcugcacccacggcauaccgggcgaccuccagguguaucauauugguaaccuccugaagggcgaccgagugaacggucaccugauccacaagauagagccccacuucaacaccuccuggaugagcugggacggcugcgaccucgacuacuacugcaacaugggggacuggccauccuguaccuacacaggcgucacucagcacaaccacgccgcguucgugaaccugcugaacaucgagaccgacuacaccaaaacguuccauuuucacagcaagcgggugacggcgcacggggacacgccccagcucgaccugaaggcccgcccgaccuacggcgccggcgagaucaccguccugguggagguggcggacauggagcuccacaccaagaaaguggagaucuccgggcugaaguuugccagccuggccugcaccggcugcuacgcgugcuccagcgggauauccugcaaggugcggauccacguggacgagcccgacgagcucaccguccacgucaagagcucugaccccgacguggucgccgcguccacuagccucauggcccgcaagcuggaguucgggaccgacuccaccuuuaaggccuucagcgccaugcccaaaaccucacucugcuucuacaucguggagcgggaguacugcaagagcugcagugaggaggacacgcaaaagugcguggacaccaagcuggaacagccgcagagcauccugaucgagcacaaggggaccaucaucggcaagcagaacgauaccugcacggccaaagcguccugcuggcucgaaagcgucaaguccuucuuauacggccugaagaacaugcucgggagcguguucggcaauuucuucaucgggaucuuguuguuccucgcccccuucgugcugcugguccucuucuucauguucggcuggaagauacuguucugcuucaaaugcugccgccgcacgcggggucugcucaaguaccgucugcugaaggacgacgaggagaccggcuaccggcgcaucaucgagcggcuaaacaacaagaagggcaagaaccgccuucuggacggggaacggcucgccgaccgcaagauugccgagcuguucucaaccaaaacccacaucggc

SEQ ID NO: 15434 - RNA, 3495 nt, Artificial Sequence
  derived and/or modified CDS sequence (opt11) from CCHVF(CCHVF 75-ST-2010)__KR814864.1__Gn-NSm-Gc
ucugaagaguccggugacgacugcaucagccguacccaacugcuccggaccgagacggccgagauccaugacgacaacuacgggggccccggggacaagaucacaaucugcaacggcuccaccaucguggaccagcgccuggggagcgagcugggcugcuauaccaucaaccgggucaaguccuucaagcucugcgagaacagcgccacgggcaagaccugcgagaucgacuccaccccggugaagugccgccagggguucugccugaagaucacccaggagggcagggggcaugugaagcugagccgcggcuccgaggucgugcucgacgccugcgacagcuccugcgaggugaugauccccaaggggacgggcgacauccugguggacugcagcggcgggcagcagcacuuccugaaggacaaccuuaucgaucugggaugcccccacaucccccugcucgggaagauggccaucuacaucugccggauguccaaccacccgcgcaccaccauggccuuccuguucugguucagcuucggcuacgugauuacgugucuauucugcaaggcccucuucuacucccugaucaucaucggaacccuggggaagaagaucaagcaauaccgggagcuccgaccccagaccuguacaaucugugagaccgcccccgugaacgcgaucgacgccgagaugcacgaccugaacugcucauacaacaucugccccuacugcgccucccggcugacgagcgacggccucgcucgucacgucccgcagugccccaagcgcaaggagaagguggaggagaccgagcuauaccugaaccucgagcguauacccuggaucgugcggaaacugcugcaggucuccgagagcaccgggguugcgcucaagcgcagcuccuggcugaucguucugcucguccuccugaccgugagccucucccccguucagagcgcaccggucggccacgggaagacgaucgaaaccuaccagacccgggagggcuucaccuccaucugccuguucaugcugggcagcauccucuuccugguguccugccugguuaaggggcucgucgacagcguuagugacagcuuuuuccccggccuguccguguguaagacgugcaguaucggguccaucaauggcuucgagaucgagagucauaaaugcuacugcucccugcuuugcugccccuacugccgccacugcagcgccgaccgggagauccaccagcuccaccuguccaucugcaagaagcgcaagaccgggagcaacgugaugcucgccgugugcaagaggaugugcuuccgcgccaccauagaagcgucccgccgggcacuucugauccgcucgaucaucaacaccacguucgucaucugcauccucacccugaccaucugcguggugagcaccuccgcugucgagauggagaaccugcccaguggcacgugggagaaggaggaagaccugaccaacuucugccaccaggagugccaggugaccgagaccgaaugccuguguccguacgaggcccuagugcuucggaagccccucuuucuggacucuaucgucaaaggcaugaagaaccugcucaacagcacgucccuggagaccagccuguccaucgaggcccccuggggcgcaaucaacgugcagagcaccuucaagcccaccguguccacugccaacaucgcccuaucaugguccagcgucgagcaccgcgggaacaagauccuggugacggggcgguccgagagcauuaugaagcuggaggaacgcaccggcgugucaugggaccucggggucgaagaugccagcgaguccaagcugcugaccgugagcaucauggaccuuagccagauguacuccccgguguucgaguaccugagcggcgaccggcaggucgaggaguggcccaaggcgaccugcacgggcgacugccccgaaagaugcgggugcaccuccuccacgugucugcacaaggaguggccccacucccgaaacuggcggugcaacccgaccuggugcuggggcguggguaccggcugcacgugcugcggcguggacgucaaggaccucuucacggaucacauguucguaaaguggaagguggaguacaucaagacggaagccaucgucugcguggagcugaccagccaggagcggcagugcucccugaucgaggccgggacccgcuucaaccucggccccgugaccaucacacugagcgagccccguaacauccaacagaagcugcccccagagaucaucacgcuccaccccaagguagaggagggguuuuucgaccugaugcacgugcagaaggugcuguccgccagcaccgucugcaagcuccaguccugcacccacgggauccccggggaccuccagguguaccacauuggcaaccugcucaagggcgaccgcgugaacgggcaucugauccacaagaucgaaccccacuucaacaccagcuggauguccugggacggcugcgaccuggacuacuacugcaacaugggggacuggcccucgugcacguacaccggcguuacccagcacaaccacgccgccuuugugaaccuccugaacaucgagaccgacuacacgaagacauuucacuuccacuccaagcgggugaccgcgcacggggacacuccccagcuggaucucaaggcccgccccaccuacggcgccggcgagaucaccguccugguggagguggccgacauggagcugcacaccaagaaagucgagaucagcgggcucaaguucgcuucccuggccugcaccggcugcuacgccugcagcuccgggaucagcugcaaggugcggauccacguagacgagccggacgagcugacgguccacgucaagucguccgaccccgacguaguggccgccagcaccucccucauggcgcgcaagcuggaguucgguaccgacagcaccuucaaggcuuucuccgccaugcccaagacgagucucugcuucuacaucguggagcgagaauacugcaaguccugcagugaggaggacacccagaagugcguggacaccaagcucgagcagccccaguccauccugaucgagcacaaggggacuaucaucgguaagcagaaugacacgugcaccgccaaggcaagcugcuggcuggaguccgucaagagcuucuucuacggccucaagaacaugcugggauccguguucggcaacuucuucaucgggauccuguuauuccuggcgccguucgugcugcucguacuguucuucauguuuggauggaagauccuguucugcuucaagugcugccgccgcgcccgggggcuccugaaguaccgccaccugaaggacgacgaggaaaccgguuaccggaagaucaucgagcgccucaacaauaagaagggcaagaaucggcugcuggacggggagcgucucgcggaccggaagaucgcagagcuguucagcacaaagacccacaucggc

SEQ ID NO: 15435 - RNA, 3495 nt, Artificial Sequence
  derived and/or modified CDS sequence (opt11) from CCHVF(CCHVF 81-R-2014)__KR814865.1__Gn-NSm-Gc
agcgaggagcccggcgacgacugcaucucccgcacccagcugcucagaaccgagacggccgagauccacgacgacaauuacggcggcccgggggacaagauuaccauaugcaauggcucuaccaucguggaccagcgcuuagguagcgagcugggcugcuauaccaucaaccgaguaaagagcuucaagcucugcgagaacuccgccacgggcaagaccugcgagaucgacagcacccccgugaagugccgccagggguucugcuugaagaucacccaggagggccgggggcaugugaagcugucccgcgggagcgaggucgugcucgacgcgugcgacuccagcugcgaggugaugaucccuaaggggacaggcgauauccuggucgacugcuccggcgggcagcagcacuuccucaaggacaaccucauugaccugggcugcccccauaucccgcugcucgggaagauggccaucuacaucugccggaugagcaaccacccucgcaccacgauggcauuccuguucugguuuuccuucggcuacgugaucacaugcaucuuuugcaaagccuuguucuacagccucaucauaaucggcacccugggaaagaagaucaagcaguaccgggagcucaagccgcagaccugcacgaucugcgagaccgcgccugugaacgcgaucgacgccgagaugcacgaccucaacugcucuuacaauaucugcccuuacugcgccagccgccugacguccgacggccuggcccgccacgucccacagugccccaagaggaaggaaaagguggaggaaaccgagcucuaccugaaccuggagagaauccccuggaucgugcgcaagcuccugcaggucagcgaguccaccgggguggcgcugaagcggagcagcuggcucaucgugcugcugguccucuugaccgugucccugagcccggugcaguccgccccagucggccacgggaagacgaucgagacguaccagaccagagagggcuucacuagcaucugccucuucaugcugggcucaauccuguuucucgugagcugccuggugaaggggcucgucgacuccgugagcgacuccuucuuccccggccucucaguguguaagacgugcuccaucgguuccauuaacggcuucgagaucgaaucgcacaagugcuacugcagccuguucugcugccccuacugccggcauugcuccgccgaccgcgagauccaccagcuccaccucagcaucugcaagaagcggaagaccggcucuaacgucaugcuggccgugugcaaacgcaugugcuuccgcgccaccaucgaggcgagcaggcgcgcccugcuuauccggucuaucauaaacaccacguucgucaucugcauccuaacccugaccaucugcguggugagcaccagcgccgucgagauggagaaccucccggccggcacgugggagcgcgaggaggaccuuaccaacuuuugccaccaggagugccaggugaccgagaccgagugccugugcccauacgaggcucuggugcuccggaagccacuguucuuggacuccaucgucaagggcaugaagaaucucuugaacagcacgucacuggagaccucccucuccaucgaggcgcccuggggcgccaucaacgugcagagcaccuucaaaccgacaguguccaccgccaacaucgcccugagcugguccagcgucgagcaucgcgggaacaagauccuggugacaggcagauccgaaagcauaaugaagcucgaggagcgcaccggcgugaguugggaccugggggucgaggaugcgagcgaguccaaacuucucacagugucuaucauggaccugucccagauguacagccccguguucgaguaccucagcggcgacaggcagguugaggaauggccuaaggcgaccugcacaggcgacugucccgagcgcugcggcugcaccuccagcacgugccuccacaaggaguggccccacucucggaacuggaggugcaaccccaccugguguuggggcguggggacgggcugcacgugcugcggcguggaugucaaggaccuuuucacagaucacauguucgugaaguggaagguggaguacaucaagacagaggccaucgucugcguggaacugacaagccaggagagacagugcuccuugaucgaggccgggacccgcuucaaccugggccccgugaccaucacccugagcgagccccggaacauacagcagaagcucccgcccgagauaauaacgcuacaccccaaggucgaggaaggcuucuuugaccugaugcacguucagaagguucucuccgccagcaccgucugcaaguugcaguccugcacccacggaaucccgggggaccuccagguauaccacaucggcaaccugcuaaagggagaccgcaucaacgggcaccugauccacaagaucgagccccacuucaacaccagcuggauguccugggacgguugcgaccucgacuacuacuguaauaugggggacuggcccagcugcacguacaccggcgugacccagcauaaccacgccgcguucgucaaccugcugaacaucgagaccgauuacacgaagaccuuccacuuccacucuaagcgggugaccgcccauggggacacgccccaguuggaccugaaggcacgcccgaccuacggcgccggcgagauaaccgugcugguggaaguggcggacauggaguugcacaccaagaagguggagaucagcgggcucaaguucgccucgcuggcuugcaccgguugcuacgccugcagcuccgggaucagcugcaagguacggauccaugucgacgagcccgacgagcuaacggugcacgucaaguccagcgaccccgacgugguggccgcgagcaccucgcugauggcccgcaaacuggaguucggcaccgacagcacauucaaggccuucuccgccaugcccaagacgucucucugcuucuacaucgucgaacgggaguacugcaaguccugcagcgaggaagacacccagaagugcguggacacccgucuggagcagccacaguccauccugaucgaacacaaggggacaaucaucggcaaacagaaugacacaugcaccgccaaggcgagcuguuggcucgaguccgucaagagcuucuucuauggccugaagaacaugcugggguccguguuuggcaacuuuuucaucgguauccuacuguuccuggcccccuucgugcuccuggugcuguucuucauguucggcuggaagauccucuucuguuucaagugcugcagacggaccagggggcuacugaaguacagacaccucaaggaugacgaagagaccggguaccgcagaaucauagagagacugaacaauaagaagggcaagaaccggcugcucgacggggagcgccuggccgacaggaagaucgccgagcuauucagcaccaagacgcauaucgga

SEQ ID NO: 15436 - RNA, 3495 nt, Artificial Sequence
  derived and/or modified CDS sequence (opt11) from CCHVF(CCHVF 3756-ST-2007)__KR814866.1__Gn-NSm-Gc
agcgaggagcccggcgacgacugcaucucccggacccagcuucucaagaccgagacggccgagauacacgacgacaacuacgggggcccgggggacaaaaucaccaucugcaacggcagcaccaucguggaccagcggcugggguccgaacugggaugcuacaccaucaaccgcguuaagagcuucaagcucugcgaaaauuccgccacgggcaagaccugcgagaucgacucgaccccagugaagugccggcagggguuuugccugaagaucacccaggagggccgcgggcacgugaagcugucccggggcagugaggucgugcucgacgccugugauuccagcugcgagaucaugauccccaaggguacaggcgacauccugguggauugcuccggcgggcagcagcacuuucugaaggacaaccucaucgaccugggcugcccccacaucccacugcucgggaagauggccaucuacauuugucggaugagcaaccacccccggaccacgauggccuuccuguucugguuuuccuucggcuacgucaucacgugcaucuuuugcaaggcccuguucuacagccucauuaucaucggcacccuggggaagaagaucaagcaguaccgcgagcugaagccccagaccugcacaaucugcgagaccgccccagugaacgcgaucgacgccgagaugcacgaccugaacuguuccuacaacaucugcccguacugcgccagccggcugacgucggacggccuggcccgccacgucacccagugcccgaaacggaaggagaaggucgaggagaccgagcucuaccugaaccuggagcgcauccccuggaucgugcggaagcuccuccaggugagcgaguccaccggggucgcgcugaagaggagcagcuggcucaucgugcugcugguacuccugacggugucccugagccccgugcaguccgccccggugggccacgguaagaccaucgagaccuaccagacccgggagggcuuuacgucaaucugccucuucaugcugggcucuauccuguucaucgucagcugccucgugaaggggcucguggacuccgucagcgacuccuucuuccccggccugucggugugcaaaaccugcuccaucgggagcaucaacggcuucgagaucgagucccacaagugcuacugcagccucuucugcugcccauacugccggcacugcuccgccgaccgggagauccaccagcugcacuugagcaucugcaaaaagcgcaagaccggguccaacgugaugcucgccgucugcaagcggaugugcuuuaaggccaccaucgaggcgagccgccgggcccuccugauccgcaguaucaucaacacgaccuucgucaucugcauccucacgcuggccauaugcgucgugagcaccagcgccguggagauggaggaccugcccgcuggcacgugggagcgcgaggaagaccucaccaacuucugccaccaggagugccaggucaccgagaccgagugccugugcccguacgaggcgcuggugcuacggaagccccucuuccuggacuccaucguaaagggcaugaagaaccugcucaacagcacgucccuggagaccagccuguccauugaagcccccuggggcgcaaucaacguccaaagcaccuucaaacccaccguguccaccgccaacaucgcccucagcugguccagcguggagcaccgcgggaacaagauccuggucaccgggcgcuccgaaagcaucaugaagcuggaggagcgcaccggcguguccugggaccucgggguugaggacgcgagcgaguccaaacuucugaccgucagcaucauggaccucagucagauguacagcccgguguucgaguaccugagcggcgaccgccaaguggaggaguggccaaaggcgaccugcacgggcgacugccccgagcggugugggugcaccuccuccacuugccugcacaaggaguggccccacucccggaauuggcgcugcaacccgaccuggugcuggggagucgggaccggcugcacgugcugcgggguggacgugaaggaccucuucaccgaccacauguucaucaaguggaaggucgaguacaucaagaccgaggccaucgugugcguggaacugaccagccaggagcggcaguguucacugaucgaggccgggacccgcuucaaccucggccccgucaccaucacccugagcgagccacggaacauucagcagaaacugcccccggagaucaucacgcuacaccccaagaucgaggagggguucuucgaucugaugcacgugcagaaggugcuauccgccagcaccgucugcaagcuccaauccugcacccacggcauacccggggaccugcagaucuaccacaucggcaaucugcucaagggcgaucgcgugaacgggcaccugauccacaagaucgagccgcacuuuaacaccaguuggauguccugggacggcugcgaccuggacuacuauugcaacaugggggacuggcccagcugcacauacaccggcgugacccagcauaaccacgccgcuuucgucaaccuccugaacaucgaaaccgacuacacgaagacguuccacuuccacuccaagcggguuaccgcacacggagacacgccccagcuggaccucaaggcccgccccaccuacggcgcgggcgagaucaccgugcuggucgagguggccgacauggagcugcacaccaagaagguggagauuuccgggcucaaguucgccucccugaccugcacgggcugcuacgccugcagcuccgggaucagcugcaagguucggauccacguggaugagccggacgagcugaccgugcacgucaaguccagcgaccccgacgugguggccgcguccaccucccucauggcccguaagcuggaguucggcaccgauagcacguucaaggccuucuccgccaugcccaagaccagccugugcuucuacauaguugagcgggaguacugcaaguccugcagcgaagacgacaccaagaagugcguggacaccaaacucgagcagccccaguccauccugaucgagcacaaggggaccaucaucggcaagcagaacgacacuugcaccgccaaggcgagcugcuggcuggaguccgucaagagcuucuucuacggcuugaagaacauguuaggguccguguucggcagcuucuucguggggauccuccucuuccugaccccguuugugcugcucguccuguucuucauguucggcuggaagauccuguucugcuucaagugcugccgccggacccggggguuguucaaguaccgccaccugaaggacgacgaggaaacgggcuaccggcgcaucaucgaacgacugaacuccaagaaaggcaagaaccgccuccuggauggggagcggcuugccgaccgcaagaucgccgagcuauucagcaccaagacccacaucggc

SEQ ID NO: 15437 - RNA, 3495 nt, Artificial Sequence
  derived and/or modified CDS sequence (opt11) from CCHVF(CCHVF 3809-ST-2007)__KR814867.1__Gn-NSm-Gc
agcgaggaacccggcgacgacugcaucucccgcacccaguuacuccgaaccgagacagccgagauccacgacgacaacuacggaggcccgggggacaagaucaccauaugcaacggcagcaccaucguggaucagcgccuggggagugagcuaggcuguuacaccauuaaccgggucaagucguucaagcucugcgagaacagugccacgggcaagaccugcgagaucgacagcacucccgugaagugccgccagggguucugucuuaagaucacccaggagggccgggggcacgugaagcugagucgcggaucagaagucguacucgacgcgugcgacuccaguugcgaggugaugaucccaaaggggacgggcgacaucuugguugacugcuccggcggucagcagcacuuccugaaagauaaccuaaucgaccuagguuguccccauaucccccugcucgggaagauggccaucuacaucugccgcaugagcaaccacccccgaaccaccauggccuuucuuuucugguucuccuucggcuacguaaucacgugcaucuucugcaaggcgcuguucuauagccuuauaaucaucggcacucuggggaagaaaauaaagcaguaccgggagcugaagccccaaacaugcaccaucugcgagaccgccccagugaacgcgaucgaugcggagaugcacgaccucaauugcuccuacaacaucugcccguacugcgcgagcagacugacgucggacggccuggccagacacgucccucagugccccaagcgcaaagagaaggucgaggagaccgagcucuauuugaacuuggaacggauucccuggauugugcgcaagcuauugcaggucagcgaguccaccgggguggcccugaaacggagcagcuggcucaucgugcugcugguccucuugacaguaagucugucgccugugcaauccgcccccgucggccacgggaagacgaucgagaccuaucaaacccgcgagggcuucaccucgaucugccucuucaugcugggguccauccuguuccucgugagcugucuggugaaggggcuggucgacuccguuagcgacuccuucuuccccggccugagcgucugcaagaccugcagcaucgggagcgugaacggcuucgagaucgagucccacaaaugcuacugcagccuauucugcugcccuuauugccggcacugcuccgccgaccgcgagauccaccaacugcaccuaucggugugcaagaaacggaagacgggguccaacgugaugcuggccgucugcaagagaaugugcuucagggccaccauagaggcgagccgccgcgcccuacucauccgguccaucauuaacacgacguuugugaucugcauccugacccuuaccaucugcgucgugagcaccagcgcgguggaaauggagaacuuaccggccggcacaugggagcgcgaagaggaccuuaccaacuucugccaccaggagugccaggucaccgagaccgagugccugugcccuuacgaggcccuggugcuccggaagccgcuguuccuggauuccaucgucaaaggcaugaagaaccuccugaacagcacgucccucgagacaagccucucuauugaagcccccuggggcgccaucaacguccagucgaccuucaaaccaaccguguccaccgcgaacaucgcucugagcugguccagcguggagcaccgcgggaacaagauucuggucacggggcggucugagagcaucaugaagcucgaggaacggacgggcguguccugggaccuggggguggaggacgccagcgaguccaagcugcucaccgucagcaucauggaccugucgcagauguacucuccuguguucgaguaccugagcggcgacagacaaguagaggaguggccaaaggcuaccugcacgggagacugucccgagaggugcgggugcaccucgucaacgugucuccacaaggaguggccgcacucccggaacuggcgcugcaaccccacauggugcuggggcguagggaccgggugcacaugcugcggcguagaugucaaggaccuguucacggaucacauguucgucaaguggaagguggaguacaucaagacugaggcaaucguuugcgucgagcugaccucgcaggagaggcaaugcucccucaucgaagccgggaccagauucaacuugggccccgugacuaucaccuuaucugagccccggaacauccagcaaaagcucccucccgagauaaucacgcugcaccccaagguagaggagggcuuuuucgaccuaaugcacguucagaaggugcucuccgccagcaccgugugcaagcugcaguccugcacccacggcaucccaggggaccugcaggucuaccacaucggcaaccuccugaagggcgaccgcgugaacgggcaccugauccauaagaucgagccccauuucaacaccagcuggauguccugggacggcugcgaccucgacuacuacugcaauaugggggacuggcccaguugcacguacaccggcguaacccagcacaaccacgccgcguucguuaaccuguugaacaucgagaccgacuacacgaagaccuuccacuuccacuccaaacgggugacugcccacggggacacgccccaacuggaccugaaggcccgcccuaccuacggcgccggcgagaucacggugcuagucgagguagcggacauggaguugcacacaaagaagguggagaucagcgggcuuaaguucgccucucuggccugcaccgguugcuacgcuugcagcucagggauaagcuguaagguccggauccacguggacgagcccgacgagcucacuguacacgucaagagcucggaccccgaugugguggcagcgucaaccagucugauggcccgcaagcuggaguucggcaccgacagcacauucaaggccuucagcgccaugccaaagaccagccugugcuucuacauugucgaaaaggaauacugccgguccugcagcgaggaggacacccagaagugcguggacaccaagcuggagcagccgcaguccauccugaucgagcacaaggggaccaucaucggcaagcagaacgacacgugcaccgccaaagcgagcugcuggcucgaguccgucaagagcuuuuucuacggacugaagaacaugcucggguccguguucggcaauuucuucaucggcauccuccuguuccugacccccuucguucuccuggugcuguucuucauguucggauggaagauccucuucugcuucaaguguugucgccgcacccgggggcugcugaaguaccgccaccuaaaggacgacgaggagacuggguaccgccgcaucaucgaacggcuaaacaacaagaagggcaagaaccgcuugcucgacggggagcgacuggccgaccgcaagauugccgaacuguucucgacaaagacccauaucggc

SEQ ID NO: 15438 - RNA, 3495 nt, Artificial Sequence
  derived and/or modified CDS sequence (opt11) from CCHVF(CCHVF 3820-ST-2007)__KR814868.1__Gn-NSm-Gc
agcgaggagcccggcgacgacugcaucucccgcacccagcugcucaagaccgagacggccgagauccacgacgacaacuacgggagccccggcgacaagaucacuaucugcaacggguccaccaucguggaccagcgucugggcagcgagcuggggugcuacaccaucaaccgcgucaaguccuucaaacucugcgagaacagcgcaacgggcaagacgugcgagaucgacuccacccccgugaagugccggcagggcuucugccugaagauaacccaggaggggcgcggccacguuaagcugagccggggguccgaggucgugcucgacgcgugcgacagcuccugcgagaucaugauccccaagggcacgggggacauccugguggacugcagcggcggccagcagcacuuccugaaggacaaccucaucgaccuggggugcccccacaucccgcugcucgguaagauggccaucuacaucugccgcauguccaaccacccccggacaaccauggccuuccuguucugguucagcuuuggguacgucauaaccugcaucuucugcaaggcccuguucuacucucucaucaucaucggcacccugggcaagaagaucaagcaguaccgcgagcugaagccccagaccugcaccaucugcgagaccgcccccgugaacgcgaucgacgcagagaugcacgaccucaacugcagcuacaacaucugcccguacugcgccucccggcugacgagcgacgggcuggcccgccacgugacccagugccccaagcggaaggagaaggucgaggagaccgagcucuaccugaaccuggagcgcauccccuggaucgugcggaagcuccuccagguguccgagucgaccggcgucgcgcugaagcgcagcuccuggcucaucgugcugcuggugcuccuggccguaagccugucccccgugcagucagccccgguggggcacggcaagacgaucgagaccuaucagacccgggagggguucaccuccaucugccucuucaugcugggcucgauccuguucaucgucuccugccucgugaagggccugguggacagcgucuccgacagcuucuuccccgggcuguccgugugcaagacgugcagcaucggcuccaucaacggguucgagaucgagagccacaagugcuacugcucccucuucugcugccccuauugccgccacugcagcgccgaccgggagauccaccagcugcacuuauccaucugcaagaagcgcaagacaggcagcaacgugaugcucgccgucugcaagcggaugugcuucaaggcgaccaucgaggccagucgccgggcccugcugauccgcagcaucaucaacaccacguucgugaugugcauccucacccuggccaucugcgucgugagcacguccgccguggagauggaggaccugcccgcggggaccugggagcgcgaggaggaccucacgaacuucugccaccaggagugccaggucaccgagaccgagugccugugcccguacgaggcccuggugcugcggaaaccccucuuccuggacucuaucguuaagggcaugaagaaccugcucaacuccaccagccuggagacuucccuuagcaucgaggcccccuggggcgccaucaacguccaguccaccuucaagcccaccgugagcaccgccaacaucgcgcucuccuggagcuccguagagcaccgcgggaacaagauccuggucaccggccggagcgagucuaucaugaagcuggaggaacgcacggggguauccugggaccucggcguggaggacgccuccgagagcaagcugcugaccgucuccaucauggaccucucgcagauguacucuccgguguucgaguaccuguccggggaccgccagguggaggaguggcccaaggcgaccugcaccggcgacugccccgagcggugcggcugcacgagcuccaccugucugcacaaggaguggccccacagccggaacuggcgcugcaacccgaccuggugcuggggcgucgggaccgggugcacgugcugcggcguagacgugaaggaccucuucacggaccacauguucaucaaguggaaggucgaguacaucaagacggaggccaucgugugcguggaguugaccucccaagagcggcagugcagccugaucgaggccggcacgcgcuucaaccucggucccgucaccaucacccuguccgagccccgaaacauccagcagaagcugcccccggagaucaucacccuccaccccaagaucgaggagggcuucuucgaccugaugcacgugcagaaggugcugagugccuccacggucugcaaguuacagagcugcacccacgggauccccggcgaccugcagaucuaccacaucgggaaccuccucaagggcgaccgcguaaacggccaccugauacacaagaucgagccacacuucaacaccuccuggaugucgugggacgggugcgaccuggacuacuacugcaacaugggcgacuggcccuccugcaccuauacgggggugacccagcacaaccacgcggccuucgucaaccuccugaacauagagaccgacuacaccaagacguuccacuuccacagcaagcgggugaccgcccacggcgauacgccccagcuggaccucaaggcgcgucccaccuacggggccggcgagaucaccgugcuggucgagguggccgacauggagcugcacaccaagaagguggagaucuccggccucaaguucgccagccugaccugcaccgggugcuacgccugcuccucuggcaucuccugcaagguccggauccacguggacgagccggacgagcugacggugcacgucaaaagcucggaccccgacgugguggcggccuccaccagccucauggcccgcaagcuggaguucgggaccgauuccaccuucaaggccuucagcgccaugcccaagacgucacugugcuucuacaucgucgagcgggaguacugcaagagcugcuccgaggacgacaccaagaagugcguggacaccaagcucgagcagccccagagcauccugaucgagcacaagggcaccaucaucgggaagcagaacgauaccugcacugcgaaggccuccugcuggcuggagagcgugaaguccuucuucuacggucucaagaacaugcugggcagcgucuucggguccuucuucgugggcauccugcuguuccuggccccguuugugcugcuuguccuguucuucauguucggguggaagauccuguucugcuucaagugcugccguaggacccgcggccucuucaaguaccgccaucugaaggacgacgaggagaccggguaccggcgcaucaucgagcggcugaacagcaagaagggcaagaaucgccuccuggacggcgagcggcuggcagaccgcaagauugcggaacucuucucgacaaagacgcacaucggg

SEQ ID NO: 15439 - RNA, 3495 nt, Artificial Sequence
  derived and/or modified CDS sequence (opt11) from CCHVF(CCHVF 4495-ST-2008)__KR814869.1__Gn-NSm-Gc
agcgaagaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagacgugcgagaucgacuccaccccggugaagugccgccagggguucugccuuaagaucacccaggagggccgggggcacgugaagcugagccgcggcuccgagguagugcucgacgcgugcgacagcucgugcgaggugaugauucccaaggggacaggcgacauccuggucgauugcagcggcgggcagcagcacuuccugaaggacaaccucaucgaccugggcugcccccauaucccgcugcucgggaagauggcuaucuacaucugccggauguccaaccacccgcgcaccaccauggccuuccuguucugguucagcuucggguacgugaucacaugccuguucugcaaggccuuauucuacucccugaucaucaucggcaccuuggggaagaagaucaaacaguaccgggagcuccguccccagaccuguaccaucugcgagaccgcccccguaaacgcaauagacgccgagaugcacgaccugaauugcagcuacaacaucugccccuacugugccucccggcugacgagugacggcuuggcccgccacgucccgcagugucccaaacggaaggagaagguggaggagaccgaacuguacuuaaaccucgagcgcauccccuggaucgugcggaaacugcugcaagucuccgagagcaccgggguggcacucaagcgcagcucauggcuuaucgugcuccucguccugcuaaccgugagccucagcccagugcagagcgccccagucggccacgggaagacgaucgagaccuaccagacccgggaaggcuucaccaguaucugccuguucaugcugggcagcaucuuauuccugguguccugccuggugaaggggcucgucgauuccguguccgacagcuucuucccgggccugucaguaugcaagacgugcagcaucggguccaucaacggcuucgagaucgagagccacaagugcuacugcucccugcucuguugccccuacugucgccacuguagcgccgaccgggagauccaucagcugcaccuguccauauguaagaagcgcaagaccgggagcaacgucaugcuggccgugugcaagcggaugugcuuccgcgccaccauagaggcgucccgccgggcgcugcugauccgcagcauaaucaacaccacguucgucaucugcauccucacccugaccaucugcguugugagcaccuccgccgucgagauggagaaccugcccucggguacgugggagaaggaggaggaucugaccaacuucugccaccaggagugccaggugacugaaaccgagugccucugcccguacgaggcccuggugcugcggaagccccucuuucuggacuccaucgucaaggggaugaagaaccuucucaacagcacgucccuugaaaccagccuguccaucgaggcccccuggggcgcgaucaacgugcagagcaccuucaagcccaccgugucgaccgcaaacaucgcccucagcugguccagcgucgagcaccgcgggaacaagauccuggugacggggcgguccgagagcaucaugaagcuggaggagcgcaccggcaucucuugggaccucgggguggaggacgccagcgaguccaaguuacugaccgucagcaucauggaccucagccagauguacuccccuguguucgaguaccucagcggcgaccgccagguggaggaguggccgaaagcgaccuguacgggcgacugcccggagcggugcgguugcaccuccagcacgugccugcacaaggaguggccccacucccggaacuggcggugcaacccgaccuggugcuggggcgucggcaccggcugcacaugcuguggcguggacgugaaggaccucuuuaccgaccauauguucgucaaguggaagguggaguacauuaagaccgaggcaaucgugugcguagagcugaccagccaggagcggcagugcucacugaucgaggccgggacccgcuucaaccucggccccgugaccaucacccugagcgagccccggaacauccagcagaaacugcccccggagaucaucacgcuccaccccaagguagaggagggguucuuugaccugaugcauguccaaaaagugcugucagccagcaccgugugcaagcuccaguccugcacccacggcauccccggggaccugcaagucuaccacaucggcaaccugcugaagggcgaccgcgugaacgggcaccugauccacaagauagagccgcacuucaacaccagcuggauguccugggacgguugcgaccuggacuacuacuguaacaugggggacuggcccagcugcacguacaccggcgugacccagcacaaccacgccgcuuucgucaaccuccugaacaucgagaccgacuacacgaagaccuuccacuuucauuccaaacgugugaccgcgcacggggauacgccucagcuggaccucaaggcccgccccaccuacggcgccggcgagaucaccgugcuggucgaggucgccgacauggagcugcacaccaagaagguggagaucagcgggcucaaguucgcgucccuggccugcaccggcugcuacgccugcagcuccgggaucagcugcaagguccggauccacguggacgagccggacgagcugacgguccacgucaagagcuccgaccccgacgugguggcugcgagcaccucccucauggcucgaaagcuggaguucgggaccgauagcaccuucaaggcauucuccgccaugccaaagacgagccugugcuucuauaucgucgagcgggaguacugcaaguccugcagcgaggaggacacccagcggugcguggacaccaagcucgagcagccccaguccauccugaucgagcacaaggggaccaucaucggcaagcagaacgacacaugcaccgcaaaagccagcugcuggcuggaguccgucaagucuuucuucuacggccucaagaacaugcugggguccguguucggcaacuucuucauugggauccucuuguuccuggcgccguucgugcugcucgugcuuuucuucauguucgguuggaaaauccuuuucugcuuuaagugcugccgccgggcccgcggacuccuuaaguaccggcaccugaaggacgacgaagagaccggcuaccgcaagaucaucgagcggcucaacaacaagaagggaaagaaccgccugcuggacggggagcggcucgccgaccgcaagaucgccgagcuguucagcaccaagacccacaucggc

SEQ ID NO: 15440 - RNA, 3495 nt, Artificial Sequence
  derived and/or modified CDS sequence (opt11) from CCHVF(CCHVF 4691-ST-2009)__KR814871.1__Gn-NSm-Gc
agcgaggagcccggugacgacugcaucucccgcacgcagcuguugaaaaccgagacggccgagauccacgacgacaacuacggaggcccgggggacaagaucaccaucugcaacggcagcaccaucguggaccagcggcugggguccgagcugggcugcuacaccaucaaccgcgucaagagcuucaagcucugcgagaacucugccacgggcaagaccugcgagaucgacagcaccccggugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcucaggcgggcaacagcacuuccugaaggacaaccucaucgaccugggcugcccccacaucccgcugcucgggaagauggccaucuacaucugccgcaugagcaaccacccccggaccaccauggccuuccuguucugguucuccuuuggcuacgucaucacaugcaucuucugcaaggcccuauucuacagccucaucaucaucggcacccuggggaagaagaucaaacaguaccgcgagcugaagccccagaccugcaccaucugcgagaccgcccccgugaacgcgaucgacgccgagaugcacgaccucaacugcuccuacaacaucugcccguacugcgccagccggcugacgagugacggccuggcccgccacgugacacagugccccaaacggaaggaaaaggucgaggagaccgagcucuaccugaaccuggagcgcauccccuggaucgugcggaagcuccuccaggugagcgaguccacgggggucgcgcugaaacgcagcagcuggcucaucgugcugcuggugcuccugacggucucccugagccccgugcaguccgccccggugggccacgggaagaccaucgagaccuaccaggcccgggagggcuucaccagcaucugccucuucaugcuuggcuccauccuguucaucguaagcugccucgugaaggggcugguggacuccgucagcgacuccuucuuccccggccugagcgugugcaagacgugcuccaucggguccaucaacggcuucgagaucgagucccacaagugcuacugcagccucuucugcugcccguacugccgccacugcuccgccgaccgggagauccaccagcugcaccugagcaucugcaagaagcgccggaccggguccaacgugaugcucgcagucugcaagcgcaugugcuucaaggcgaccaucgaggccagccggcgugcccugcugauccgcuccaucaucaacaccacguucguaaucuguauccucacccuggccaucugcguugugagcaccagcgccguggagauggagaaccugcccgcgggcaccugggagcgggaggaggaccucacgaacuucugccaccaggagugccaggucaccgagaccgagugccugugcccguacgaggcccuggugcugcgcaagccccucuuccuggacuccaucgugaagggcaugaagaaccugcucaacagcaccucccuggagacgucacuguccaucgaggcccccuggggcgccaucaacguucagagcaccuucaagcccgccguguccaccgcgaacaucgcccucagcugguccagcguggagcaccgggggaacaagauccuggucaccgggcgcuccgagagcaucaugaaacuggaggagcggaccggugugucuugggaccucgggguggaggacgccagcgaguccaagcugcugacggucagcaucauggaccucucccagauguacagcccgguguuugaguaccugagcggcgaccgccagguggaggaguggcccaaggcaaccugcaccggcgacugccccgagcggugcgggugcaccuccagcacgugccugcacaaggaguggccccacucccgcaacuggcggugcaacccgaccuggugcuggggcgucgggaccggcugcacgugcugcggcguggacgugaaggaccucuuuaccgaccacauguucaucaaguggaaggucgaauacaucaagaccgaggccaucgugugcguggaguuaaccagccaggagcgccagugcucccugaucgaggccgggacccgguuuaaccucggcccaguuacgaucacccugagcgagccccgcaacauccagcagaagcugcccccggagaucaucacccuccaccccaagaucgaggagggguucuucgaccugaugcacgugcagaaggugcuguccgccagcaccgucugcaagcuccaguccugcacgcacggcauccccggggacuuacagaucuaccacaucggcaaccugcucaagggggaccgggugaacgggcaccugauccacaagaucgagccgcacuucaacacaagcuggaugaguugggacggcugcgaccuggacuacuauugcaacaugggggacuggcccagcugcaccuacaccggcgugacgcagcacaaccacgccgccuucgucaaccuccugaacaucgagaccgacuacaccaagaccuuccacuuccacucaaagcgcgucacggcgcacggggacacgccccagcuggaccucaaggcccggcccaccuacggcgccggcgagaucaccgugcuggucgagguggccgauauggagcugcauaccaagaagguggagauuagcgggcucaaguucgccucccuggcgugcaccggcugcuacgccugcagcuccgggaucagcugcaagguccgcauccacguggacgagccggacgagcugacuguucacgucaaguccagcgaccccgacgugguggccgccagcaccagucucauggcccggaagcuggaguuuggcacggacagcaccuucaaggcguucuccgccaugcccaagaccagccugugcuucuacaucgucgaacgcgaguacugcaaguccugcagcgaggacgacaccaagaagugcguggacacgaagcucgagcagccccaguccauccugauugagcacaaggggaccaucaucggcaagcagaacgacacgugcaccgccaaggccagcugcuggcuggaguccgucaagagcuucuucuacggccucaagaacaugcugggguccguguucggcaauuucuucguugggauccuccucuuccuggccccguucgugcugcucguccuguucuucauguucggcuggaagauccuguucugcuucaagugcugccggcgcacccgcgggcuguucaaauaccggcaccugaaggacgacgaggagaccggcuaccgccggaucaucgaacgccugaacagcaaaaagggcaagaaccggcuccuggacggggagcgccuggcggacagaaagaucgccgagcuguucuccaccaagacacacauaggc

SEQ ID NO: 15441 - RNA, 3495 nt, Artificial Sequence
  derived and/or modified CDS sequence (opt11) from CCHVF(CCHVF 4701-ST-2009)__KR814872.1__Gn-NSm-Gc
agcgaggagccgggcgacgacugcaucucccgcacgcagcuacuuaagaccgagacggccgagauccacgacgacaacuacgggggcccgggggauaagauuaccaucugcaacggaucuacgguggucgaccagcggcucggauccgagcugggcugcuacaccauuaaccgcgucaagagcuucaaacuaugcgagaacuccgccacgggcaagacaugugagaucgacagcacccccgugaagugccggcagggguucugucugaagaucacccaggagggccgggggcacguaaagcuguccaggggaagcgagguggugcucgacgcgugcgacuccagcugcgagaucaugaucccaaaagggacgggcgacauccuggucgacugcuccggcggacagcagcauuucuugaaggacaaccucaucgaccugggcugcccccacaucccacugcucgggaagauggccaucuacaucugccguaugagcaaccacccccggaccaccauggcauuccuguucugguucuccuuuggcuaugugaucacgugcaucuucuguaaggcccucuucuacagccucaucaucaucgguacgcuggguaaaaagaucaagcaguaucgcgagcugaagccccagaccuguaccaucugcgagaccgccccagugaacgcgaucgacgccgagaugcacgacuuaaacugcuccuacaacaucugcccguacugcgccagccgccugacguccgacggccuggcccgccacgucacccagugccccaagcggaaagagaagguggaggagaccgagcucuaccugaaccuggagcgcauccccuggauagugcggaaguuacugcaagucagcgaguccaccgggguggcgcugaagcggagcagcuggcucaucgugcugcugguccucuugacgguuucccucagccccgugcaguccgcgccgguaggccacgggaagacuaucgagaccuaccagacccgggaaggcuucacguccauaugccucuuuauguuaggcuccauccucuucaucguuagcugccucgugaagggccugguagacuccgugagcgacuccuucuuccccggccugagcgugugcaagaccugcuccaucgggucgaucaacgguuucgagaucgagucccauaaguguuacugcagccucuucugcugucccuacugccgccacugcuccgccgaccgggagauccaccagcugcaccuuagcaucugcaagaaacgcaagaccggguccaacgucaugcucgccguuugcaagagaaugugcuucaaggccacaaucgaggcuagccgccgggcccuucugauccgcuccaucaucaacacgaccuucgucaugugcauccuuacccuggccaucugcguggugagcacuagcgccgucgagauggaggaccugcccgccggcacgugggagcgcgaggaggaccucaccaacuuuugccaccaggagugccaggugaccgagaccgagugcuuaugucccuacgaagcguuggugcugagaaagccccucuuccuggacuccaucgucaagggcaugaagaaccugcucaacucuacgucccuggagaccagccuguccaucgaggccccuuggggcgccaucaacgugcaaagcaccuucaagcccaccguguccaccgccaacaucgcccucagcugguccagcgucgaacaccgagggaacaagaucuuagugacggggcgauccgagagcaucaugaaguuagaggagcgcaccggcguguccugggaccucggggucgaggacgcaagcgaguccaagcugcugaccgugagcaucauggaccucucccagauguacucuccgguguucgaguaccuuaguggcgaccggcaggucgaagaguggccaaaggcgacaugcacgggcgacugccccgagcgcugcggaugcaccucuagcacaugucugcacaaggaguggccccacucccggaacuggcgcugcaacccgaccugguguuggggcguagggaccggcugcacgugcugcggcgucgacgucaaggaccuguucaccgaccacauguucaucaaguggaagguggaguacauuaagaccgaagccaucgugugcgucgagcugacuagccaggagcggcagugcucccugaucgaggccggaacccgcuucaaccucggccccgugaccaucacccugagugagccccggaacauacagcagaagcugcccccggagaucaucacgcuccacccuaagauugaggagggguucuucgaucugaugcacgugcagaagguccugucugccagcacugugugcaagcuccaauccugcacccacggcauccccggggaccugcagaucuaccacaucggcaaucugcucaagggggaccgugugaacgggcaccugauccacaagaucgagccgcacuucaacaccagcuggaugucaugggacggcugcgaccuggacuacuacugcaacaugggggacuggcccagcugcacguacaccgggguaacucagcacaaccaugcagcguucgugaaccucuuaaacaucgagaccgacuacacgaagaccuuccacuuccacucgaagcgagugaccgcccacggggacacgccccagcuggaccucaaggcccgccccaccuacggcgcgggcgagaucacagucuuggucgagguggccgacauggagcugcacaccaagaaggucgagaucucugggcugaaguucgccucccuuacgugcacgggcugcuacgccugcagcuccggcaucagcugcaaggugcggauccacguggacgaaccggacgagcugaccguccacgugaaauccagcgaccccgacguggucgccgcgagcacgucccucauggcccgcaagcuggaguuuggcaccgauagcacguucaaagccuucagugccaugccuaaaacaucgcugugcuucuauaucguggagagagaguauugcaaguccugcucagaagacgacaccaagaagugcguggacaccaagcucgagcaaccccagaguauccugaucgaacauaaggguaccaucauaggcaagcaaaacgacacgugcacagccaaggcgagcuguugguuggaauccgucaagaguuucuucuacgggcucaagaacaugcucggguccguguucggcggguucuucgugggcauccuccucuuccucgccccguucguuuuauugguucucuucuucauguucggcuggaagaucuuauucuguuucaagugcugccgccgaaccagaggccucuucaaauaccgccaccugaaagacgacgaggagacaggcuaccggcggaucaucgagcggcugaacucgaagaaggggaagaaccgacuccuggacggcgaacggcuggccgaccgcaagaucgccgaacucuucuccacgaagacccacaucggg

SEQ ID NO: 15442 - RNA, 3495 nt, Artificial Sequence
  derived and/or modified CDS sequence (opt11) from CCHVF(CCHVF 5170-R-2011)__KR814873.1__Gn-NSm-Gc
ucagaggagccuggcgacgacugcauaucgaggacccaacuccucaagaccgaaacugccgagauccacgacgacaacuacggaggacccggcgacaagauaacgaucugcaacggcuccaccaucguggaccaacgccuaggauccgagcugggcugcuacaccaucaaccgugucaagagcuucaaauuaugcgaaaacucagccaccggaaaaacgugugaaauagacuccacacccgucaaaugcagacaaggcuucugccucaagaucacacaggaaggacgcggacauguuaaacuuucccgaggaagcgaaguaguccuugacguaugcgacuccuccugcgaaaucaugauacccaaggggacaggcgacauccucgucgacugcuccggcggccaacaacauuuccucaaagacaaccucauagauuuggguuguccucacaucccccuacucggcaaaauggccauauacauaugcaggauguccaaccacccucgaaccacgauggccuuucuauuuugguuuagcuucggguacgucaucacaugcaucuuuugcaaagcccucuucuacagucucaucaucaucggcacccuaggaaagaaaaucaaacaauaccgagaacucaaaccacaaaccugcacaauaugcgaaaccgcacccgucaacgcaaucgacgccgaaaugcacgaccuuaacugcuccuacaacauaugccccuacugcgcuucccgccuaaccuccgagggcuuggcgagacacguuacccaaugcccaaaacgcaaagaaaaagucgaagaaacggaacucuaccugaaucuggaaagaaucccguggauagugcgcaaacuacugcaggucucagaaagcaccggugucgcccucaaacgauccagcuggcuaaucguauuacuuguccuacuuaccguaucccuaucccccguccagucggcucccgucggccacggcaaaaccaucgaaacuuaccaaacccgagaaggcuucaccagcauaugccucuuuaugcugggcucuauacuguucaucguuucgugccuaguuaaaggccuaguagacuccguauccgacuccuucuuccccggauuaucgguaugcaaaaccugcucgaucggaagcauaaauggcuucgaaaucgaaucacacaaaugcuacugcagccucuuuugcugcccauacugcagacacugcagcgccgacagagaaauccaucaacuacaccuaaguauaugcaagaaacgcaaaaccggcuccaacguuaugcucgccguauguaaaagaaugugcuucaaagcaacaauagaagccagccgccgcgcgcuccuaauccgcuccaucaucaacaccaccuucgucauauguaucuuaacgcuugcuauaugcgucguaucgacaagcgcuguagagauggaagaccuuccagcaggaacuugggaacgcgaagaagaccuuaccaacuucugccaccaagaaugccaggucaccgaaacugaaugccuuugcccauacgaagcccucgugcuacgcaaaccccuuuuucuagacagcaucgucaaaggcaugaagaaucuccucaacuccacaucccuagaaacuucccuuucgauagaagcgccguggggcgccaucaacguccaaucgacguuuaaaccaacaguauccaccgccaacaucgccuuaucauggucauccguagaacaccgaggcaacaaaauucuuguaacaggccgcuccgagucaaucaugaagcucgaggaaagaaccggcguuuccugggaucucggcgucgaagacgcaucggaaucuaagcuacucacgguaagcauaauggaccuaucacagauguacuccccagucuucgaguaccuaucaggagaccgacaagucgaagaauggcccaaagcuacaugcaccggggauugcccagaacgaugcgggugcacuuccucuacaugccuacacaaagaauggccccacucccgcaacuggagaugcaauccuaccugguguuggggcgucggaacaggauguacaugcugcggcgucgacgucaaagaccuguucacggaccacauguucauaaaauggaaaguagaguacaucaaaacugaggcaauaguaugcguagagcucacaagccaggagcgccagugcucacuuauugaggccggcacgcgauucaaucuaggacccgucaccauuacacuuagcgaaccacggaacauucagcaaaaacucccacccgaaaucaucacccuccaccccaaaaucgaggaaggcuucuucgaccucaugcauguccaaaaaguacuaucagcauccaccgugugcaagcugcaaagcugcacacauggaauccccggagaccuccaaauuuaucauaucggcaaucuacucaaaggagaccgaguaaacggucaccucauucacaaaauagaaccacacuuuaacaccagcuggauguccugggacggcugugaccuagacuacuacugcaacaugggagacuggcccucgugcacauacaccggcgucacccaacacaaccacgcugcuuucgucaaucuucucaacaucgagaccgacuacaccaaaacauuccacuuccacuccaaaagggucaccgcacacggcgacacaccccagcucgaccugaaggcacggcccacauacggugccggcgagauaaccguccuaguagagguggccgacauggaacuacacaccaagaaagucgaaaucuccggacuaaaauucgcaucacuaaccugcacuggcugcuacgccugcucaagcggcauuuccugcaaaguccgcauccacguagacgaaccggacgaauuaacaguacacguuaaaagcucagaucccgacguuguugccgcuuccacuucccuuauggcaaggaagcuagaguucggcaccgauagcacauucaaggccuucagcgcaaugccgaaaacaucccuaugcuucuacauuguggaacgcgaauacugcaaaucuugcuccgaggacgacaccaaaaagugcgucgacacaaagcuagaacagccccaauccauccucaucgaacauaaaggaaccauaaucggaaagcaaaaugacacaugcaccgcaaaagcaucaugcuggcucgagagcgucaaauccuucuucuacgggcucaaaaacaugcuagggagcguuuucggaucguucuucguggggauucuacuauuccucgcacccuucguacugcuaguucuauucuucauguucggauggaagauccuauucugcuucaaaugcugucgccguacucgcggacuauucaaauaccgccaucucaaagacgaugaggaaacgggauaucgccguauuaucgaacgacugaacuccaagaaaggcaaaaauagacuacucgacggcgagcgccucgcagaccgcaagauagcagaacucuucucuacgaagacgcacauagga

SEQ ID NO: 15443 - RNA, 3495 nt, Artificial Sequence
  derived and/or modified CDS sequence (opt11) from CCHVF(CCHVF Oman-199809166)__KR864901.1__Gn-NSm-Gc
agcgaggaguccggcgaggacuguaucagccgcacccaacugcuccggaccgagacagccgagauccacggugacaacuacggcgggcccggcgacaagaucaccaucugcaacggguccacuaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacucguccugcgagaucaugauccccaaggggaccggugacauccugguggacugcagcggcgggcagcagcacuuccugaaggacaaccucaucgacuugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggugggcacccuggggaagaaguucaagcaguaccgggagcucaagccccagaccugcaccaucugcgagaccacccccgugaacgccauugacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccagguaucagaguccaccggggucgcgcucaagcggagcagcuggcugaucgugcugcucgugcugcugaccguaucccucagccccgugcaguccgcccccaucggccacgggaagacgaucgagaccuaucagacccgcgagggcuacaccuccaucugccuguucgugcugggcuccauccucuucaucgucagccaccugaugaaggggcugguggacucggugggcaacagcuucuucccggggcucuccaucugcaagacgugcagcaucggcuccauaaacggguucgagaucgagagccacaagugcuacugcucccuguucugcugccccuacugccggcacugcagcgcggacaaggagauacacaaacugcaccucuccaucugcaagaagcgcaaggccggcagcaacgucaugcuggccgugugcaagcggaugugcuuccgugccaccauggaggucuccaacaaggcccugcucauccggagugugaucaacaccaccuucguggucugcauccugauccuggcggugugcguggucuccacgagcgccguggagauggagagccuccccgccggcaccugggagcgcgaggaggaccugaccaacuucugccaccaggagugccaggugaccgagacagagugccugugccccuacgaggcccugguccuccggaagccgcuguuccuggacuccaucgccaaggggaugaagaaccuccugaacagcaccucccuagagacaagccucuccaucgaagcgcccuggggcgccaucaacgugcagagcaccuucaagcccacgguguccaccgccaacaucgcccugagcugguccagcgucgagcaccgcgggaacaagauccugguguccggccgcagcgaguccaucaugaaacuggaggagcggaccgggaucagcugggaccugggcguggaggacgccuccgagagcaagcugcucaccgucuccgugauggaccugagccagauguacagccccguguucgaguaccuguccggcgaccgccaggucgaggaguggccgaaggcgaccugcacgggggacugccccgagcggugcggcugcaccagcuccacgugccuccacaaggaguggccccacagccgcaacuggcggugcaaccccaccuggugcuggggcguggggaccggcugcacgugcugcgggcuagacgugaaggaccuguucaccgacuacauguucgucaaguggaagguggaguacaucaagaccgaggcaaucgugugcgucgagcucaccucccaggagcgccagugcagccugaucgaggccggcacccgguucaaccuggggccggugaccaucacccucuccgagccccgcaacauccagcaaaagcugccgcccgagaucgugacgcugcacccccggaucgaggagggguucuucgaccucaugcacguccagaaggugcugagcgcauccaccgugugcaagcugcagagcugcacccacgggguccccggcgaccuccagguguaccacaucggcaaccugcugaagggggacaaggugaacggccaucucauccacaaggucgagccccacuucaacaccuccuggaugagcugggacgggugcgaccuggacuacuacugcaacaugggcgacuggccguccugcacuuacaccggggugacccagcacaaccacgccgcguucgugaaccugcucaacaucgagaccgacuacacaaagaacuuccacuuccacagcaagcgcgucaccgcccacggcgacacgccccagcuggaccugaaggcccggcccaacuacggcgccggcgagaucaccgugcucguggaggucgcagacauggagcugcacaccaagaagaucgaaaucuccggccugaaguucgccagccugaccugcaccgggugcuacgccugcuccagcggcaucuccugcaaggugcgcauccacguggacgagcccgaugagcugaccguccacgucaagagcgaggacccggacaucguggccgcaagcuccagccugauggcgcggaagcucgaguucgggacggacucaaccuucaaggccuucagcgccaugcccaagaccucccugugcuucuacaucguggagcgcgaguauugcaagagcugcuccaaggaggacacccagaaaugcgugaacgccaagcucgaacggccacagagcaucuuaaucgagcacaagggcacgaucaucggcaagcagaacgacacgugcaccgccaaggcguccugcuggcuggaaagcgugaaguccuucuucuacgggcugaagaacaugcucagcggcaucuucgggaacgucuucaucggcaucuuccuuuuccuggcccccuucauccuccugauccuguucuucauguucggguggcgcauccucuucugcuucaagugcugccggcgcacccggggucuguucaaguaccgccaccugaaggacgacgaggagaccggcuaccgcaagaucaucgagcggcucaacaacaaaaagggaaagaacaagcugcuggacggcgagcgccucgccgaccggaagauugccgagcuguucuccaccaagacccacaucgga

SEQ ID NO: 15444 - RNA, 3495 nt, Artificial Sequence
  derived and/or modified CDS sequence (opt11) from CCHVF(CCHVF 200406546-Turkey)__KR864902.1__Gn-NSm-Gc
agcgaggaacccggagacgacuguaucucccgcacccagcugcuccggaccgagacugcugagauccaugacgacaacuacggggguccgggggacaagaucaccaucugcaacgggagcaccaucguggaccagcgccugggguccgagcugggcugcuacaccaucaacagggucaagagcuucaagcucugcgagaacuccgccacgggcaagacaugugagaucgacagcacccccgugaagugccgccagggguucugccugaagaucacccaggagggcagggggcaugugaagcugucccgcggaagcgaggucgugcucgacguaugcgacuccagcugugaggucaugauccccaaggggacgggcgacauccuaguggacugcagcggcggucagcaacacuuccugaaagacaaccucaucgaucugggcugcccccacgugccgcugcucgggcggauggcgaucuacaucugccgaaugagcaaucacccccggaccaccauggccuuccuauucugguucuccuucggcuaugucaucacgugcaucuucugcaaggcccuguucuacagccucaucaucaucgguacccuggggaaaaaguucaagcaguaccgcgagcugaaaccccagaccugcaccaucugcgagacugcccccgugaacgccaucgacgcggagaugcacgaccucaacugcuccuacaacaucugcccguacugcgccagccggcugacgucagauggucuggcccgccacgugccccagugccccaagcggaaggagaagguagaggagaccgagcucuaccugaaccuggagcgcauccccuggaucguuaggaagcuccuccaggugagcgagucaaccggggucgcgcugaagcgcagcagcuggcucaucgugcugcuggugcugcugaccgucuccuugagcccggugcaguccgcgcccgugggccacgggaagacgaucgagaccuaccagaccagagagggcuucaccagcaucugccucuucaugcugggcuccaucuuguucaucgucagcugccucgugaaggggcugguggacuccgucagcgauuccuucuuccccggccugagcgugugcaagacgugcuccaucggguccaucaacgguuucgagaucgaaucccacaaaugcuacugcaguuuguucugcugccccuacugccgccacugcuccgccgaccgggagauccaccagcugcaccugagcauaugcaagaagcgcaagaccgggaguaacgucaugcuugccgugugcaagcggaugugcuuccgcgccaccauugaggccagccgccgugcgcugcugauccgcuccaucaucaacaccacguucgugaucugcauccuuaccuuaaccaucugcgucgugucgaccagcgccguggagauggaaaaccugccggccggcacgugggagcgagaagaggaccucaccaacuucugccaccaagagugccaggucaccgagaccgagugccugugccccuacgaggcccuggugcugcgcaagccccucuuccuggacuccaucgugaagggcaugaagaaccugcucaacagcacgucccuggagaccagccuguccaucgaggcccccuggggcgcgaucaacguacagaguaccuucaagccgaccguguccaccgccaacaucgcccucucguggucgagcaucgagcaccgggggaacaagauccuggugacggggcgcuccgagagcaucaugaagcuggaggagcggaccggcgucuccugggaccucgggguggaggacgccagcgaguccaagcugcugaccgugaguaucauggaccucucccagauguacagccccgucuucgaguaccugagcggcgaccgccagguggaggaguggcccaaggcgaccugcacgggcgacugccccgagaggugcggaugcaccuccucgacgugccugcacaaggaauggccgcacagucgcaacuggcggugcaaccccaccuggugcuggggcguggggaccggcugcacgugcugcggcgucgacgugaaggaccucuucaccgaccacauguucguuaaauggaaggucgaguacaucaagaccgaggcaaucgugugcguggagcugaccagccaggagcgccagugcucccugaucgaggccgggaccagguucaaccucggucccgucacgaucacccugagcgagccccgcaauauccagcagaagcugccgcccgagaucaucacacuccaccccaagguggaggagggguucuucgacuugaugcacgugcagaagguucugagcgccucaaccgugugcaagcuccaguccugcacccacggcaucccuggggacuuacagguguaccacaucggcaaccugcucaagggcgaccgggucaacgggcaucugauucacaagaucgagccccacuucaacaccagcuggaugaguugggacggcugcgaccuggauuacuacugcaacaugggggacuggccuucaugcacguacaccggcgugacccagcacaaccacgccgccuucguaaaccuccugaacaucgagaccgacuacacgaagaccuuccacuuccauuccaagcgcgucaccgcccacggggacacgccccagcuugaccucaaggcgcguccgacguacggcgccggcgagaucaccguguuaguagaggucgccgacauggagcugcacaccaagaagguggaaaucagcgggcucaaguucgcgucgcuggccugcaccggcugcuacgcguguagcuccgggaucagcugcaaagugcgcauccaugucgacgagcccgacgagcugaccgugcacguaaaguccagcgaccccgacgucguggcagccagcaccucccucacugcgcggaagcuggaguucggcaccgacagcacguucaaggcauucuccgccaugcccaagaccagccugugcuucuacaucgucgagaaggaguacugcaagagcugcaacgaggacgacacacagaagugcgucgacaccaagcucgagcagccgcaaagcauccugaucgagcacaaagggaccaucaucggcaagcagaacgacacgugcaccgccaaggccaguugcuggcuggaguccgugaagaguuucuucuacggccucaaaaacaugcuggggagcguguucggcaacuuuuucaucgguauccugcuguuccuggcgcccuucguccugcuagugcuuuucuucauguucggcuggaagauccuguucugcuucaagugcugccgccgcacccggggccucuucaaguaccgccaccugaaggacgaugaggagacaggguacaagcggaucaucgagcgccugaacaacaagaagggcaagaaccggcuccuggacggggagcgccuugccgaccggaagaucgccgagcuguucuccacuaagacccauaucggc

SEQ ID NO: 15445 - RNA, 3495 nt, Artificial Sequence
  derived and/or modified CDS sequence (opt11) from CCHVF(CCHVF 1-CR/HU-2015)__KU161584.1__Gn-NSm-Gc
uccgaggagcccggcgacgacuguauuucccgcacccagcugcuacggacggagacggccgagauccacgacgacaauuacgggggaccgggggacaagaucacaaucugcaacgguagcaccaucguggaccaacgccugggguccgagcuggggugcuauacuaucaaccggguuaagucguucaagcucugugaaaauuccgccacagggaaaaccugcgagaucgacaguaccccgguaaagugucgccagggguucugccugaagaucacccaggagggccgggggcauguuaagcugucccgcggcuccgaggucgugcuugacgcgugugacuccagcugcgaggugaugauccccaaggggacgggugacauccuggucgacugcuccggcgggcagcagcacuuccucaaggauaauuuaaucgaccugggcuguccccacaucccguugcucggaaaaauggcuauauacaucugccggaugagcaaccacccacguaccaccauggccuuccuguucugguucuccuucggcuacguuaucacgugcaucuuuugcaaggcccuguuuuacagcuuaaucaucaucggcaccuuagggaagaagauuaagcaguaucgggaacucaagccgcagaccugcacaaucugcgagaccgcccccgugaacgcuaucgacgccgagaugcacgaccucaacugcuccuacaacauuugcccauacugcgccagcagacuuacgagugacggccuugcccgucacgucacccagugcccgaagcguaaagagaagguggaggagaccgaguuauaccuaaaccuggaacggauccccuggaucguacgcaagcuccuccaggucagcgaguccacagggguggcgcuuaaacggucaagcuggcucaucguucugcugguccuccuuacgguuucucugucgcccguucaguccgccccggucggccacggaaagacuaucgaaaccuaccagacccgugaaggcuuuacgagcaucugccucuucaugcugggcuccauccuguucauugugagcugucucgugaagggucuggucgacuccgugucagauagcuucuuccccggccugagcgugugccgaaccugcuccaucgggagcaucaacggcuucgagaucgagucacacaaguguuacugcagccuguucuguugccccuacugccgccacugcuccgcggaccgagagauccaccaguugcaccugagcaucugcaaaaagcgcaaaaccgggucaaacgucauguuagccgugugcaagcggaugugcuuucgcgccaccauggaggcgagccgacgggcacugcugauccgguccaucaucaacacgaccuucgucaucugcauccucacccugaccaucugugugguaagcacgagcgccgucgaaauggaaaaccuuccugcaggcaccugggagcgagaggaggaccucaccaacuucugccaccaagagugccaggugaccgagacggagugccugugcccguacgaggccuugguacugcgcaagccccuguuccuggacuccaucgucaagggcaugaagaaccuucucaacagcaccucccuggagaccagccucuccauugaggcgcccuggggcgccaucaacgugcaauccaccuuuaagcccacgguguccacggccaacaucgccuugagcugguccagcgucgagcaccgggggaacaagauccuggugacuggacgcuccgagagcaucaugaagcuggaggagcggaccggagugucaugggaccucggggucgaggacgccagcgaguccaagcuacugaccgugagcaucauggaccugucccaaauguacagcccgguguucgaguaccuguccggcgaccgccaggucgaggaauggcccaaggcaacgugcaccggcgacugccccgagaggugugggugcaccuccaguacgugccugcacaaggaguggccacauagcaggaacuggaggugcaauccgaccugguguuggggagugggcaccggcugcacaugcugcggcguggacguuaaggaccucuucaccgaccacauguucgugaaguggaagguggaguauaucaaaaccgaagccaucguuugcguggaacugacaagccaggagcgccagugcucucugaucgaagccgggacccgguucaaccucggccccgugaccaucacgcugucugagccccggaacauucagcagaagcuacccccggaaauaauaacccugcaccccaaaaucgaggagggguucuucgaccugaugcauguccagaaggugcuguccgcgaguaccgugugcaaacuucaguccugcacccacggcauccccggcgaccugcaggucuaccacaucgggaaccugcucaagggggaccgggugaacgggcaucugauccauaagaucgagccacauuucaacacgagcuggauguccugggauggcugcgaccuggacuacuacugcaauaugggggacuggcccagcugcaccuacaccggcguuacccagcacaaccacgccgccuucgucaacuuacugaacaucgagacggauuacaccaagacguuccacuuccauuccaagcgcgugacagcccacggagacacgccccagcuggaccucaaggcccggccaaccuacggcgccggcgaaaucaccgugcugguggagguagcggacauggagcuacacaccaagaaggucgagauuagcgggcucaaguuugccucccuggccugcacuggcugcuaugccugcuccuccgggauuagcuguaagguccggauucacguugaugagccugacgagcugaccgugcacgucaaguccagcgaccccgaugugguggccgcaagcaccucccuuauggcucggaagcuggaguucggcaccgacagcacguucaaggccuucuccgccaugcccaagacgagucugugcuucuacaucgucgagcgcgaguacugcaaguccugcagcgaggaugacacuaagaagugcguggacaccaagcucgagcagccccaguccauccugauagagcauaaggggaccauuaucggcaagcagaacgauaccugcaccgccaaggcauccuguuggcuggaguccgucaagucguucuucuacggccucaaaaacaugcugggguccguguucggcaacuuuuucaucgggauacuccucuuccuggccccguucguguuguuggugcuguuuuucauguucggauggaaaauccuguucugcuucaaauguugccggagaacccgcggccucuucaaguaccggcaccugaaggacgacgaggagaccggguaucgccggaucauugagcgcuuaaacaacaagaagggcaagaaccggcuccuggacggcgaaaggcuggccgacagaaagaucgccgagcuguucucuacuaagacacacaucggc

SEQ ID NO: 15446 - RNA, 3495 nt, Artificial Sequence
  derived and/or modified CDS sequence (opt11) from CCHVF(CCHVF 1231-CR/TI-2015)__KU161585.1__Gn-NSm-Gc
agcgaggagcccggcgacgacugcaucucccgcacccagcugcucagaacagagacggccgagauccacgacgacaauuaugggggcccgggggacaagaucaccaucugcaacgguucgacgaucgucgaccagcgccuuggguccgaacugggcugcuacaccaucaaccgggucaaguccuucaagcucugugagaacuccgccacgggcaagaccugcgagauagacagcacccccgugaagugccgccagggguucugccugaagaucacccaggaaggucgggggcaugucaagcugucucgcggcuccgaggucgugcucgacgcgugcgacucaagcugcgaggugaugauccccaaggggacgggcgauauccuggucgacugcagcggcggccagcaacacuuccugaaggacaaccucaucgaccuuggcugcccccacaucccgcugcucgggaaaauggccaucuacauaugccggaugagcaaccacccccgcacgaccauggcguuccuguucugguucaguuucggcuacgugaucacguguaucuucugcaaggcccuguucuauagccucaucaucaucggcacccuggggaagaagaucaagcaguaccgggagcugaagccucagaccugcaccaucugcgagacggcccccgugaacgccaucgacgccgagaugcacgaccugaacugcuccuacaacaucuguccguacugcgccagcagacugacguccgacggccuggcccggcacgucacccagugcccaaagcgcaaggaaaaaguggaggagaccgagcucuaccugaaccucgagcggauccccuggaucgugcgcaaacuccuacaggucagugagucgaccggcguggcgcugaagcgaucuaguuggcucaucgugcugcuaguccuccuaacugucagucugucucccguacaguccgccccugucggccacgggaagacuaucgagacguaccagacccgcgagggcuuuacaagcaucugccucuucaugcugggcuccauccuguucaucgugagcugucucgugaaagggcuggucgagucggugagcgacucguucuuccccggccugagcgugugccggaccugcuccaucgggagcaucaacggcuucgagaucgagucccacaagugcuacugcagccucuucugcugccccuacugccgacacugcucugccgaccgggagauccaccagcugcaccugagcaucugcaagaagcgcaagacgggaucuaacgucaugcucgccgugugcaagcggaugugcuuccgcgcaaccauggaagcgagccgccgggcccugcuaauccgcuccaucaucaauacgaccuucgucaucugcauccugacccugaccaucugcgucgugucuacguccgccgucgagauggagaaccugcccgccggaacaugggagagagaggaggaccucaccaauuucugccaccaggagugccaggugaccgaaacggagugccuaugcccuuacgaagcccuugugcugaggaagccccucuuccuggauuccaucgucaagggcaugaagaaccugcuuaacagcaccucccuggagaccagccuauccaucgaggcccccuggggugccaucaacguucagagcaccuucaagcccaccgugucuacagccaacaucgcccucagcuggaguagugucgagcaccgggguaauaagaucuuggugaccgggcgcuccgagagcaucaugaagcuggaggaaagaaccggcguguccugggaccucgggguggaggacgccagcgaaaguaagcugcugaccgugagcaucauggaccucucgcaaauguacagcccgguauucgaguauuugagcggcgaccgucaggucgaggaguggcccaaggcgacgugcaccggcgacugccccgagcggugcgggugcaccaguagcacgugccugcacaaggaguggccccacuccagaaacuggcggugcaacccgacuuggugcuggggcguggggaccggcugcacgugcugcggcguugacgucaaggaccucuucaccgaccauauguucgugaaguggaagguugaguacaucaagaccgaggccaucgucugcguggagcugaccagccaggagcgccagugcucccugauugaggccgggacgcgguucaaccucggccccgugaccaucacgcugagcgagccccgcaacauacagcagaaguuacccccggaaaucaucacccuccaccccaagaucgaggagggguucuucgacuugaugcacguacagaaagugcucuccgccagcaccgugugcaagcuccaguccugcacccacggcauccccggggaccugcagguuuaccacauaggcaaccugcucaagggcgaccgggugaacgggcaccugauccacaagaucgagccacacuucaacacgagcuggauguccugggacggcugcgaccuggacuacuacuguaacaugggggacuggcccucaugcaccuacaccggcgugacccagcacaaccacgccgcguucgucaacuugcugaacaucgagaccgacuacaccaagaccuuccacuuccacucaaagcgcgucaccgcccauggggacacgccccaguuagaccucaaggcccggcccaccuacggcgccggcgagaucacaguguuagucgaaguagccgacauggagcugcacaccaagaagguggagaucagcggccucaaguucgcgucccuugccugcacgggcugcuacgccugcagcagugggaucucaugcaaaguccgcauccacguggacgaaccggacgagcugaccgugcacgucaaguccagcgacccagacgugguggccgcgagcaccucccucauggccaggaaguuggaguucggcaccgacagcaccuucaaggcauuuuccgccaugcccaagaccagccugugcuucuacaucguagaacgcgaguacugcaaguccugcagcgaggacgauaccaagaaguguguggacaccaaacucgagcagccccaguccauccugaucgagcauaagggaacgauuaucggcaaacagaacgacacuugcaccgccaaggcgagcugcugguuagaauccgucaagagcuuuuucuacggccucaagaacaugcugggguccguuuucggcaacuucuucaucgggauccuccuauuucuggccccguucgugcugcucguucuguucuucauguucgguuggaagauucuguucugcuucaagugcugccgccggaccagaggccucuucaaguaccggcaccugaaggacgacgaggaaaccggguaccgccggaucauagaacgccugaacaauaagaaggggaagaaccggcuccuggacggggagcgccuugccgaccggaagaucgccgaacuguuuagcacgaagacccauauuggc

SEQ ID NO: 15447 - RNA, 3495 nt, Artificial Sequence; identical to SEQ ID NO: 12161
  derived and/or modified CDS sequence (opt11) from CCHVF(CCHVF Gaib)__KX013445.1__Gn-NSm-Gc

SEQ ID NO: 15448 - RNA, 3495 nt, Artificial Sequence
  derived and/or modified CDS sequence (opt11) from CCHVF(CCHVF Hodzha)__KX013448.1__Gn-NSm-Gc
agcgaggaguccggcgacgacuguaucagccgcacccagcugcuccggaccgagacggccgagauccacggggaugacuauggcgggcccggcgacaagaucacgaucugcaacggguccaccaucguggaccaacgccugggaagcgagcugggcugcuacaccaucaaccgggucaagagcuucaagcucugcgagaacuccgccacggggaaguccugcgagaucgacagcacuccggugaagugccgccagggauacugccugaagaucacccaggaggggcggggccaugugaagcugucccgcgggagcgaggucgugcucgacgcgugcgacuccagcugcgaggugaugauccccaagggcaccggcgacauccuggucgacugcuccgggggccagcagcacuuccugaaagacaaccucaucgaccuggggugcccccggaucccccugcuaggcaagauggccaucuacaucugccgcaugagcaaccacccggagacaaccauggccuuccuguucugguucuccuucggcuaugugaucacaugcaucuuaugcaaggccaucuucuaccuccugaucaucguggggacccugggcaagcgguucaagcaguacagggaacucaagccgcagaccugcacgaucugcgagaccacccccgccaacgcgaucgacgccgagaugcacgaccucaauugcagcuacaacaucugccccuacugcgccuccagacugacgagcgacgggcucgcucgccacguaacccaguguccgaagcggaaggagaaggucgaggagaccgagcuguaccugaaccucgagcgcauccccuggaucgugcggaagcugcugcaggucuccgagagcaccggcguugcgcucaagcgcagcuccuggcugaucgugcugcucguccuguucgccgugagccugucccccgugcagagcgcucccauuggucauggcaagacgaucgaaaccuaccaggcccgggaggaguacaccuccauuugccucuucgugcugggcagcauacuguucaucguguccugccucaugaaggggcugguggacagcaucgggaacauauucuucccggggcuaaccaucugcaagacgugcuccauaggcagcaucaacgguuucgaaaucgagucccacaagugcuacugcagcuuacugugcugccccuacugccgccacugccccgccgaccgggaaauccaucagcugcaucucuccaucugcaagaagcgcaagaccggcagcaacgucaugcuggcggugugcaagcggaugugcuuccgcgccacgauggagguguccaacaaggcgcuucucauccgcagcaucaucaacaccacuuucgucgugugcauccugauccuggccgucugugugguguccacuagcgccgucgagauggaaucccuccccgcgggcaccugggagcgugaggaggaccuaaccaacuucugccaccaggagugccagguaacggagaccgagugccucugcccguacgaggcccuggugcuccgccgaccccuguuccuggacagcaucgucaaggggaagaagaaccuccugaacagcaccucccuggaaaccucgcucuccaucgaggcccccuggggcgccaucaacgugcagagcacguacaagcccaccguguccaccgccaacaucgcgcugucguggaguagcgucgagcaccgcgguaacaagauccugguguccggacggucggaguccaucaugaaacucgaggagcgcaccgggauaagcugggaccugggcguggaggaugcauccgagaguaagcugcucaccgugucggucauggaccugagccagauguacuccccgguguucgaguaccugagcggcgaccggcaggucgaagaguggcccaaggccacgugcacuggggauugcagcgagcgcugcggcugcaccuccagcacgugccuccacaaggaguggccccacucccggaacuggcgcugcaaccccaccuggugcuggggcguagggaccggcugcacgugcugcgggcuggacgugaaggaccuuuucaccgacuacauguucgucaaguggaagguugacuacaucaagaccgaggccaucgugugcgucgagcucaccagucaggagcggcagugcucauugguggaggccggcacccgguucaaccuggggccgguaacgaucacgcucagcgagccgcggaacauccagcagaagcugccgccggagaucaucacccugcacccccgcaucgaagaaggcuucuucgacuuaaugcacguccagaagguuuuaagugcuagcaccgugugcaagcugcaguccugcacccacgggguccccggcgaccuccaggucuaccacaucggcaaccugcugaagggggacaaggugaacggccaccucauccacaagaucgagccccacuucaacacaagcuggauguccugggacgggugcgacuuagacuacuacugcaacaugggcgacuggccguccugcaccuacaccggggucacccagcacaaccacgccuccuucgugaaccugcucaacaucgagacggacuacaccaagucguuccacuuucacuccaagcgggugaccgcacauggcgacacgccccagcuggaccugaaggcccgccccaccuacggcgcgggggagaucacaguccucguggagguggccgacauggaacugcauaccaagaagaucgagauuaccggccugaaguucgccagccucacgugcaccgggugcuacgccugcuccagcggcaucuccugcaaggucagaauccacguugacgagccagaugagcugaccgugcacgucaagagcgacgacccggauguggucgccgcgagcuccagccugauggcgaggaaguuagaguucgggaccgacucaacguucaaggccuucuccgccaugcccaagaccucucugugcuucuacaucguagagcgggaguacugcaagagcugcuccaaggaggacacccagaagugcgugaacaccaagcuggaacaaccccagagcauccucaucgagcagaagggcacgaucaucggcaagcagaacaacacgugcaccgccaaggcguccugcuggcuggagagcgugaaguccuucuucuacggccugaagaacaugcucagcggcaucuuuggaaacguguuuguggggaucuuccuguuccuggcccccuucauccuccugauccuguucuucauguucggauggcgcauccucuucugcuucaagugcugucgccggacccgcggccuuuucaaguacaagcaccugaaggacgacgaggagaccgguuaccggcgcaucaucgagcggcucaacaacaagaaggggaagaauaagcugcuggacggcgagcgucuggccgaccggcgcaucgccgagcuguucuccaccaagacucacaucggg

SEQ ID NO: 15449 - RNA, 3495 nt, Artificial Sequence
  derived and/or modified CDS sequence (opt11) from CCHVF(CCHVF IbAn7620)__KX013451.1__Gn-NSm-Gc
agcgaggagcccuccgacgacugcauaagccgcacccaacugcuccggaccgagacggccgagauccacggcgacaacuacgggggcccuggggacaagaucaccaucugcaacggcuccaccaucgucgaccagcgccuggggagcgagcugggcugcuacacgaucaaccgggucaaauccuuuaagcucugcgagaacagcgccacgggcaagaacugugagaucgacucugugcccgugaagugucgccagggcuacugccugcggaucacccaggagggccgagggcacgucaagcugucgcggggcuccgagaucgugcucgacgcgugcgacaccucaugcgagaucaugauccccaaggguaccggcgauauccugguggacugcuccggcgggcagcaacacuuccugaaggacaaccucaucgaccuggguugccccaagaucccgcugcucggcaagauggccaucuacaucugccgcaugagcaaccaccccaagacgaccauggccuuccuguucugguucuccuucggcuacgucaucaccuguauccugugcaaggccaucuucuaccuccugaucaucaucggcacccuggggaagcggcuaaagcaguacagggagcugaagccccagaccugcaccauaugcgaaaccacccccgugaaugccaucgacgcggaaaugcaugacuugaacugcagcuacaacauaugcccguacugugccucacggcucacgagcgacggccuggcccgacacgugauccagugucccaagcgaaaggagaagguugaggagaccgagcuguaccucaaccuggagcgcauccccugggucgugcggaagcugcuccagguuucagagagcaccgggguggcucugaagcgcuccucauggcugaucgugcuccugguccuguucacagugagcuugucccccgugcagagcgcgcccaucggccaggggaagacgaccgaggcuuaccgggcccgcgagggcuacaccuccaucugccuguucguccugggcagcauccucuuuaucguguccugccugaugaaggggcugguggacagcgucggcaacuccuucuuccccgggcucagcaucugcaaaaccugcuccaucagcuccaucaacggcuucgagaucgaaagccacaagugcuacugcucccuguucugcugcccguacugccggcacugcagcacggacaaggagauccacaagcuacaccucuccaucugcaagaagcgcaaaaccgggagcaacguaaugcuggccgugugcaagcggaugugcuuccgcgcgacgauggaggucucgaaccgcgcacuguucauacggagcaucaucaacaccacguucgugcucuguauccugauccuggccgucugcgugguguccaccagcgccgucgagauggagaaccucccggccggcaccugggagcgcgaggaagaccugaccaacuucugccaccaggagugccaggugacggagaccgagugccugugcccguacgaggcccuggugcuccggaagccacuauuccuggacucaaucgcgaagggcaugaagaacccccucaacaguaccagccuggagaccucccugagcaucgaagcccccuggggcgccaucgacguccaguccacguacaagccgaccgucagcacggccaauaucgcccucaguuggucguccguggagcaccgcgggaacaagauccugguuagcgggcgguccgagagcaucaugaagcuagaggagcgcaccggcaucuccugggaucucgggguggaggacgcgagcgaguccaagcugcugaccgugagcgucauggaccugucccaaauguacagccccguauucgaguaccugagcggcgaccgacagguggaggaguggcccaaggccacgugcaccggcgacugccccgagcggugcgggugcaccuccucuacgugccugcacaaggaguggccgcacuccagaaacuggcgcugcaaucccacuuggugcuggggcgucgggaccgggugcacgugcugugggcucgacgugaaggaccuguuuaccgacuauauguucgugaaguggaaggucgaguacaucaagaccgaggccaucgugugcguagagcugaccagccaggagcggcagugcucccucaucgaggccgggacccgcuucaaccugggccccgucaccaucacgcugagcgagccccggaacauccagcagaagcucccgcccgagaucaucacccugcacccccgcaucgaggagggguucuucgaccugaugcacguucagaaagugcucuccgccucaaccgugugcaagcugcaguccugcacccacggcgugccgggggaccuccagguguaccacaucggcaaucuccucaagggcgacaaggucaacgggcaucugauccacaagaucgagccccacuucaacacgagcuggauguccugggacggcugcgaucuugacuacuacugcaacaugggggacuggcccagcugcaccuacaccggcgugacucagcacaaccacgcguccuucgugaaccugcugaacaucgagacagacuacacuaagaacuuccacuuccacagcaagcgggucaccgcccacggggacacaccccagcucgaccugaaggcccguccuaccuacggcgccggcgagaucaccguguuaguagagguagcgaacauggagcuccacacaaagaagaucgagaucuccgggcugaaguucgccagccugaccugcacgggcugcuacgcaugcuccagcgggaucuccugcaaggugagaauccacguggacgagcccgacgagcucacgguccacgucaagagcgacgaccccgacguaguggcugccuccuccagccugauggcgcgcaagcuggaguucggcaccgauaguaccuucaaggccuucagcgccaugcccaagacgucccucuguuucuacaucguggagcgggagcacugcaagagcugcuccgaggaggacaccaagaagugcgugaacaccaagcuggagcagccgcagagcauccugaucgagcacaaggggaccauuaucggcaagcagaacuccacgugcaccgcuaaagccagcugcuggcucgaguccgucaagagcuucuucuacggccugaagaacaugcuguccgguauuuucggcaacguguuuauggggaucuuccucuuccuggcgcccuucauccugcucaucuuauucuuuauguucggcuggcgcauucuguucugcuucaagugcugccgucggacccgcggccucuucaaguaccggcacuugaaagacgacgaagagaccggguaccgccggaucaucgagcgccugaacaacaagaagggcaagaacaagcuccuggacggggagagacuagccgaccgacggaucgccgaguuauucagcaccaagacgcacauuggc

SEQ ID NO: 15450 - RNA, 3495 nt, Artificial Sequence; identical to SEQ ID NO: 12164
  derived and/or modified CDS sequence (opt11) from CCHVF(CCHVF K128_76)__KX013454.1__Gn-NSm-Gc

SEQ ID NO: 15451 - RNA, 3495 nt, Artificial Sequence
  derived and/or modified CDS sequence (opt11) from CCHVF(CCHVF K168_40)__KX013457.1__Gn-NSm-Gc
agcgacgaguccggcgacgacugcaucagucgcacccagcugcuccggacagagacggccgaaauccacggggacaacuauggcgggccgggcgacaaaaucaccauaugcaauggguccacaauuguggaccagcgccugggaucugagcucgggugcuacaccaucaaucgggucaagucauucaaacucugcgagaauagcgcuacggggaaauccugcgagguggacagcauaccggucaagugccgucagggcuacugcuugaagaucacccaggaggggcggggccacgucaagcucucccgcgggagcgagguggugcuugacgcgugcgacuccagcugcgaggucaugauccccaaggguaccggcgacauccugguggacugcuccgggggccagcagcacuuccugaaggacaaccucaucgaccuggggugccccaagauuccccugcucggcaagauggccaucuacaucugccggaugagcaaccacccgaagacuacuauggccuuucuguucugguucuccuucggcuacgucaucacgugcaucgucugcaaggccaucuucuaccugcugaucaucguggggacccugggcaagcgcuuuaaacaguaccgggaauuaaagccccagaccugcacuauuugcgagaccacccccaccaacgcuaucgacgcggagaugcacgaucucaacugcagcuauaacaucugccccuacugcgccucccgcuugacgucggacgggcuggcccggcacgugacccacugcccgaaacgcaaggagaaggucgaggagaccgagcucuaccugaaccucgagcggauacccugggugguacgcaagcuacugcaggucagcgagucgaccggcguggcccugaaacgaaguuccuggcucaucgugcugcugguucucuucgcggugagccuguccccugugcagagcgcccccaucgggcacggaaaaacaaucgagaccuaccaggucagggaggaguacaccuccaucugccuguucgugcucggcagcauccuguucaucguguccugucucaugaaggggcucgucaacagcgugggcaacaucuucuuuccggggcuguccaucuguaaaaccugcagcaucggcuccauuaacggcuucgagaucgagagccacaagugcuacugcucacugcucugcugcccuuacugucggcacugcagcgccgaucgcgagauccaccagcugcaccugagcauuugcaagaagcggaagacggguagcaacgucaugcuggccgugugcaagcgcaugugcuuccgggccaccguagaagucuccaacaaggcgcugagcauccgcuccaucaucaacaccaccuucguggugugcauccugauccucgccguuugcguagugagcacgagcgcagucgagauggaaucccuccccgcaggcaccugggagcgcgaggaggaccugaccaacuucugccaccaggagugccaggugaccgagacggagugccucugccccuacgaggcucuggugcugcggcgcccauuguuccucgaugggauagucaagggcaugaagaaccugcucaacagcacuucccucgagaccagccuguccaucgaagcgccauggggcgccaucaacgugcagagcaccuacaagcccacgguguccgccgccaacaucgcccuuagcuggucuuccgucgagcaccgggggaacaagauccucguguccgggcgcagcgaguccaucaugaagcuggaggagcggaccgggaucagcugggaccugggcguagaagacgcgucggagagcaagcugcucaccgucuccgugauggaccugucacagauguacagccccguguucgaguaccucuccggggaccgccaagucgaggaguggccgaaggcgaccugcacuggugacugccccgaacggugcgggugcacgaguucuaccugccugcacaaggaguggccgcacagccgcaauuggcggugcaaccccaccugguguuggggcgugggcaccgggugcacuugcugcggccuggacgugaaggaccucuucaccgacuacauguucgucaaguggaaagucgaguauaucaaaaccgaggccauagugugugucgagcugaccucucaagagcgccagugcagccugaucgaagccggaacgcgguucaaccucgggcccguuacaaucacccugucagagccccgcaacauccagcagaagcugccgcccgagaucaucacccuccacccccggaucgaggaggguuucuucgaccuuaugcacgugcagaagguccugagcgccuccacggugugcaagcuccagagcugcacccacggcgugcccggcgaucugcaggucuaccacaucgggaaucugcucaagggcgauaaagugaacgggcaccugauccacaaaaucgagccccacuucaacacuuccuggaugagcugggacggcugcgaccuggacuacuacugcaacaugggggacuggcccuccugcacuuacacgggagugacccagcacaaucacgcgaguuucaucaaccuccugaacaucgagaccgacuacacuaaauccuuccacuuccacagcaagcgcgucacggcccacggcgacacgccccagcuggaucucaaggcccggcccaacuacggggccggcgagauuaccguucugguggaggucgcggacauggagcuccacaccaagaagaucgagaucagcggccucaaguucgccagccugaccugcacgggcugcuacgccugcaguagcgggaucagcugcaaggugcguauccacguugacgaacccgacgagcugaccguccaugugaaguccgacgacccugacguggucgccgccagcuccucgcuuauggcgcgcaagcuggaguuuggcaccgacuccacguucaaggccuucagcgcgaugcccaaaaccucccugugcuucuacaucguggagcgcgaguauuguaagagcugcuccaaggaggacacucagaagugcgugaacaccaagcucgaacacccccagaguauucugaucgagcauaagggcacgaucaucgggaagcagaacaauaccuguaccgccaagacaucgugcuggcuggagucugugaaauccuuuuucuacggccucaagaacaugcugagugggaucuucggcaacguauucguggggaucuuccuguuccucgcccccuucauccugcugauccuauucuucauguucggauggagaauccuguucuguuucaaguguugccgccgcacgaggggccuguuccgcuacaagcaccucgaggacgacgaggagaccggguaccggcguaucaucgagcggcugaauaacaagaagggcaagaacaagcuacucgacggcgagcgccuggcggaccggcgcaucgccgagcuguucuccaccaagacacacauaggc

SEQ ID NO: 15452 - RNA, 3495 nt, Artificial Sequence
  derived and/or modified CDS sequence (opt11) from CCHVF(CCHVF K168_125)__KX013460.1__Gn-NSm-Gc
agcgacgaguccggcgacgacugcauuagccgcacccagcugcuccggaccgagacggcagagauacauggggacaauuacggcgggcccggugacaagaucaccaucugcaacggguccaccauaguggaucagcgccugggcuccgagcugggcugcuacaccaucaaccgggucaaguccuucaaguugugcgagaacagcgcuacggggaaguccugcgagguggacagcaucccggugaagugccgccaggguuacugcuugaagaucacccaggaggggcggggccacgugaagcugucccgcgggagcgagguggugcucgacgcgugcgacuccagcugcgaggucaugauccccaagggcaccggcgacauccugguggacugcuccgggggccagcagcacuuucugaaggacaaccuaaucgaucuagggugccccaaggugccccugcucggcaaaauggcuaucuacaucugccggaugagcaaccacccgaagaccacgauggcauuccuguucugguucuccuucggcuacgucauuaccugcaucgugugcaaggccaucuucuaccugcucaucaucguggggacccugggcaagcgcuucaagcaguaccgugagcuaaagccccagaccugcacaaucugcgagaccacccccaccaacgccaucgacgcggagaugcacgacuugaacugcagcuacaacaucugccccuacugcgccucccgccugacgagugacgggcuggcccggcacgucacgcacugcccgaagcgcaaggagaagguggaggagaccgagcucuaccugaaccuggagcggauccccugggugguccgcaaacuccuccagguguccgagagcaccggcgucgcccugaagcggagcuccuggcucaucguccugcuggugcuguucgcuguaagccugucccccguccaaagcgcccccaucgggcacggcaagacaaucgaaaccuaccaggugcgcgaggaguauaccuccaucugccuguucguucucggcagcauccuauucaucguguccugccuuaugaaggggcucgugaacagcgucggcaacaucuucuucccggggcuguccauaugcaagaccugcucuaucggcuccaucaacgguuucgagaucgaaagccacaagugcuacuguucccugcucugcugcccguacugccggcacugcagcgccgaccgggagauccaccagcugcaccuauccaucugcaagaagcggaagacgggcagcaacgugaugcucgccgugugcaagcgcaugugcuuccgggccaccgucgagguguccaacaaggcgcugagcauccgcuccaucaucaauaccaccuucguggucugcauccugauccucgccgugugcguggucagcacguccgccguggagauggaaucccugcccgccggcaccugggagcgcgaggaggaucugaccaacuucugccaccaggagugucagguaaccgagacggagugccucugcccguacgaggcccucgugcugcgacgcccgcuguuccucgacuccaucgugaagggcaagaagaaccugcugaacuccaccucacucgagaccuccuugucaaucgaggcgcccuggggcgcgaucaacgugcaguccaccuacaagcccacggucagcgcagccaacaucgcccuguccuggagcuccgucgagcacagggggaacaaaauccucgugagcgggcgcuccgagaguaucaugaagcuggaggagcggaccgggaucagcugggaccuaggcgucgaggaugcgagcgaguccaagcuccugaccgugagcgugauggaccugagccagauguacucccccgucuucgaguaccucagcggcgaccgccagguggaggaauggccgaaggcgaccugcaccggggacugccccgagcggugcgguugcacguccagcaccugucugcacaaggaguggccccacucccgcaacuggagaugcaaccccaccuggugcuggggugugggcaccggcugcacgugcugcgggcuggacgucaaggaccuguucaccgacuacauguucgugaaguggaaaguggaguacaucaagaccgaagccaucgucugcgucgagcugaccagccaggagcgccagugcucccugaucgaggccggcacgcgcuucaaccucgggccggugaccaucacccugucggagccccgcaacauccagcagaagcugccgcccgagauuaucacgcuccaccccagaaucgaggagggcuucuucgaccugaugcacguccagaaggugcuguccgccagcacggugugcaagcuccaguccugcacccacgggguccccggggacuuacagguguaccauaucgguaaccugcucaagggggacaaggugaacggccaccugauccacaagaucgaaccccacuucaacaccagcuggauguccugggaugggugcgacuuagauuacuacugcaacaugggcgacuggccgagcugcaccuacacggggguuacccagcauaaccacgccuccuucaucaaccucuugaacaucgagaccgacuacaccaagagcuuccacuuccacucaaagcgcgugacugcacacggcgacacgccccaguuagaccucaaggcccggcccaacuacggcgccggggagaucaccgugcuggucgagguggcagacauggagcugcacaccaagaagauagagaucagcggccucaaguucgccucgcugaccugcacuggcugcuacgcuugcagcagcggcaucuccugcaaggugcgcauacacgucgacgagcccgacgagcugaccgugcacgucaagagcgacgacccggacgugguggcggccuccagcucccucauggcgcggaaacuggaguucgggaccgacagcacguucaaggccuucuccgcuaugcccaagaccagucugugcuucuacaucguggagcgcgaguacuguaaauccugcagcaaggaggacacucagaagugugucaacaccaagcucgagcacccgcaguccauccugaucgagcacaagggcacgauaaucggcaagcagaacaacaccuguaccgccaagaccagcuguuggcuggaauccgucaagagcuucuucuacgggcucaagaacaugcuguccggcaucuucgguaacguguucgugggaauuuucuuguuccuggcccccuucauccugcugauccucuucuucauguucggguggcggauccuguucuguuucaagugcugccgccgcacucgggggcuguuccgcuacaaacaccucgaggacgacgaggagaccggcuaucggcgcaucaucgagcgccugaacaacaagaaggggaaaaacaaguuacucgacggcgaacgccuggcggaccggagaaucgccgagcuguucagcaccaagacccacaucggg

SEQ ID NO: 15453 - RNA, 3495 nt, Artificial Sequence
  derived and/or modified CDS sequence (opt11) from CCHVF(CCHVF K229_194)__KX013463.1__Gn-NSm-Gc
agcgaggagccaggcgacgacugcaucucccgcacccagcugcucaagaccgagacggccgagauccacgacgacaacuacgggggcccgggggacaagaucaccaucugcaacggcagcacgaucguggaccagcggcugggguccgagcuaggcugcuacaccaucaaucgcgucaagagcuucaagcucugcgagaacuccgccacgggcaagaccugcgagaucgauagcacccccgugaagugccggcagggguucugccugaagaucacccaggagggccgcgggcacgugaaacucucccggggcagcgaggucgugcucgacgcgugugacuccagcugcgagaucaugauccccaaggggacgggcgacauccugguggauugcuccggcgggcagcagcacuuccugaagggcaaccucaucgaccuggggugcccccacaucccgcugcucggcaagauggcgaucuacaucugccgcaugagcaaccacccccggaccaccauggcauuucuguucugguucuccuucggcuacgucaucacgugcaucuucugcaaggcccuguucuauagccucaucauaaucgggacccugggcaagaagaucaaacaguaccgcgagcugaaaccgcaaaccugcaccaucugcgagaccgcgcccgugaacgcgauagacgcugagaugcacgacuuaaacugcuccuacaacaucugcccguacugcgccagccggcugacguccgauggacuggcccgccacgugacccagugccccaagcgcaaggagaaggucgaggagaccgaacucuaucugaaccuggagcgcaucccuuggaucgugcggaagcuccuccaggugagcgaaagcaccggugucgcgcugaagcgcagcagcuggcugaucguccuguuaguguuauuaacggucucccugagccccgugcaguccgcaccgguggggcacggcaagaccaucgagacauaccagacacgggagggcuucacgaacaucugccucuucaugcuggggagcauccuguucaucgucuccugccucguaaagggccugguggacagcgucuccgacagcuuuuuccccgggcuauccgugugcaaaacuugcagcaucgggagcaucaacggguuugagaucgagagccacaagugcuauugcuccuuauucugcugcccuuacugccgccacugcagcgcagaccgggagauucaccagcugcaccuggguaucugcaagaagcgcaagaccggauccaacgugaugcucgccguuugcaagcggauguguuuuaaagccaccaucgaggcgagccgccgggcccugcugauccgcuccaucaucaacacgacauucgugaucugcauccucacacuggccaucugcgucgugagcacauccgccguggagauggagaaucugcccgccgggacgugggagcgcgaggaggaccucaccagcuucugccaccaggagugccagguaaccgagacggagugcuuaugcccguacgaggcgcuggugcugcgaaaaccccuuuuccuggacagcaucgugaagggcaagaagaaccugcucaauuccacaagccuggagaccucccugagcaucgaggcccccuggggcgccaucaacguccaaucgaccuucaagccgaccgugagcaccgccaacauugcccucuccuggagcuccguggagcaccgcgggaacaagauccuaguuacggggcggagcgaguccaucaugaagcuggaggagcggaccggcgugagcugggaccucggcguggaggacgccuccgagagcaaacugcugaccgucuccaucauggaccucucgcaaauguacuccccgguguucgaguaccucagcggggaccgccagguggaggaguggcccaaggcgaccugcacgggcgacugccccgagcggugcgggugcaccucuuccacaugccugcacaaggaguggccccauagccggaacuggcgcugcaacccgacauggugcuggggcgucgggaccgggugcacgugcugcggcguggaugugaaggaccucuucaccgaccacauguuuaucaaguggaaggucgaguacaucaagaccgaggccaucgugugcguggagcuuacgucccaagagcggcagugcagccugaucgaggccgggacccgcuucaaccucggccccgucaccaucacucuguccgagccccgcaacauucagcagaagcugccaccggagaucaucacucugcaccccaagaucgaggagggguucuucgaccugaugcacgugcagaagguacugagcgccuccaccgucugcaagcuccagagcugcacccacgguauccccggcgacuugcagaucuaccacaucgggaacuuacucaagggcgaccgccugaacgggcaccugauacauaaaaucgagccgcacuucaacaccuccuggaugagcugggacggcugcgaccucgacuacuacugcaacaugggggacuggcccuccugcacuuacaccggcgugacccagcacaaccacgccgccuucgugaaccugcugaacaucgagaccgacuauacgaagaccuuccacuuccacagcaagcgggucaccgcccacggcgacacgccccagcucgaccugaaggcccgccccaccuauggggccggcgagaucaccgugcugguggaggucgccgacauggagcuccacaccaagaagguggagaucuccgggcugaaguucgccagccuggccugcacuggcugcuacuccugcagcuccgggaucucuugcaaagugcggauccacgucgacgagccggacgagcucacggugcaugugaaguccagugaccccgacgucguggccgcgagcaccucccugauggcacgcaaacuggaguucggcaccgacagcaccuucaaggccuucuccgccaugcccaagacgagccucugcuucuacaucguggaacgggaguacugcaaguccugcagcgaggacgacaccaagaagugcgucgacaccaagcuggagcagccccagaguauccugaucgagcacaaggggaccaucaucgggaagcagaacgauacgugcaccgcuaaggcgagcugcuggcucgaguccgucaagagcuucuucuacggccugaagaacaugcucgguuccguguucggcaauuucuucguggggauacuccuguuccuggcccccuucgugcuccuggugcuguucuucauguuugguuggaagauccucuucuguuucaagugcugccgccggacccgcggccuguucaaguaccgccaccugaaggacgacgaggagaccggguaccggaagaucaucgagcgccucaacagcaagaagggcaagaaccggcugcuggacggggaacgccucgccgaccggaagaucgccgagcuguuuuccaccaagacgcacaucggc

SEQ ID NO: 15454 - RNA, 3495 nt, Artificial Sequence
  derived and/or modified CDS sequence (opt11) from CCHVF(CCHVF K229_243)__KX013466.1__Gn-NSm-Gc
agcgaggagcccggcgacgacugcaucucccguacccagcugcuccggacggaaacggccgagauccacgaugacaauuacgggggcccgggggacaagaucaccaucugcaacgggagcacaaucguggaccagcgcuugggguccgagcugggauguuacacgaucaaccgggucaagucuuucaaguuaugcgagaacuccgccacgggcaagaccugcgagaucgacagcacccccgugaagugccgacagggguucugccuaaagaucacccaggagggccggggucacgugaagcugagccgcggcagcgaggucgugcucgacgcgugcgacuccagcugcgaggugaugaucccaaaggggacgggcgacauacuggucgacugcuccggcgggcagcaacacuucuuaaaggacaauuugaucgacuuagggugcccccauaucccgcugcuugggaagauggccaucuacauuugccguaugagcaaccacccccgcaccaccauggccuuccuguucugguucuccuucggcuacgucaucacguguaucuucugcaaggcccuguucuacucccucaucaucaucggcacccuugggaagaagaucaagcaguaccgggaacugaagccccagaccuguaccaucugcgagaccgcccccgugaacgcuaucgacgccgaaaugcacgaccucaacugcuccuacaacaucugcccuuacugcgccagccgcuuaacguccgauggccuggcccggcacgucccccagugcccaaagcggaaagagaaaguggaggagaccgagcucuacuugaaccuugagcgaauccccuggauugugcgcaaguuacugcagguuagcgaguccaccgggguggcgcugaagcggagcagcuggcucauagugcugcugguccuccugaccguuucgcugagccccgugcaguccgcccccgucggccacgggaaaacgaucgagaccuaccagacccgcgagggcuucaccagcaucugccucuucaugcuggggagcauacuguuccucgugagcugucuggugaaggggcugguggacuccguguccgacuccuucuuccccggccucagcgugugcaagacgugcucaaucgggagcauuaauggauucgagaucgagucccacaagugcuauugcagccuguucugcugcccguauugccggcacugcuccgccgaccgcgagauacaccagcuucaccuaagcauaugcaagaagcggaagaccggguccaaugucaugcuagccgugugcaagcgcauguguuuccgggccaccaucgaggcgagccgcagagcccugcucauccgguccaucaucaacaccacguucgucaucugcauccuaacccugaccaucugcguggugagcacuagcgccguggagauggagaaccuaccggccggaacgugggagcgcgaagaggaccugaccaacuuuugccaccaggagugccaggugaccgagaccgagugccugugucccuacgaggcccuggugcuccggaagccccuguucuuagacuccaucgucaagggcaugaagaaccuguuaaacagcacgucccuggagaccucacucagcaucgaagcgcccuggggagccaucaacgugcagagcaccuucaaaccgaccguguccaccgccaacaucgcccugagcugguccagcgucgagcaccgcgggaacaagauucuggugacggggcgguccgagagcaucaugaagcucgaggaacgcaccggcguguccugggaccugggggucgaggacgccagcgagucaaagcugcucaccguaagcaucauggaccugucccagauguacagccccgucuucgaguaccuguccggcgaccggcaggucgaggaguggcccaaagcgaccugcacgggcgacugucccgagcgcugcggcugcaccucgagcacgugccugcacaaggaguggccgcacucccgaaacuggcguugcaaccccaccuggugcuggggcguagggaccggcugcacgugcugcggcguggacgugaaggaucuguucaccgaccauauguuugugaaguggaagguagaauacauaaaaaccgaagccaucgucugcguggagcugaccucgcaggaacggcagugcuccuugaucgaggccgggacucgcuucaaucugggcccagugaccaucacgcugagcgagccccggaacauucagcagaagcucccgcccgagaucaucacgcugcaccccaaggucgaggagggauucuucgaccugaugcacgugcagaaagugcucuccgccagcaccgucugcaaauuacaauccugcacccacggcaucccgggggaccuacagguguaccacauugguaacuugcugaagggcgaccgcgugaaugggcaccuuauccacaagaucgagccucacuuuaacaccagcuggauguccugggacggcugcgaccucgacuacuacugcaacaugggggacuggcccagcugcacuuacaccggcgucacccagcacaaccacgccgcauucgugaaccugcugaacaucgagaccgacuacacaaagaccuuccauuuccacuccaaacgggugaccgcacacggggauacgccgcagcucgaccugaaggcccgcccgaccuauggcgccggggagaucaccguccucguggagguggcggauauggagcuccacaccaagaaggucgagaucagcgggcugaaguucgccucccuggcgugcaccggcugcuacgcgugcagcuccgggaucagcugcaaggugagaauccacguggacgagcccgacgaacucacgguccacgugaaguccucugacccggacguugucgccgcuagcaccuccuugauggcccgcaagcuggaguucggcacggacagcaccuucaaggccuucuccgcuaugccuaagacgagccucugcuucuacaucguggagaaggaauacugcaaguccugcagcgaggaggacacccaaaagugcguagacaccaagcuggaacagccgcagaguauccugauugagcacaaggggaccaucaucggcaaacagaacgacacgugcacugccaaggcgagcugcuggcucgaguccgucaagagcuucuucuacggccugaagaacaugcugggguccguguuuggcaacuuuuucaucgggauccuccuguuccugacccccuucgugcuccugguccuguucuucauguucggguggaagauccuauucugcuucaagugcugccggcgcacccgcggacugcugaaguaccgccaccucaaggacgacgaggagaccggcuaucgccggaucaucgagcgccugaacaacaagaaggggaagaaccggcugcucgacggggaacgucucgccgaccggaagaucgccgagcuguucagcacgaaaacccacaucggc

SEQ ID NO: 15455 - RNA, 3495 nt, Artificial Sequence
  derived and/or modified CDS sequence (opt11) from CCHVF(CCHVF K315_14)__KX013469.1__Gn-NSm-Gc
agcgaggagcccggggacgacugcaucucccgcacacaacugcucaagaccgagacggccgagauccacgacgauaacuacgggggcccgggggauaagaucaccauuuguaacggcagcaccguggucgaccagcguuuaggguccgagcugggcuguuacaccaucaaccgcgucaagagcuuuaaacucugcaagaacagcgccaccggcaagaccugcgaaaucgauucuacccccgugaaaugccggcagggguuuugccugaagaucacccaggagggccgcggacacgugaaacugucccggggcagcgagguaguguuagacgucugcgacuccagcugcgagaucaugauccccaaagggacuggcgacaucuuaguggacugcuccggcgggcagcagcacuuucugaaggacaaccucaucgaccugggcuguccccauaucccgcugcucgggaagauggcgaucuacauuugccgcaugagcaaccacccccggaccacaauggccuuccuguucugguucucguucggcuacgugauuacuugcaucuucugcaaggcgcuguuuuacagccucaucaucaucggcacccuggggaagaagaucaagcaguaccgcgagcugaagccccagaccugcaccaucugcgagaccgccccugucaacgccauugacgccgagaugcacgaccucaacugcuccuacaacaucugcccguauugcgccagccggcugacguccgagggccuggccaggcacguaacccagugcccuaagcggaaggagaagguggaggagaccgaacuuuacuugaaccuggagcgcauccccuggaucguccguaaauugcuccagguguccgagucuaccgggguggcccugaagcgcagcagcuggcucaucguucuucuagugcugcucacggugucccugagccccguccaguccgcgccggugggccacgggaagaccauagagacuuaucagacucgggaaggcuucacgagcaucugucucuucaugcugggcuccauccuguucaucgugagcugccucgugaagggccugguguauuccgugagcgauuccuucuuucccggccugagcgucugcaagaccugcuccaucgggagcauaaacggcuucgagaucgagucccacaagugcuauugcucucucuucugcugccccuacugccgccacugcagugccgaccgggagauucaccagcugcaucucagcaucuguaagaagagaaaaaccggguccaacguaaugcucgccgucugcaaacguaugugcuuuaaggccacaauugaggccagcagacgggcgcugcugauccgauccaucaucaacacgaccuucgugaucugcauccucacccuggccaucugcguggucagcaccagcgccguggagauggaagaccuucccgccggcaccugggagcgcgaggaggaccuaaccaauuuuugccaccaggagugccaggugacggagaccgagugcuuaugcccguacgaggcccugguccugcggaagccccucuuccuggauuccauagugaaggguaugaagaagcugcucaacagcacgucccuggagaccagccuguccauugaggcgcccuggggcgcaaucaacgugcagagcaccuucaagcccaccgucucaaccgccaauaucgcccucagcugguccagcguggaacaccgcgggaacaagauccuagugacugggcgguccgagagcauaaugaagcuggaggagcgcaccggcgucuccugggaccucgggguggaggacgcuagcgaauccaaacugcuuaccgugagcaucauggaccucucccagauguacagcccgguauucgaguaucugagcggcgaccgccaggucgaggaguggccuaaggcgaccugcacgggcgacugccccgaacggugcggaugcaccuccucgacgugccugcacaaggaguggccccacucccggaacuggcgcugcaacccgacgugguguuggggcguugggaccggcugcacguguugcggcgucgauguaaaagaccucuucaccgaccacauguucauaaaguggaagguggaauacaucaagaccgaggccaucgucugcguggagcugacaagccaagagaggcagugcucccugaucgaggcagggacccgauucaaccucggccccgugaccaucacccugagcgaaccccggaacauccagcagaagcugccgccggagaucaucacgcuccaccccaagauugaggaaggguucuucgaccuuaugcauguccagaaggugcuguccgccagcaccguguguaagcuccaguccugcacccacggcauaccaggugaccugcagauauaccacaucggcaaccugcucaagggcgaucgcgucaacgggcaccugauacacaagaucgagccucacuucaacaccagcuggauguccugggacggcugcgaucuggacuacuacugcaacaugggagauuggccgaguugcacguacaccggcgugacccagcauaaccaugccgcuuucgugaacuuacugaacauagagaccgacuacacgaagaccuuccacuuccacuccaagcgagucacggcccacggagacacgccucagcuggaucucaaggcccgcccuaccuacggcgccggcgagaucaccgugcuaguggaggucgcggacauggagcugcacaccaagaagguugagaucagcgggcucaaguucgcuucccugaccuguacgggcugcuacgccugcagcucugggaucaguugcaaggugcggauucacgucgacgagccggacgagcugaccgugcacguaaagucaagcgaccccgacgucguugccgccagcacaagccucauggcgcgcaagcucgaguucggcacugacuccacguucaaggccuucucagccaugcccaagacaagccugugcuucuacaucguggagagggaguacugcaaguccuguuccgaggacgacaccaagaaguguguugacaccaagcucgagcagccccaguccauccucaucgagcacaaggguacaaucaucgguaagcagaacgauacgugcaccgcuaaggccagcuguuggcuugaguccgucaagagcuucuucuacggccugaaaaacaugcugggauccguguucggcagcuucuucguggggauccuccuguuccuugcaccuuucgugcugcucguacuguucuucauguucgguuggaaaaucuuguucugcuucaagugcugccgccggacccgcgggcuguucaaguaucgccaccuaaaagacgacgaggagaccgguuacaggcgcaucaucgagcggcugaauagcaaaaagggcaagaacaggcuccuggacggcgagcgacuggccgaccgcaagaucgccgagcuguuuagcacgaagacccacaucggc

SEQ ID NO: 15456 - RNA, 3495 nt, Artificial Sequence
  derived and/or modified CDS sequence (opt11) from CCHVF(CCHVF K323_27)__KX013472.1__Gn-NSm-Gc
uccgaggaaccgggcgaugacugcauaucacgaacccaacuacuaaaaaccgaaacugccgagauucacgacgauaacuacggagggcccggggacaaaaucacaaucugcaacggauccaccaucguggaccaaaggcugggaucggaguugggauguuauaccauuaacagaguuaaaucguuuaagcugugcgaaaacuccgccaccggaaaaaccugcgaaauugacucaacccccguaaagugccgacaaggcuucugccuuaaaauaacccaagaaggccgcggccacgugaaacucagccgagguuccgaagucguccucgacgcaugugacagcucaugcgaaaucaugauccccaaggggaccggugacauccuaguagacugcuccggcggucaacagcacuuccucaaagacaaccuaaucgaccucggaugcccucauaucccccuccuugggaaaauggcaaucuacaucugccgaaugucaaaucacccccguacaacaauggcuuuccucuucugguucuccuucggauacgucaucacaugcauauucuguaaagcgcucuuuuaccuccuaauaaucaucggaacccucggcaaaaagauaaaacaauaccgggagcucaaaccgcagaccuguaccauaugcgagaccgcaccagucaacgcaauagacgcggagaugcaugaccucaauugcagcuacaacauuugccccuacugcgcgagccgacuaacuucugauggccucgcacgacacgucacccaaugcccaaaacggaaggaaaaaguagaggaaaccgaacuguacuugaacuuagagcguauuccauggaucgugcgaaagcuacuccagguauccgaauccacaggugucgcccuaaaacgaagcagcuggcucaccguacuacuuguacuccuaacagucagccuuucccccguucaaucagccccaguuggucacggcaacacgauagagaccuaccaaacacgcgaaggauucaccucuaucugccucuucaugcuaggcuccauucucuucauagucucgugucugguaaaaggccucguagacucagucagcgacucauucuuccccggucucuccgucugcaaaaccugcuccaucggaagcauaaauggcuucgagauagaaagccacaaauguuacuguucccucuucugcugcccccacugccgccaccgcuccgcggauagagaaauccaccaacuucacuuauccaucugcaaaaagcggaaaaccggcucaaacguuaugcucgccgucugcaagcgcaugugcccuaaagcaaccaucgaagccagucgccgagcacuacccauccgcagcaucaucaacaccacgcuggugaugugcauacucacacuagccaucugcgugguaucaaccagcgcgguagaaauggaggaccuuccggcagggacaugggaaagagaagaagaccugacaaacuucugccaccaagagugccaagucaccgaaacugagugccucugcccguacgaggcccugguguugcggaaaccucucuuccucgacagcaucgcaaaaggaaugaagaaccuacuaaacucaacaagucuggaaacaucacugucgaucgaagcccccuggggcgccaucaacguccaaagcaccuucaagccaaccguaucgaccgccaacaucgcccuauccuggagcuccguggagcaccgcggcaacaagauucucguuaccggacgcucugaaucgaucaugaaguuagaagaacgcaccggagucucaugggaccuagggguggaagaugccuccgaguccaagcuccuaaccguaagcauaauggaucuaucacaaauguacagccccgucuucgaauaccugagcggagacagacaaguagaagaauggcccaaggcuaccugcacaggugacugccccgaacgcugcggcugcaccagcagcacaugucuccacaaagaguggccccacagccgcaauuggcguugcaaccccacuuggugcuggggagucggcaccggcugcacaugcugugguguggacgucaaagaucuauucacagaccacauguuuauaaaguggaaaguagaauacaucaagacugaagcuauaguuugugucgaacuaacaggacaagaacgccaauguucccuuaucgaggcuggcacccgauucaaccuaggaccagugacuaucacccucuccgaaccccgaaacauacaacaaaaauuaccaccugaaaucauaacccuucauccaaaaauugaagaaggauuuuucgaccucaugcacguccagaaaguacucucggcuagcacggucuguaaacugcaauccugcacacacggcauaccaggcgaccuccaaauauaccacaucggaaaccuucuaaaaggcgaccgugucaacggacaccuaauccacaaaaucgagccccacuucaacacauccuggaugucaugggacggaugcgaccuggauuacuauugcaacaugggcgacuggcccuccugcaccuacaccggcgucacacaacacaaccacgcagccuucgucaaccuccucaacaucgaaacggacuacacaaagaccuuccacuuccacuccaagagaguaacagcucauggagacacaccccaacucgaccucaaagcccgccccaccuacggcgccggcgaaaucacaguccugguagagguggccgacauggaacuccauacgaagaaaguagaaauuagcggauugaaauucgcaucacuaacauguacuggauguuacgccugcagcucaggcauaucuugcaaaguucgcauucacguugaugaaccagacgagcuaacuguccacgucaaaucguccgacccagacguugucgccgcauccacuucgcuaauggcccgcaaacucgaguucgggaccgacucgacauucaaagccuucuccgcaaugcccaagacuucccucugcuuuuacauagucgaacgggaauacuguaaaagcugcucagaagacgauaccaagaaaugcguagacaccaaacuagaacaaccccaguccauucuuauagaacacaaaggaaccaucaucgggaaacaaaacgacacaugcacagccaaagccuccugcuggcucgaauccgucaaauccuucuucuacggccugaaaaacaugcuugguuccgucuuuggcucguucuucgucggcauacuacucuuccucgcaccauucguccuccucguccucuucuuuauguucggauggaagauccucuucugcuucaagugcugccgacggacucgaggccucuucaaauaccgacaucucaacgacgacgaggaaaccggcuaccgucgaaucauagaacggcuaaacaguaagaaagguaaaaaccgacuauuagacggagagcgccuagcggaccgcaaaaucgcagaacuauucucaaccaaaacgcacaucggg

SEQ ID NO: 15457 - RNA, 3495 nt, Artificial Sequence
  derived and/or modified CDS sequence (opt11) from CCHVF(CCHVF K340_6)__KX013475.1__Gn-NSm-Gc
uccgaggaaccaggagacgacugcaucagccgcacccaacuacucaagacagaaacagcggaaauccacgacgacaacuacgggggaccaggcgacaaaaucaccauaugcaauggcuccacaaucgucgaccaacgccuugguuccgagcucggcugcuacacgaucaaccguguuaagagcuucaaacuuugcgaaaacagcacuaccgguaaaacgugugaaaucgacuccacacccgugaaaugccgccaaggcuucugccucaaaaucacacaagagggacgcggacaugugaagcucaguaggggcagugaagucguacucgacgccugcgacuccuccugcgaaauaaugauaccaaaagguacgggcgacauccucgucgacuguuccggcggccaacaacacuuccucaaagacaaccucaucgaccucgggugcccacauaucccgccccuuggcaaaauggccaucuacauauguagaauguccaaccacccccgcacaacgauggcauuucucuuuugguucucauucggauacguuauuaccugcaucuucugcaaggcacuauuuuacucauugauaauaaucggcacacugggaaagaaaaucaaacaauaccgugaacucaaaccccaaaccugcaccaucugcgaaacagcccccguaaaugcaauagacgccgagaugcaugaccucaauuguagcuacaauaucugcccuuacugcgcaucccgccucacgagugacggacucgccagacacgucacucaaugcccaaaacgaaaagaaaaggucgaagagacagagcucuaccucaaccuagaaagaauaccauggauugucagaaaacugcuacaaguaagcgaaucgacaggagucgcccuuaaacgguccucguggcugauaguacuccuaguacuccucacaguaagccugagcccaguccaaagcgccccaguaggccaugggaagaccauagaaaccuaucagaccagagaaggcuucacaagcauaugccuauucaugcuaggcucuauccuauucauaguauccugccuagucaaaggccucguggacuccgucucugacucguucuucccgggccucagcgucugcaaaaccugcagcauaggauccaucaauggauucgaaauagaaucacacaaaugcuacugcucccuauucugcugcccauacugccgccauugcagcgccgaccgagaaauccaucaacuacaccuaagcaucugcaagaaacgaaaaacaggcuccaacgucaugcucgcuguauguaaacgcauguguuucaaagcaacaauagaagccucccgccgagcacuacuaauccguuccaucaucaacaccaccuucgucaugugcauccuuacccucgccauaugcgucgucucaacuagcgccgucgagauggaggaccuccccgcaggaaccugggaacgggaagaagaccuaacaaacuucugccaucaggaaugucaagucaccgaaacagagugccuuugcccauacgaggccuugguccuccggaaaccacugucccuagacagcauaguuaagggaaugaaaaaccuacucaacuccacuucccucgaaaccucauuauccauugaggcacccuggggagcuaucaauguccaaucgacauucaaaccaacagucagcacagcaaacauagcauugagcuggucuuccguagaacaucgcggaaacaagauacucgucacaggacgaagugaauccaucaugaagcucgaggaacgcaccggcgucuccugggaccucgggguagaagacgccuccgaaagcaaacuccuaacaguauccauaauggaccucagccagauguacucgcccgucuucgaguaccucaguggagacagacaggucgaagaauggccgaaagccacuuguacgggcgacugcccagagagaugcggcugcacgagcuccacuugccuccacaaagaauggccccacucccgcaacuggcgaugcaauccaaccuggugcuggggcgucggcacagguuguacuugcugcggcgucgacguaaaagaccuuuucacggaccacauguucaucaaauggaagguagaguacaucaaaacggaggccauuguaugcgucgaacugaccucccaggaacgccaaugcucacucaucgaagccggcaccagauucaaccuuggccccgucaccaucacgcucucagagcccagaaacauacaacaaaaacucccuccagaaaucauaacccuacauccuaaaaucgaagaaggcuucuucgaccugaugcacguacaaaaagucuuaagcgccagcaccgucugcaaacuacaaagcuguacgcacggcaucccaggcgacuugcaaauauaccacauaggaaaccuacugaagggagacagaguaaauggacaccuaauccacaaaauagagccccacuucaauacaucauggaugucuugggacggcugcgaccucgacuacuacugcaacaugggugacuggccaagcugcacauacaccggagucacacaacacaaccacgcagcauucgucaaccuacuaaacauagagacggacuacacaaagacauuucauuuccacuccaaaagagugaccgcccacggcgauacgccccaacuagaccuaaaagcgaggcccacguacggcgcaggagaaaucacggugcucguagaagucaccgauauggagcuccacaccaagaaaguagaaauaagcggccuuaaauucgccuccuugacaugcaccggaugcuaugcaugcuccuccggaauauccugcaaaguacguauccacgucgacgaacccgacgaacucacaguccacgucaaaucguccgaccccgacgucgucgccgcaagcacuagccugauggcaagaaaacuagaguuuggaaccgacucgacguucaaggcauuuuccgcgaugcccaagacaucacuaugcuucuacaucgucgaacgggaauacugcaaaagcugcucagaagacgauaccaagaaauguguagacaccaaacuagaacaaccucaauccauacucaucgaacacaaagggacuauuauaggaaaacaaaacgauaccugcacagccaaagccagcuguuggcuugaaucagucaaauccuucuuuuacggccucaaaaacaugcuaggcucaguauucggcucauucuucguuggaauccuccucuuccuagcgccuuucgugcuacucguccucuucuuuauguucggcuggaaaauccuauucugcuucaaaugcugccgacgaacccgaggccuauucaaauaccgccacuucaaagacgacgaagagacaggcuaccgacgaauaauugaacgacucaacucgaagaaaggcaaaaaccgacuacucgacggagaacgccuugccgacagaaaaauagcagaacucuucuccaccaaaacccacaucggc

SEQ ID NO: 15458 - RNA, 3495 nt, Artificial Sequence
  derived and/or modified CDS sequence (opt11) from CCHVF(CCHVF Mamon)__KX013478.1__Gn-NSm-Gc
agcgaggagcccggcgacgacugcaucagucgcacccaacugcuccggaccgagacagccgagauccacgacgacaacuacgggggcccgggggacaaaaucaccaucuguaacggcuccaccaucguagaccaacgacucgggucggagcuggguugcuacaccaucaaccgggucaagagcuucaaacucugugagaacuccgcuacaggcaagaccugcgaaaucgacagcacgcccgugaagugccgccagggguuuugucugaagaucacccaggagggccgggggcacgugaagcugucccgcgggagcgaggucguguccgacgcaugcgacagcuccugcgaggugaugauccccaaggggacgggcgacauccucgucgacugcagcggcgggcagcagcacuuccuuaaagacaaccugaucgaccucggcugcccccacaucccgcugcuggggaagauggccaucuacaucugucggauguccaaccacccccgcaccaccguagccuuccucuucugguucagcuucggcuacgugaucacgugcauauucugcaaagcccuguuuuacucgcugaucaucaucggcacccucgggaagaaaaucaagcaguaucgggagcugaagccccagaccugcaccaucugcgagacugcccccguuaacgcgaucgacgccgagaugcacgaccugaacugcagcuacaacaucugcccguacugcgccucccgccucacgagcgauggccuggcccgacauguaccccagugccccaaacgcaaggagaaaguggaggagaccgagcuguaccucaaccuggagcggauccccuggaucguccgcaagcugcuccagguauccgagagcaccgggguggcgcugaagcggucguccuggcugaucguacuucugguucugcucaccgugagccugagcccuguccagucggcccccgugggccacgggaagacuaucgagaccuaccagacccgcgagggcuuuaccuccaucugccuguuuauguugggcagcauucuuuuccugguuuccugccuugucaaggggcugguggacagcguguccgacagcuucuuccccggccuguccgucugcaagacgugcagcaucggguccaucaacggcuucgagaucgagagccacaagugcuacugcucccucuucuguugccccuacugccggcacugcagcgccgaccgcgagauccaccagcuacaccuguccaucugcaagaagcggaagaccgggagcaacgugaugcucgccgucuguaagcgaaugugcuuccgggccaccaucgaggcgucccgccgcgcccugcugauccgcagcaucaucaacaccacguucgugaucugcauacucacccugaccaucugcguggucagcaccucugccguggaaauggagaaccugccgagcggcacuugggagcgcgaggaagaccucaccaacuucugccaccaggagugucaggugaccgagaccgagugccugugccccuacgaggcccugguccugcggaagccccucuuccuggacagcauugugaagggcaugaagaaccugcucaacagcacgucccuggagaccagccuguccaucgaggcccccuggggcgcgaucaacguacagagcaccuucaagccgaccgucuccacagccaacaucgccuugucuugguccagcguggagcaccgcgggaauaagauccuggugacggggcgguccgagagcaucaugaagcuggaggagcgcaccggggucuccugggaccucgggguggaggaugccagcgagagcaagcugcugaccgugagcaucauggaccucagucagauguacucccccgucuucgaguaccugagcggagaccgccagguugaggaguggcccaaggcgaccugcacgggcgacugcccagagcggugcgggugcaccaguagcacaugccugcacaaggaguggccgcacucccggaacuggcgcugcaaccccaccuggugcuggggcguugggaccggcuguacgugcugcggcgucgacgugaaggaccucuucaccgaccacauguucgugaaguggaaagucgaguacaucaagaccgaggccaucgugugcguggagcugaccagucaggagcggcagugcucccugaucgaggcuggaacucgcuucaaccucggcccugucaccaucacccugagcgagccccgcaacauacagcagaagcugccucccgagaucauuacucuccaccccaagguggaggagggguucuucgaccugaugcacgugcagaagguccuguccgccagcaccguuugcaagcuccaguccuguacccacgggaucccgggggaccuccagguguaccacaucggaaacuuacucaagggcgaucgcgucaacgggcaccugauccacaaaaucgagccccacuucaacaccagcuggauguccugggacggcugcgaccuggacuacuacugcaacaugggggacuggcccagcugcacguauaccggcgugacccaacacaaccacgccgccuucgugaaccuccugaacaucgagaccgacuauacgaagaccuuccacuuccacuccaagcgggucacagcgcacggcgacacgccccagcuggaccucaaggcccgcccgaccuacggcgccggcgagaucaccgugcugguggaggucgccgauauggagcugcacaccaagaagguggagauaucugggcucaaguucgcgucccuggccugcaccggcugcuacgccugcagcucagggaucagcugcaaggugcggauccacguggacgaacccgacgagcugacggugcacguaaagagcuccgacccagacgugguggccgccagcaccucccugauggcgcgcaagcuggaguucggcacggacagcaccuucaaggcauucuccgccaugcccaaaacgagccugugcuucuacaucguggagcgggaguacugcaaguccugcucagaggaagacacccagaagugcgucgacaccaagcucgagcagccgcaguccaucuugaucgaacacaaggggaccaucaucggcaagcagaacgacacgugcaccgccaagaccaguugcuggcuagaguccgucaagagcuucuucuacggccucaagaacaugcuaggguccguguucggcaacuucuucauugggauccuccuguuccuggccccauucgugcugcuugugcuguucuucauguucggcuggaagauccucuucugcuucaagugcugccgccgcacccgggggcucuuaaaauaccgccauuuaaaggacgacgaggagacaggcuaccggcgcauaaucgagcggcucaacaacaagaagggcaaaaaccgccuguuagacggggagcggcucgcggaccgcaagaucgccgagcuguucagcacgaagacccacaucggc

SEQ ID NO: 15459 - RNA, 3495 nt, Artificial Sequence
  derived and/or modified CDS sequence (opt11) from CCHVF(CCHVF Min)__KX013481.1__Gn-NSm-Gc
agcgaggaacccggcgacgacugcaucucccgcacccagcuccuucgcaccgagacggcggagauccaugaugacaacuacgggggcccgggggacaaaaucaccauuugcaaugguagcaccaucguggaccaacgccugggguccgaacugggcugcuacacuaucaaccgggucaagagcuuuaagcucugcgagaacuccgccacgggcaagaccugcgaaaucgacagcacccccgugaaaugccgccagggguucugccugaagaucacccaggagggccgggggcacgugaaacugagccgcggcagcgagguggugcuugaugcaugcgacuccuccugcgaggugaugaucccuaaggggacuggcgacauccuagucgacugcuccgguggucagcagcacuuccugaaagauaaccucaucgaccugggcugcccccacaucccguugcucgggaagauggccaucuacaucugccggaugagcaaccacccccgcaccacgauggccuuccuguuuugguucuccuucggcuacgugaucacgugcaucuucugcaaagccuuauuuuacucgcucaucaucaucggcaccuuggggaagaagaucaagcaguaccgggagcugaagccccagaccugcacgauaugcgagacugcccccgugaaugcgaucgacgccgagaugcacgaccucaacugcuccuauaacaucuguccguauugcgcgagccgccugacgucagacggacuggcccggcacgucccccagugccccaagagaaaggagaagguggaagagaccgagcucuaucugaaucuggagcggaucccauggaucguccgcaagcuccugcaggucagcgaguccaccgggguggcgcucaaacguagcuccuggcucaucgugcugcugguccuccuuaccgugucccugagcccggugcaauccgcccccgucggacacgggaagacuauagagaccuaccagacccgcgagggcuucaccagcaucugcuuauucaugcuugguuccauccuguuucucguaagcugccuggugaaggggcucguugacuccguguccgacuccuuuuucccaggccucagcgugugcaaaacgugcacuaucggguccaucaacggcuucgagaucgaaagucacaagugcuacugcucccuguucugcugcccguacugcaggcacugcagcgccgaucgcgagauacaccagcugcaccucucgaucugcaaaaagcggaaaacugggagcaacgucaugcuggccgugugcaagcgcaugugcuuccgggcaaccaucgaagcgucccgcagagccuuauugauccgcagcauaaucaacacgaccuucgucaucugcauccugacccugacuauaugcguaguauccacgagcgccguagagauggagaaucucccgagcggcaccugggagcgcgaggaggaccugaccaacuuuugucaccaggagugccaagugaccgagacggagugcuuauguccuuacgaggcccuggugcuccggaagccccuguuccuggauagcauugucaaaggcaccaaaaaucuccugaacagcacuagccuggagaccagccucucaaucgaggcccccuggggugcgauuaacgugcagagcaccuucaagccgacaguguccaccgccaauaucgcccuguccugguccagcgucgagcaccgcggaaacaagauccucguuacagggcgguccgagagcaucaugaagcucgaagaacgcaccgguguguccugggaccugggggucgaggacgccagcgaauccaagcugcucacuguuagcaucauggacuugucucaaauguacagccccguguucgaguaccugaguggugaccggcaagucgaagaauggcccaaggcgaccugcaccggugacugccccgagcgcugcggcugcaccuccagcacgugccuccacaaggaguggccgcacucccggaacuggcguuguaaccccacauggugcuggggcguggggaccggcugcacgugcuguggaguggacgucaaagaccuguucaccgaucauauguucgugaaguggaaggucgaguacaucaagaccgaggccaucgucugcguagagcugaccagccaggaacggcagugcucgcucaucgaggccgggacccgcuuuaaccuaggccccgugacgaucacccugagcgagccccgcaacauccagcaaaagcucccgcccgagaucaucacccugcaccccaaagucgaggagggguucuuugaccucaugcacgugcagaaggugcugagugcaagcaccguuugcaagcuccaguccuguacgcacggcaucccgggggaccuucagguauaccauaucggcaacuuguuaaagggcgaccgcauaaacgggcaccugauccacaagauagagccccacuucaauaccagcuggauguccugggacggcugcgaccucgacuacuacugcaacaugggagauuggcccagcuguaccuacaccggcgugacgcaacacaaccacgccgccuucgucaacuuacugaacaucgagaccgacuacaccaaaacuuuccacuuucacuccaagcgugugacggcgcacggggauacuccccagcucgaccugaaggcccgcccuacauacggcgccggcgaaaucacggugcuggucgagguugccgacauggagcuccacacaaagaagguagagaucagcgggcugaaguucgcaucucuggcgugcacaggcugcuacgccugcagcucggggaucagcugcaagguccggauucacguugacgagccagacgagcucaccgugcacgucaagucuagcgacccugacgugguggcagccagcacgucccugauggccagaaaacuugaguucggcacggauagcacuuucaaagccuucuccgccaugcccaagacgagccucugcuucuacaucgucgaacgugaguacugcaaguccugcagugaggaagacacccagaagugcguugacaccaagcuggagcagccacaaucgauccugaucgagcacaaagggacgauuaucggcaaacagaacgacacgugcacagcgaaggccagcugcugguuggaguccguaaagagcuucuucuacggacucaagaacaugcuggguuccguguucggaaauuucuucauagggauccuccucuuccuggcgccguucguucuccuggugcuguucuucauguucggauggaagauccucuucugcuucaagugcugccgccgaacucgggggcugcugaaguacaggcaccucaaagacgacgaggagaccggcuaccgccgcaucaucgagcgccugaacaacaaaaagggcaagaaccgccugcucgauggggaacgucucgccgaccgcaagauagccgagcuguucagcaccaagacucacaucggc

SEQ ID NO: 15460 - RNA, 3495 nt, Artificial Sequence
  derived and/or modified CDS sequence (opt11) from CCHVF(CCHVF Nakiwogo)__KX013484.1__Gn-NSm-Gc
gcagagggcgugagcaacgacugcgucucccgcacccaguuaaucaagaccgagguggccgagauccacgaggacagcuacgggggcccaggcgagaagaucacgaucugcaacggcuccaccaucguggaccagcggcucgggagcgagcugggcugcuacaccauuaaccgcgucaagaccuacaagcugugcgagaacuccgcgacugagaagggcugcgagaucgacagcgugccggugaagugcaagcagggguucugccucaaggucacgcaggagggccgggggcacgugaagcugucccgcggcaccgagaucgugcuggacgucugcgacaccagcugcgagcucaugaucccaaaggggacgggcgacauccugguggacugcuccggcgggcagcagcacuuccugcaggacaaccucaucgaccugggcugccccaacgugccccugcucgggaagauggccaucuacaucugccggaugucaaaccacccgaagaccaccauggccuuccuguucugguucuccuucggcuacgucaucacgugcguggugugcaagguccuguucuaccuccugaucgugaucggcacccuggggaagaagcucaaacaguaccgcgagcugaagccccagaccugcaucgugugcgaaagcauacccgucaacgugaucgacgccgagaugcacgagcugaacugcaacuauaacaucugccccuacugcgccucccggcucaccagcgacggccuggugcgccacgucacccagugcccgaagcggaaggagaagguggaggagacugagcuguaccucaaccuggagcgcauccccuggcuggugcggcgccuccugcaggucuccgagagcaccggaauggcgcugaagcgguccugcuggaugaccacccuccugauccugcucguggucagccucucccccgugcagagcgcccccgugggccaggagaaggccaucgagguauaccaggugcgcgagagcuacacguccaugugccucuucgugcucgggagcguccuguucgccgugucuuggcuggugaagggccucaucgacgggaucgggaacucuuucuuuccaggccuguccgucugcaagaccugcagcaucgggucaaucaacggcuucgagaucgagagccacaagugcuacugcagccuguucugcugucccuacugccgagccugcagcuccgacaagaucacccaccgcaugcaccucaacaucugcaagcggcgcaagguggggagcaacguaaugcuggccgucugcaagcguaugugcuucaaggccaccguggaggccuccaacagcgcccugcucauccgcuccaucaucaacagcacguucgugaucuguguccugauccuggugaucugcgugguaucuaccagcgcgguggacauggaaaaccuccccgccggcaucugggagcgggaggaggaccugaccaacuucugccaccaggagugccaggugaccgagacagagugccugugccccuacgaggcauugauccuccgcaagccccuguaccuggacucgaucgccaaggggaugaagucccuccugaacagcaccaaccuggagaccucccucagcaucgaggcccccuggggcgcgaucaacguccaguccaccuucaagcccacggugagcgccgccaauaucgcccuguccuggagcuccguggagcaccgcgggaacaagauccuggucagcgggcgguccgagucuaucaugaagcucgaggagcgcaccggcaucuccuggagccuggggguggaggacgccuccgagagcaagacccugaccguguccgucauggacuugagccagauguacucccccguguucgaguaccugagcggcgaccgccagguggaggaguggccgaaggcgacgugcaccggcgacugccccgagagaugcgguugcaccagcuccaccugucugcacaaggaguggccccacagccggaauuggcgcugcaaccccaccuggugcuggggcgucgggaccggcugcacgugcugcggccucgacgugcgggaccuguucaccgacuacaugauggugaaguggaaggucgaguacgugaagaccgaggccaucaugugcguggagcugaccucccaggagcgccaaugcagccucaucgaggccgggacccgguucaaccugggcccggucaccaucacccuguccgagccccgcaacgugcagcagcggcuccccagcgagaucguaacgcugcaccccaagaucgaggagggguucuucgaccugaugcauguccagaaggugcuauucugcaagcacucccuccaggccaccagcugcacccacggcgugccgggggaccugcaggucuaccacgugggcaaccuccugaagggcgacaaggugaacgggcacuccauccacaagaucgagagccacuucaacaccuccuggaugagcugggacggcugcgaccuggacuacuucugcaacaugggggacuggcccuccugcacguacaccggcgucacccagcacaaccgcgccgcguucgugaacaugcucaacaucgagaccgacuacacgaagaccuuccacuuccacagcaagcgggugaccgcccacggggacacgccccagcuggaccugaaggcccgcccgaccuacggcgccggcgaggucacggugcucguggagguagcggaccuggagcugcacacaaagaagaucgagguguccgggcucaaguucgccagccugaccugcuccggcugcuacgccugcagcuccgggaucagcugcaagguccggauccacgugaacgagcccgacgaguucacagugcacgucaagucgaacgaccccgacgugguggccgccggcuccagccugauggcgcgcaagaucgagcucggggccgacuccaccuucaaggccuucagcuccaugcccaagaacagccugugcuucuacaucgucgagcgggacuacugcuccagcugcacagacgacgacacccagaagugcgugaacacgaagcuggagcacccucaauccauccucaucgagcacaagggcaccaucaucggcaagcagaacgacacgugccccaccaagaccagcugcuggcuggaguccgucaagagcuucuucuacgggcugaagaacaugcucggcgggaucuucggcaauguguuccuggggaucuuccuguuucucgcccccuucgcccugcugauccucuucuucuucuucggcuggcgccugcuguucugccucaagugcugccggcgcacccggggccugcugaaguacaagcagcucaaggacgaggaggaggcgggguacaagaagauuaucgagcggcugaacgacaagaagggcaagucccgccuguucgacggggagcgacucgccgaccgcaagaucgccgagcuguucagcaccaagacccacaucggc

SEQ ID NO: 15461 - RNA, 3495 nt, Artificial Sequence
  derived and/or modified CDS sequence (opt11) from CCHVF(CCHVF Saf)__KX013487.1__Gn-NSm-Gc
agcgaggagcccggcgacgacugcaucucccgcacgcagcugcuccggaccgagacggccgagauccacgacgacaacuacgggggcccgggggacaagaucaccaucugcaacggcucuaccaucguggaccagcgcuugggguccgagcugggcugcuacaccaucaaccgggucaagagcuucaagcucugcgagaacuccgccacgggcaagaccugcgagaucgacuccacccccgugaagugccgccagggguucugccugaagaucacccaggagggccgggggcacgugaagcugucccgcggcagugaggucgugcucgacgcgugugacuccagcugcgaggugaugauccccaaagggacgggcgacauccuagucgacugcuccggcgggcagcagcacuaucugaaggacaaccucauagaccugggcugcccccacaucccgcuucucgggaagauggccaucuacaucugccggaugagcaaccacccccgcaccaccauggccuuccuguuuugguucucauucggguacgugaucacgugcaucuucugcaaagcccuguucuacagccucaucaucaucgggacccuggggaagaagauaaagcaguaccgggagcugaagccccagaccugcaccaucugcgagaccgccccaguaaacgcgaucgacgccgagaugcacgaccuuaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguacuccugaccgugucccugagcccggugcaguccgcccccgucggccacggaaagacgaucgagaccuaccagacccgcgagggcuucaccagcaucugccucuucaugcugggcuccauccuguuccucgugagcugccuggugaaggggcuggucgacuccgugagcgacucguucuuccccggccucagcgugugcaagacgugcuccaucgggagcaucaacggcuucgaaaucgagucucauaaaugcuacugcagccuguucugcugccccuacugccggcacugcuccgccgaccgcgagauccaccaguugcaccucagcauuugcaagaagcggaagaccggguccaacgucaugcuggccgugugcaagcgcaugugcuuccgggccaccaucgaggcgagccgccgcgcccuguuaaucagguccaucauuaacaccaccuucgucaucugcauccugacccugaccaucuguguggugagcaccagcgccgucgagauggaaaaccucccguccggaacgugggagcgcgaggaggaccugaccaacuucugccaccaggagugccaggugaccgagaccgagugccugugccccuacgaggcccuggugcuccggaaaccccuguucagcgacuccaucgucaagggcaugaagaaccugcucaacagcacgucccuggagaccagccugucuaucgaggccccguggggcgcgaucaaugugcagagcaccuucaagccuaccguguccaccgccaacaucgcccucagcugguccagcguagagcaccgcgggaacaagauccuggugacggggcgguccgagagcaucaugaaacuugaggagcgcaccggcguguccugggaccucggggucgaggacgccagcgaguccaagcugcugaccgugucuaucauggaccucagccagauguacagucccguuuucgaguaccugagcggcgaccggcaggucgaggaguggcccaaggcgaccugcacgggcgacugccccgagcgcugcgggugcaccuccagcacgugccugcacaaggaguggccgcacucccggaacuggcgcugcaaccccaccuggugcuggggcguggggaccggcugcacgugcugcggcguggacgucaaggaccucuucaccgaccacauguucgugaaguggaagguggaguacaucaagaccgaggccaucgucugcgucgagcucaccagccaggagcggcagugcagccugaucgaggccgggacccgcuucaaccucggccccgugaccaucacccugagcgagccccggaacauccagcagaagcugccgcccgagaucaucacgcuccaccccaaggucgaggagggguucuucgaccugaugcacgugcagaaggugcuguccgccagcaccgucugcaagcuccaguccugcacccacggcaucccgggggaccuccagguguaccacaucggcaaccugcugaagggcgaccgcgugaaugggcaucugauccacaagaucgagccccacuucaacaccagcuggauguccugggacggcugcgaccuggacuacuauugcaacaugggagacuggcccagcugcacguacaccggcgucacccagcauaaccacgccgccuucgugaaccuccugaacaucgagaccgacuacaugaagacguuccacuuccacuccaagcgggucaccgcgcacggggauacgccccagcuggaccucaaggcccgcccgaccuacggugccggcgagaucaccguccugguggaggucgccgacauggagcugcacaccaagaaggucgagauaagcgggcucaaguucgugucccuggcgugcaccggcugcuacgccugcagcuccgggaucagcugcaaggugcggauccacgucgacgagcccgacgagcugaccgugcacgucaagagcuccgaccccgacgucguggccgccagcacguccuuaauggcccgcaagcuggaguucggcaccgacagcaccuucaaggcguucuccgccaugcccaaaaccagccugugcuucuacaucguggagcgggaguacugcaaguccuguagugaggaggacacgcagaagugcgucgacaccaagcucgagcagccgcaguccauccugaucgagcacaaggggaccaucaucggcaagcagaacgacacgugcaccgccaaggccagcugcuggcuggaguccgucaagagcuucuucuacggccucaagaacaugcugggguccguguucggcaacuucuucaucgggauccugcuguuucuggcacccuucgugcugcucgugcuguucuucauguucggauggaagauccuguucugcuuuaagugcugccgccgcacccgggggcuccugaaguaccgccaccugaaggacgacgaggagaccggauaccggcgcauuauugagcggcucaacaauaagaagggcaagaacagacugcuggacggggagcggcucgcggaccgcaagaucgccgagcuguucagcaccaagacccacaucggc

SEQ ID NO: 15462 - RNA, 3495 nt, Artificial Sequence
  derived and/or modified CDS sequence (opt11) from CCHVF(CCHVF Ast199)__KX056051.1__Gn-NSm-Gc
agcgaggagcccggcgacgacugcaucucccgcacccagcugcuaaaaaccgagacggccgaaauccacgacgacaauuacgggggcccgggggacaaaaucaccaucugcaacggcucaaccaucguugaccagcggcucggauccgagcugggcugcuacaccauaaaccgcgucaagagcuuuaaacucugcgaaaacuccgccacgggaaagacgugcgagaucgacuccacccccgugaagugccggcagggguucugccugaaaaucacgcaggaaggccgcgggcacgugaagcugucccgaggcuccgaggucgugcucgacgcgugcgacuccagcugcgagaucaugauccccaaggggacgggcgacauccugguggauugcuccggcgggcagcagcacuuucugaaagacaaucucauagaccugggcugcccccauaucccgcugcucgggaaaauggcgaucuacaucugccgcaugagcaaccacccccgcaccaccauggccuucuuauuuugguucuccuucggcuacgucauuaccugcaucuucugcaaggcccuguucuauagccugaucaucaucggcacucuagggaagaagaucaagcaguaccgcgagcuaaaaccccagaccugcaccaucugcgaaaccgcgcccgugaacgcgaucgacgccgagaugcacgaccucaacugcuccuacaacaucugcccguacugcgcaagccggcuuacguccgacggccuggccagacacgugacucagugccccaagcggaaggaaaaggucgaggaaaccgagcucuaccugaaccuggagcgaauccccuggaucgugcggaagcuccuccaggugagugaguccaccgggguugcucuaaagcgcuguagcuggcugaucgugcuguuggugcuacugacagucagccugucccccgugcagagcgccccgguuggccacgggaaaaccaucgagaccuaccagacccgggagggauucacgaacaucugucucuucaugcugggauccauccuguucaucgucucgugccucgugaaggggcugguggacuccgucagcgacuccuucuuccccggccugaguguuugcaagaccugcaguaucggaucgaucaacggcuucgagaucgaaucgcacaagugcuacugcagccucuucugcugcccguacugucgccacugcuccgccgaccgggagauccaccagcugcaccuggggaucugcaagaagcgcaagaccggcucuaacgugaugcucgccgucugcaagcggaugugcuucaaggccaccaucgaggcgucgcgccgggcccuccugauccgcucuaucaucaauacgaccuucgugaucugcauccucacccuggcaaucugcgucguauccacaagugccguggagauggagaaccugcccgccggcacgugggagcgcgaggaggaccucaccaacuucugccaucaggaaugccagguaacugagaccgagugccucugcccguaugaggcgcuggugcugcggaagccccucuuccuggacuccaucgugaaagggaugaagaacuuacuaaacagcacgagccuggagaccucccugagcaucgaggccccuuggggagccaucaacguccagucuaccuucaagcccaccguuagcaccgccaacaucgcccucuccuggagcuccguggagcaccgcgggaacaagauccuggucacgggccggagcgaguccaucaugaagcuggaggaacgcaccggggugagcugggaccucggcguggaggacgcguccgagagcaagcugcugaccgucucaaucauggaucucagccagauguacuccccgguguuugaguaccuaagcggcgaccgccagguggaggaguggcccaaggcuaccugcacaggggacugccccgagcggugcggcuguaccuccagcacgugccugcacaaggaguggccccacagucggaacuggcgcugcaacccgaccuggugcuggggcgucgggaccggcuguacgugcuguggcguggacgugaaggaccucuucaccgaccacauguuuaucaaguggaaagucgaguacauaaagaccgaggccauugugugcguggaacugaccucccaggagcgacaguguagccugaucgaagccggcacccgguucaaccucgggccuguaaccaucacccuguccgagccccggaacauccaacagaagcugccgccggagauuauaacgcuucaccccaagaucgaggagggcuucuucgaucugaugcacgugcagaaggugcugucugccuccaccgucugcaagcuccaaagcugcacccacgggauccccggcgaccuccagaucuaccauaucggcaaucugcucaaaggggacaggcugaacggucaccugauccacaagaucgagccucauuuuaacaccuccuggaugagcugggacgggugcgaccucgacuacuacugcaauaugggcgacuggccaucuuguacguauacaggggugacccagcacaaccacgcagccuucgugaaccugcugaacauagagaccgacuacacgaaaaccuuccacuuccacagcaagcggguaaccgcucacggcgacacgccccagcucgaccugaaggcccgccccaccuacggcgcgggggagauaacggugcugguggaagucgccgacauggagcuccacaccaagaagguggagguguccggccugaaguucgccagccuggccugcaccgggugcuacgccugcuccagcggcaucuccugcaaggucagaauccauguggaugagccggacgagcucacggugcacgugaaaagcuccgaccccgacgugguggcggcaucaaccucccugauggcccgcaagcuggaguucggaaccgacagcaccuucaaagccuucagcgccaugcccaagacuucccuaugcuucuacauaguggagcgggaguacugcaagagcugcucagaggacgauaccaagaagugcguagacaccaaacuggagcaaccccagagcauucugaucgagcacaagggcaccaucaucggcaagcagaacgauacguguaccgcuaaggcuuccugcuggcucgaaagcgugaagucuuucuucuacggccuaaagaacaugcugggcagcguuuucgggaacuucuucgugggcauucuccuguuccuggccccauucgugcuucugguccuguucuucaucuuuggguggaagauccucuucugcuucaagugcugccggcggacccgcggcuuguucaaguaccgccaccugaaggacgacgaagagaccggcuaccgcaagauaaucgagagguugaauaguaagaaggggaagaaccggcugcuggacggcgagcgccucgccgaccggaagaucgcugagcuguucucgaccaagacgcacaucggg

SEQ ID NO: 15463 - RNA, 3495 nt, Artificial Sequence
  derived and/or modified CDS sequence (opt11) from CCHVF(CCHVF Ast149)__KX056054.1__Gn-NSm-Gc
agcgaggaaccaggcgaugacugcauaucccgcacccagcugcugaagaccgagacggcagagauccacgacgacaacuacgguggaccgggggacaagaucaccaucugcaacggcagcaccaucguggaucagagauuaggguccgaguugggcugcuacaccaucaaccgcgucaagagcuucaagcucugugaaaacuccgccacgggcaagaccugcgagaucgacagcacccccgugaagugucggcagggcuucugcuuaaagaucacccaggagggacgcggacacgugaaacuuucgcggggcagcgaggucgugcucgacgcuugcgacaguucuugugagaucaugauccccaaggggacgggcgacauccuuguggacugcagcggagggcagcagcacuuccugaaagacaaccugaucgaccugggcugcccgcacaucccacuucugggaaagauggcaaucuacaucugccgcaugagcaaccacccccggaccaccauggccuuccuguucugguucuccuucggcuacgucaucacgugcaucuucugcaaagcccuguucuauagccucaucauuaucggcacccuggggaagaagauaaagcaguaccgcgagcugaagccccagacaugcacuaucugcgagaccgcgcccgugaacgcgaucgacgccgagaugcacgaccucaacugcuccuacaacaucugcccguauugcgcaagccggcugacgagcgacggccuggcgaggcacgucacgcagugccccaaacgaaaggagaaggucgaggagaccgagcucuaccugaaccuggagcgcauaccuuggaucgugcggaagcugcuccaggugagcgaauccacaggagucgcgcugaagcgcagcagcuggcucaucguguugcuggugcuccugacggucucccugucccccguccaguccgcuccgguaggccacgggaagaccaucgagaccuaccagacucgggagggauuuacgaacauuugccuguucauguugggcucgauccuguucaucgucuccugucucgugaagggccugguugacagcgucucugacagcuucuuccccgguuuguccgugugcaagaccugcucuaucgguagcaucaacggcuucgaaauagaaagccacaaaugcuacugcuccuuguucugcugucccuacugucgccacugcucugcagacagagagauccaccagcugcaccuggggaucugcaagaagcgaaagaccggcuccaacgugaugcuugccgugugcaagcggaugugcuuuaaggcgaccauugaggcuagccgccgggcccugcccaucagaaguaucauuaacacgacuuuugugauuugcauccuuacccucgccauaugcgucgugagcaccuccgcaguggagauggagaaucugccggccgguacgugggagcgcgaggaagaccugaccaacuucugucaccaggagugccaggugaccgagaccgagugucucugccccuacgaggcacuggugcugagaaagccccuguuccucgacagcaucgugaaggggaugaaaaaccuccugaacagcacgucccucgaaacgucgcugaguauagaagcccccuggggcgccauuaacguccaaagcaccuucaagccgaccguguccaccgccaacaucgcccugaguugguccagcguggagcaccgcgggaacaagauccucgucacgggccggucugagagcaucaugaaguuggaggagcgcaccggugugaguugggaucugggugucgaggacgcuucugaauccaagcugcugaccgucaguaucauggaccugucccagauguacagccccguguucgaguaccucuccggugacaggcaaguggaggaauggcccaaggcgaccugcacgggggacugucccgaaaggugcggcugcaccagcagcacgugucugcacaaggaguggccgcauucccggaacuggcgcugcaacccgaccuggugcuggggcgucgggaccgggugcacaugcugugggguggacgugaaggaucuguucaccgaccacauguucaucaaguggaaggucgaauacauaaagaccgaagcgauagugugcguagagcucaccagucaggaacggcagugcucccugaucgaggccggcacccgcuucaaccuggggccugucaccauaacccucagcgagccccggaauauccagcagaaguuaccgcccgagaucauaacacugcacccaaagaucgaggagggauucuucgaccucaugcacgugcaaaaaguguugucggcaucaaccgugugcaagcugcaaaguugcacccacgggauccccggcgaccuccagaucuaucacaucggcaaccugcuuaaaggcgaccgccucaacggccaucugauccacaagaucgagccccauuucaacaccagcuggauguccugggacgggugcgaccuggacuauuacugcaacaugggcgacuggcccagcugcacguauacuggggugacgcagcacaaccacgccgccuucgugaaccuccuaaacaucgagaccgacuacaccaagaccuuccacuuccacaguaagcgagucaccgcccacggggacacgccccagcuggaccucaaggcccgcccaaccuauggcgcgggggagaucacggugcugguugaggucgcagacauggagcugcauaccaagaaaguggaggugagcggacuuaaguucgccucccuggcgugcacgggguguuacgcuugcagcuccggcaucagcugcaaaguccgaauccacguggacgagcccgacgaacugaccguucacgucaaaucuagcgaccccgaugugguggcggccuccaccagccucauggcacggaagcuggaguucgggaccgacagcaccuucaaggccuucuccgcuaugcccaagacgagccugugcuucuacaucgucgagcgggaguacugcaaguccugcagcgaagaugacacuaagaagugcguggacaccaagcucgaacagccgcaaucuauccugaucgagcacaagggcaccaucaucggcaaacagaacgacacguguaccgcgaaggccagcugcuggcuggaguccguuaagagcuucuuuuacgggcucaaaaacaugcugggcagcguguucgggaacuucuucguggggauccuccuguuccuggccccguucgugcugcucgcccuguucuucauauucggguggaagauccuguucugcuucaagugcugccggcgcacccgcggccucuucaaguauaggcaccugaaggacgacgaggagaccggcuacaggaagaucaucgagcgccugaacagcaagaaggggaagaaccggcuccuggacggcgagcgccuggccgaccggaagauagcggaguuguucuccacuaagacgcauaucgga

SEQ ID NO: 15464 - RNA, 3495 nt, Artificial Sequence
  derived and/or modified CDS sequence (opt11) from CCHVF(CCHVF Ast137)__KX056057.1__Gn-NSm-Gc
agcgaggagcccggcgacgacugcaucucccgcacgcagcugcucaagaccgagacggccgagauccacgaugacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucguacucgacgcgugcgacuccagcugcgagaucaugauccccaaggggacgggcgacauccugguggacugcuccggcgggcaacagcacuuccugaaggacaaccucaucgaccugggcugcccacacaucccgcugcucgggaagauggccauccacaucugccgcaugagcaaccacccccggacuaccauggccuuccuguucugguucuccuucggcuaugucaucacgugcaucuuuugcaaggcccuguucuacagccucaucaucaucggcacccugggcaagaagaucaagcaguaccgcgagcugaagccccagaccugcaccaucugcgagaccgcacccgugaacgcgauagacgccgagaugcacgaccucaacugcucguacaacaucugcccguacugcgccagccgguugacguccgacggccuggcccgccacgugacccagugccccaagcggaaggagaaagucgaggagaccgagcucuaccugaaccuggagcgcauccccuggauugugcggaagcuccuccaggugucagaguccaccggggucgcgcuuaagcgcagcagcuggcugaucgugcugcuggugcugcugacggucucccugagccccgugcaguccgccccggugggccacgggaagaccaucgagaccuaccagacacgggaaggcuucacgaacaucugccucuuuaugcugggcagcauccucuucaucgucuccuaccucgugaaggggcugguggacagcgucuccgacagcuucuuccccggccuguccgugugcaagaccugcaguaucggguccaucaacggcuucgagaucgagagccacaagugcuacugcucccucuucugcugccccuacugccgccacugcagcgccgaccgggagauccaccagcugcaucuggggaucuguaagaaacgcaagacuggcuccaacgugaugcucgccgucugcaagcggaugugcuucaaggcaaccaucgaggcgagccgccgggcccugcugauccgcuccauaaucaacacgaccuucgugaucugcauccucacacuggccaucugcgucgugucaaccuccgccguggagauggagaaccugcccgccggcacgugggagcgcgaggaggaccucaccaacuucugccaccaggagugccaggucaccgagaccgagugucugugcccguacgaggcgcuggugcugcggaagccccucuuccuggacagcauagucaaggggacgaagaaucugcucaacagcaccucccuggagaccagccuguccaucgaggcccccuggggcgccaucaacguccagagcaccuucaagcccaccguguccacggccaacaucgcacucagcugguccaguguggagcaccgcgggaacaagauccuggucaccggccgguccgagagcaucaugaagcuggaggaacguaccgggguaaguugggaccucggcguggaggacgcgagcgaguccaagcugcugaccgucagcaucauggaccucucccagauguacagcccgguguucgaguaccuguccggugaccggcagguagaggaguggcccaaggccacguguaccggggauugcccagaacggugcggcugcaccagcagcacuugccugcacaaggaguggccccacucccggaacuggcgcugcaacccgaccuggugcuggggagucgggaccggcugcacgugcugcgggguggacgugaaggaccucuucaccgaccacauguucaucaaguggaaggucgaguacaucaagaccgaggccaucgugugcguggagcugaccagccaggagcggcagugcucccugaucgaggccggcacccgcuucaaccucgggcccgucaccaucacgcugagcgagccccggaacauccagcagaagcugcccccggagauaaucacccuccaccccaagaucgaggagggcuucuucgaccuuaugcacgugcagaaggugcuguccgccagcaccgucugcaagcuccaguccugcacccacgggauccccggcgaccugcagauuuaccauaucggcaaccugcucaagggggaccgccugaacggccaccugauccacaagaucgagccgcacuucaacacgagcuggauguccugggacgggugcgaccucgacuacuacuguaacaugggcgacuggccaagcugcacauacaccggggugacccagcacaaccacgcggccuucguuaaccugcugaacaucgagacggacuacaccaagaccuuccacuuccacuccaagcgggucaccgcccacggcgacacgccccagcucgaccugaaggcccgccccaccuacggcgcgggugagaucaccgugcugguggaggucgccgacauggaguuacauaccaagaagguggaggugagcggccugaaguucgccucacuggccugcacggggugcuacgccugcagcuccggcaucagcugcaagguccggauucacgucgacgagccggacgagcucaccgugcacgucaaguccagcgacccagacgugguggcugccuccaccagccugauggcccgcaagcuggaguucgggaccgacagcacguucaaggccuucuccgccaugcccaaaaccucccucugcuucuacaucgucgagcgggaguacugcaaguccugcagcgaggacgacaccaagaaaugcguggacaccaagcuggagcagccccaguccauccugaucgagcacaagggcaccauaaucggcaagcagaacgacacgugcaccgcgaaggccagcugcuggcucgaguccgucaagagcuucuucuacgggcugaagaacaugcugggcuccguguucgggaauuucuucgugggcauccuacuguuucuagccccguucgugcuccugguccuguucuucaucuucggguggaagauccucuucugcuucaagugcugccgccggacccgcggccuguucaaguacaggcaccugaaggacgacgaggagaccggcuaccggaagaucaucgagcgccucaacagcaaaaaggggaagaaccgccugcuggacggcgagcgccucgccgaccggaagaucgccgagcuguucuccacgaagacccacauaggg

SEQ ID NO: 15465 - RNA, 3495 nt, Artificial Sequence
  derived and/or modified CDS sequence (opt11) from CCHVF(CCHVF Ast133)__KX056060.1__Gn-NSm-Gc
agcgaggagccagacgacgauugcauuucccgcacccagcugcucaaaaccgagacggccgaaauccacgacgacaacuacggcgggccgggcgacaagaucaccaucugcaacgggagcaccaucguggaccagagacugggcucggagcucgggugcuacaccaucaaccgcgucaagagcuucaagcucugcgagaacuccgccacgggcaagaccugcgagaucgacagcaccccagugaaaugccggcagggcuucugccugaagaucacccaggaggggcguggucacgugaagcucucccgggguagcgaggucgugcucgaugcgugcgauuccagcugcgagaucaugaucccgaagggcacgggggacauccugguggacugcuccggcggccagcagcauuuccugaaggacaaccucaucgaccuggggugcccccacaucccgcugcuuggcaagauggccaucuacaucugucgcaugagcaaccacccccggacaaccauggccuuccuguucugguucuccuucggguaugucaucacgugcaucuucugcaaggcccuuuucuaccuccugaucaucaucggcacccugggcaagaagauuaaacaguaccgcgagcucaagccccagaccuguaccaucugcgagaccgcccccgugaacgccaucgacgccgagaugcacgaccugaacugcagcuauaacaucugcccguacugcgccucccggcugacgagcgacgggcuggcaaggcacgugacccagugcccuaagcggaaggagaaggucgaggaaaccgagcucuaccugaaccucgagcgcauucccuggaucgugagaaagcugcuccagguguccgagagcaccggcgucgcgcucaagcgcuccagcuggcugaucgugcuguuggugcugcugacggucucucucuccccagugcagagcgccccgguggggcacggcaagaccauugagaccuaccagacccgggagggguucacguccaucugccuguucaugcugggauccauccucuucaucgucuccugccuggucaagggccugguggacucagucuccgacucuuucuuccccgggcucuccgugugcaagacuugcagcaucgguuccaucaacggguucgagaucgaaagccacaagugcuacugcucccuguucuguugucccuacugccgccauuguucugccgaccgggagauucaccagcugcaccucuccaucugcaagaagaggaagaccggcucuaacgugaugcuggccgucugcaaacggaugugcuucaaggccaccaucgaggcgucccgccgcgcccugcucauccgcagcaucaucaacacgaccuucgugaugugcauccugacccuggcuaucugcgucguguccaccagcgccguggagauggaggaccuuccggccgggacgugggagcgcgaggaggaccugaccaacuucugccaccaagagugccaggucaccgagaccgagugucugugcccguacgaggcgcuggugcuacgcaagccccuguucagcgacuccaucgugaagggcaugaagaaccugcucaauagcacgucccuggagaccagccuguccaucgaggcccccuggggagccaucaacguacagucaaccuucaagcccaccguguccaccgccaacaucgcucucagcugguccagcguggagcaccgcgggaacaagauccuggugacgggccgguccgagagcaucaugaagcucgaggagcgcaccgguguguccugggaccucgggguggaggacgcaagcgaguccaaacugcugaccgucagcaucauggaccucucucagauguacagcccgguguucgaguaccugagcggggaccgccagguggaggaguggcccaaggcgaccugcacgggggacugccccgagcgaugcgggugcaccuccagcacgugccugcacaaggaguggccccacucucggaacuggcgcugcaacccgaccuggugcuggggcgucgggaccggaugcacguguugcggcguggacgugaaggacuuguucaccgaccacauguucaucaaguggaaggucgaguacaucaagacagaggccaucgugugcguggagcugacaucccaagaacgccaguguucccugaucgaggccggcacgcgcuucaaccucgggcccgucaccaucacgcugagcgagccucggaauauccagcagaagcugcccccggaaaucaucacgcuacacccgaagaucgaggagggguucuucgaccucaugcacguacagaaggugcuguccgccagcacagucugcaagcuccaguccugcacccaugggauccccggcgaccugcagaucuaccacaucgggaaccugcucaagggcgaccgcgugaacggccaccugauccacaagaucgagccgcacuucaacaccagcuggauguccugggacgggugcgaccuggacuacuacugcaauaugggcgacuggcccagcuguacguacaccggggugacccagcauaaccacgccgccuucguaaaccuccugaacaucgagaccgacuacaccaagaccuuccacuuccacuccaagagggugaccgcccacggcgacacgccccagcuggaccucaaagcccgccccaccuacggggcgggcgagauaaccgugcuugucgagguggccgacauggaguugcacaccaagaagguggagaucagcggccucaaguucgccucccugaccugcacggggugcuacgccugcagcuccggcaucagcugcaagguccggauccacguggacgagccggacgagcuaaccgugcacgucaaguccagcgaccccgacgucguggccgcgagcacaucucucauggcccggaaacuggaguucgggaccgacagcacguucaaggccuucuccgccaugcccaagaccagccugugcuucuauaucgucgagcgggaguacugcaaauccugcagcgaagacgacaccaagaagugcguugacaccaagcucgagcagccccaguccauccugauagagcacaagggcaccaucaucgggaagcagaacgacacgugcaccgccaaggcgagcuguuggcuggaguccgucaagagcuucuucuacggccucaaaaacaugcugggcuccguguucgggagcuucuucgugggcauccuccuguuccuggccccguuuguguugcucguccuuuucuucauguucggguggaagauccuguucugcuucaagugcugccgcaggacccgcggccucuuuaaguaccgccaccugaaggacgacgaggagaccgguuaccggcgcaucaucgagcggcugaacuccaagaagggcaaaaaccgccuccuggacggggagcggcuggccgaccgcaagaucgccgaacuguucagcuccaagacccacaucggg

SEQ ID NO: 15466 - RNA, 3495 nt, Artificial Sequence; identical to SEQ ID NO: 12180
  derived and/or modified CDS sequence (opt11) from CCHVF(CCHVF SK/2015/human)__KX458183.1__Gn-NSm-Gc

SEQ ID NO: 15467 - RNA, 3495 nt, Artificial Sequence
  derived and/or modified CDS sequence (opt11) from CCHVF(CCHVF YL16070)__KY354081.1__Gn-NSm-Gc
gcugagggugggagcuccgacugcaucagccgcacccagcuggugaagaccgaggucgccgagauccacgaggacuccuacggcgggcccggggagaagaucacgaucugcaacgggagcaccaucguggaccagcggcucggcuccgagcugggcugcuacaccaucaaccgcgucaagagcuacaagcugugcgagaacuccgcgagcgggaaguccugcgagaucgacagcaucccggugaagugcaagcagggcuucugccucaagaucacccaggaggggcggggccacgugaagcugucccgcgggacggagaucguccuggacgucugcgacagcuccugcgagcucaugauucccaagggcaccggcgacauccugguggacugcagcgggggccagcagcacuuccugcagaacaaucucaucgaccuggggugccccaacgugccccugcucggcaagauggccaucuacgucugccggauguccaaccacccgaagaccaccauggccuuccuguucugguucagcuucggguacgugaucacgugcaucgucugccgcguccuguucuaucuccugaucgccaucgggaccgugggcaagaagcugaagcaguaccgggagcuuaagccccagaccugcaucgugugcgaguccguacccgugaaugccaucgacgcggagaugcacgaguugaacugcagcuacaacaucugccccuacugcgccucccgccuaagcaccgacgggcucauccggcacgugacgcagugcccuaagcgccgggagaaggucgaggagaccgagcuguuccugaaccucgagcgcauccccuggcugguucggaagcugcuccaggugagcgaguccaccggcauggcccugaagcgcagcugcuggaugaucacccugcucauccugcugcucgucucaaugagccccgugcaguccgcccccguggggaaggagagagcgaucgaaacguaccaggcccgcgaggccuacaccggcaucugccuguucguccugggcagcguacucuucgccguguccuggcucaccaaggcccugaucgacgggaucggcaacagcuucuucccggggcucuccgugugcaagaccugcagcaucggcuccaucaacggguucgagaucgagagccacaagugcuacugcucccuguucugcugccccuacugccgggcgugcagcuccgacaagaacacgcaccgcaugcaccugaacgugugcaagaagcggaagauggguagcaacgucaugcucgcggugugcaagcgcaugugcuuccgggccaccaucgaggccuccaacaaggcccugcugauccgcagcaucaucaacuccaccuucgugauaugcauccuuauccugaccaucugcgucgugagcacgagcgcgguggacauggagaaccugccugccggcaucugggagaaggaggaggaccucaccaauuucugccaccaggagugccagguaaccgagaccgagugccugugccccuacgaggccauggugcugcgaaagccgcuuuuccucgacuccaucgccaaggggaugaaaagccugcugaacuccacgagccucgagaccucccugagcaucgaggcccccuggggcgcgaucaacgugcagaguaccuucaagcccaccgucuccgccgccaacaucgcccuguccuggagcuccguggagcaccgggggaacaagauccucgugagcggccgcuccgagagcaucaugaagcuggaggaacggacuggggucuccuggaaccugggcguggaggacgccagcgaguccaagacccucaccgugagcgucauggaccugagccagauguacuccccaguguucgaguaccugagcggcgaccgccagguggaggaguggccgaaggcgaccugcacgggggacugccccgagcggugcggcugcaccucaagcacgugccuccacaaggaguggccccacagccgcaacuggcggugcaacccaaccuggugcuggggcgucgggaccggcugcacgugcugcgggcuggacgugaaggacuucuucaccgacuacaugcuggugaaguggaaggucgaguacaucaagaccgaggccaucgucugcguggagcucaccagccaggagcgccagugcucccugaucgaggcaggcacgcgguucaaccuggggccggucaccaucacccucuccgagccccgcaacgugcagcagcggcugccgcccgagaucgugacccugcaccccaagaucgaggagggcuucuucgaccucaugcacguccagaagauccuguccgccagcacggugugcaagcugcaguccugcacccacgggguucccggcgacuuucaggucuaccacgugggcaaucuccugcgcggggacaaggugaacggccacagcauccacaagaucgaaccacacuucaacaccuccuggaugagcugggacgggugcgacuuggacuacuucugcaacaugggcgacuggccguccugcaccuacacgggugucacccagcacaaccgggcggccuucaucaacaugcucaacaucgagaccgacuacaccaagacguuccacuuccacagcaagcgcgugaccgcccacggcgacacgccccagcuggaccugaaggcccggcccgccuacggcgcgggggaggugaccguauuaguggagguggccgaccuggagcugcacaccaagaagcucgaggucuccggccugaagaucgccagccugaccugcuccggguguuacgccugcagcagcggcaucuccuguaaggugcgcauccacgugaacgagcccgacgaguucaccguccacgugcggagcuccgacccggacguggucgccgcggggagcucccucauggcccgcaagaucgaguucggcgccgacaguaccuucaaggccuucuccagcaugcccaaggacagccugugcuucuacaucguggagaaggacuacugcagcucaugcacggacgacgacacccaaaagugcgugaacaccaagcuggaccacccccagagcauccucaucgagcacaagggcaccauaaucgggaagcagaacgacacgugcuccaccaagaccagcugcuggcugaaguccuucaagggcuucuucuacgggcugaagaacaugcucagcggcauuuucgggaacgucuuccugggcauccuccuguucuuagcccccuucgugcugcucaucuucuucuucuucuucggcuggcggcugcuguucugccucaagugcugcaagaagaccaaggggcugcugaaguacaagcaccucaaggacaaggaggaggcgggcuacaagaagaucaucgagcgccugaacgggaagaagggcaagucccagcuguucgacggcgagcgccucgccaaccggaagaucgccgagcuguucagcacgaagauccacaucggg

SEQ ID NO: 15468 - RNA, 3495 nt, Artificial Sequence
  derived and/or modified CDS sequence (opt11) from CCHVF(CCHVF Oman_812956)__KY362518.1__Gn-NSm-Gc
agcgaggaguccggcgaggacuguaucagccgcacccagcugcuccggaccgagacggcagagauccacggggacaacuacggcgggcccggugacaagaucaccaucugcaacgguuccaccaucguggaccagcgccugggcagcgagcugggcugcuacaccaucaaccgggucaagucauucaagcucugcgagaacagcgccacggggaaguccugcgagaucgacaacaccccggugaagugcaagcagggcuucugccugaagaucacccaggaggggcguggccacgugaagcugagccgggacuccgagguaguucucgaugcgugcgacagcuccugcgagaucaugauccccaaggggaccggcgacauccugguggacugcagcggcgggcagcagcacuuccugaaggacaaccucaucgaccuaggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccaaaccugcaccaucugcgagaccacccccgugaacgccaucgacgccgagaugcacgaccugaacugcuccuacaacaucugccccuacugcgcgagccgccugacguccgacggccucgcccggcacgugaugcagugccccaagaggaaggagaagaucgaggagaccgagcuguaccugaaucucgagcggauccccugggucgugcgcaagcugcuccaggugagcgaguccaccggggucgcccucaagcggagcagcuggcugaucgugcugcucgugcugcugaccgucucccucagccccgugcaauccgcccccaucggccacgggaagacgauugagaccuaccagacccgcgagggcuacaccagcaucugccuguucgugcugggcuccauccucuucaucgucagccaccugaugaaggggcugguggacuccgugggcaauagcuucuucccagggcucuccaucugcaagacgugcagcauaggcuccaucaacggguucgagaucgagagccacaagugcuauugcucccuguucugcugccccuacugccggcacugcagcgcggacaaggagauccacaagcugcaccucuccaucugcaagaagcgcaaggccggaagcaacgucaugcuggccgugugcaagcggauguguuuccgcgccaccauggaggucuccaacaaggcccugcucauacgcagcgugaucaacaccaccuucguggucugcauccugauccuggcugugugcguggucuccaccagcgccguggagauggagagccuccccgccggcaccugggagcgcgaggaggaccugacgaacuucugccaccaggagugccaggugaccgagacggagugccugugccccuacgaggcccuaguccuccggaagccguuguucuucgacuccaucgccaaggggaugaagaaccugcucaacagcacaucccuggagaccagccuguccaucgaggcgcccuggggagccaucaacgugcagagcaccuucaagcccacgguguccaccgccaauauagcccucagcugguccagcgucgagcaccgcgggaacaagauccugguguccggccgcagcgaguccaucaugaagcuggaggagcggaccgggaucagcugggaccucggcguggaggaugccuccgagagcaagcugcugaccgucuccguaauggaccucagccagauguacagccccguguucgaguaccuguccggcgaccgccaggucgaggaguggccgaaggcgaccugcacgggggacugcccggagcggugcggcugcaccagcuccacgugccugcacaaagaguggccccacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcguugagcugaccucccaggagcgccagugcagccucaucgaggccggcacccgguucaaccucgggcccguaaccaucacccuguccgagccccgcaacauccagcagaagcuaccgcccgagaucgugacgcugcacccccggaucgaggagggcuucuucgaccugaugcacguccagaaggugcucagcgccuccaccgugugcaagcugcagagcugcacccacgggguccccggcgacuuacagguguaccacaucggcaaccugcugaagggggacaaggugaacggccaccugauccauaaggucgagccccacuucaauaccuccuggaugagcugggacgggugcgaccucgacuacuacugcaacaugggcgauuggccgucuugcacguacaccggggugacccagcacaaccacgccgcguucgugaacuuacugaacauugagaccgacuacacgaagaacuuccacuuccacagcaagcgagucaccgcccacggcgacacgccccagcucgaccugaaggcccggcccaacuacggcgccggggaaaucaccgugcugguggaggucgcggacauggagcuccacaccaagaaaaucgagaucuccggccugaaguucgccagccugaccugcaccgggugcuacgccuguuccagcggcaucuccugcaaggugcgcauccacgucgacgagcccgaugagcucaccguccacgucaagagcgaggacccggacaucguggccgcgagcuccagccugauggcgcggaagcuggaguucgggacggacuccaccuucaaggccuucagcgccaugcccaagaccucccucugcuucuacaucguggagcgcgaguacugcaagagcugcuccaaagaggacacccagaagugcgugaacgccaagcuggagagaccccagagcauccugaucgagcacaagggcacgaucaucggcaagcagaacgacacgugcaccgccaaggcguccuguuggcucgagagcgugaaguccuucuucuacggccugaagaacaugcugagcggcaucuucgggaacgucuucaucggcaucuuccucuuccuggcgcccuucauccugcucaucuuguucuucauguucggguggcgcauccuguucugcuucaagugcugccggcgcacccggggccucuucaaguaccgccaccugaaggacgacgaggagaccggcuaccgcaagauaaucgagcggcugaacaacaagaaggggaagaacaagcuccuggacggcgagcgccuggccgaccggaagaucgccgagcuguucuccaccaagacccacaucggg

SEQ ID NO: 15469 - RNA, 3495 nt, Artificial Sequence
  derived and/or modified CDS sequence (opt11) from CCHVF(CCHVF UCCR4405)__KY484029.1__Gn-NSm-Gc
uccgaagaacccggcgacgacugcauaucucgcacccaacuccugaaaaccgaaaccgcugaaauacaugacgacaacuacggagggccaggagauaaaauuacuaucugcaacggaagcacaauuguggaccaacgccuaggcucggaacucggcugcuacacaauaaaccgcguaaaauccuucaaacucugcgaaaacuccgcaacaggcaaaacaugcgaaaucgacuccacgccgguuaagugccggcaaggcuuuugucucaaaaucacccaggagggccgcggccauguaaaacuaucccguggcagcgaagucguccuagacgcuugugacucuagcugcgaggugaugauuccuaaagggacaggagauauccuaguggacugcuccggcgggcaacaacacuuccucaaagacaaccuuauagaccuagggugcccgcacauaccacuccugggcaaaauggcaaucuacaucugccgaaugagcaaccacccucgcacuaccauggccuuccuauucugguucagcuucggauacguaaucaccuguaucuuuugcaaagcccuuuucuacagccuaaucauaauaggcacccuaggaaagaaaaucaaacaauacagggaacuaaaaccccaaacaugcaccaucugcgaaacagcaccagugaaugccauagaugccgaaaugcacgaucugaaaugcuccuacaacaucugcccauacugcgcuucccgacucacgagugacggacuugcacgccacgucacacaaugcccaaaacgaaaagagaaaguagaagaaacagaauuauaucuaaaucuagaacgaauacccuggauaguccgaaaacuacuccaaguaucagaauccacgggcguagcccucaagcgauccagcuggcucaucguccuccucguccugcuuaccgucucccugagcccugugcaguccgcccccgugggacacggaaaaacaaucgagacuuaccaaacaagagaaggcuuuaccucgauaugccucuucaugcucgguagcauccucuucaucguauccugccuaguaaagggacuggucgacuccgucucugacucuuucuuccccggucuauccguaugcaaaacuugcucuauaggaucgaucaacggauuugaaauugaaucccacaagugcuacuguagccuuuucugcugccccuacugccgucacuacuccgcagaccgggaaauccaccaacuccaccuuucaaucuguaagaaacgaaaaacuggguccaacgucaugcuagccgugugcaaaaggaugugcuucaaagcgaccauagaagcauccagacgagcccuacuaauaagauccauaauaaacacaaccuucgucaucugcauccugauacucgccaucugcguugucuccaccucagcagucgaaauggaaaaccuccccgcgggcaccugggagagagaagaagaucucacgaauuucugccaccaagagugucaagucaccgaaaccgaaugucuaugcccauacgaagcacucgugcuccgaaaaccucucuuccuugacucuaccguuaaaggcaugaaaaaucuacucaacucuaccucccucgagacuucgcuauccauugaagcacccuggggcgcaaucaacguccaaucgaccuucaagccaacagucuccacagcuaauaucgcacuauccuggucaucggucgaacaccgaggcaacaagauccuaguaacaggccggagcgaauccaucaugaaacucgaagaacggacuggcgugucaugggaccuaggaguggaagacgcaucggaaaguaaacuccucaccguguccauaauggaccugucccagauguauucacccguauucgaauaccucagcggcgaccggcaagucgaagaauggccgaaagcaacaugcacaggagacugccccgaaagaugcggaugcaccagcucgaccugccuccacaaagaauggccgcacucccgcaacuggcgaugcaauccaaccuggugcuggggaguaggcacuggcugcacuugcugcggcgucgacguaaaggaccuauucaccgaccacauguucguuaaauggaaagucgaauacaucaaaaccgaagccauaguuugugucgaacugaccucccaagaacgacaaugcucccucaucgaagcuggcacgagauucaaccuugggcccguaacaauuaccuuauccgaaccacgcaacauacaacaaaaacuaccacccgaaaucauaacccuacaccccaaaauagaagaaggcuucuucgaccuaaugcacguacagaaggugcucagcgccuccaccgucugcaaacuccaaagcugcacucacggcauccccggcgaccuccagauauaccacauagguaaccuguuaaaaggggacagaguaaacggccaucuuauucacaagaucgaaccccauuuuaacacaagcuggaugagcugggacgggugcgaccucgauuacuacugcaacaugggaaauuggcccucgugcaccuauacaggaguaacccaacacaaccacgcugcauucgucaacuuacucaacauagaaacagacuacacaaaaaccuuucacuuucacagcaaacgcgucaccgcacauggcgacacaccccagcucgaccuaaaagcucggccgaccuacggagccggggaaaucaccguccucguagaagucgccgacauggaacugcacaccaagaaagucgaaauaucggggcugaaauucgccucccugguauguacuggcugcuacgcaugcucaucugggaucagcugcaaaguccgaauccacgucgacgaaccagacgaacucacgguccacgucaaaagcuccgaccccgacgucgucgcagcauccacgagccucauggcccgcaaacuagaguucggcacggacaguaucuucaaagcauuuuccgcaaugccaaaaacaagccucugcuucuacauuguggaacgcgaauacugcaaauccugcucagaagacgacacaaagaaaugcgucgacaccaaacuagaacaaccacaauccauccuaaucgaacauaagggaaccaucauaggcaaacaaaaugacaccuguacagccaaggccucaugcuggcuagaauccguaaaaucuuucuucuacggucucaaaaacaugcucggaucaguauucggcaacuucuuugucggcauccuccuauuccuggcuccauucguccuucucguucucuucuuuauguuuggcuggaaaauccucuucugcuucaaaugcugccgucgaacacgcggacuauucaaguacagacaccucaaagacgacgaagagacuggcuaccgccggauuauagaacgccuuaacuccaagaaaggcaaaaacaggcuacucgacggcgagcggcuggccgacaggaaaaucgccgaacuuuucagcaccaaaacacauaucggu

SEQ ID NO: 15470 - RNA, 3495 nt, Artificial Sequence
  derived and/or modified CDS sequence (opt11) from CCHVF(CCHVF UCCR4459)__KY484032.1__Gn-NSm-Gc
agcgaggagagcggcgacgacugcaucagccgcacccagcugucccggaccgagacggccgaaauccacagcgacaacuacgggggacccggggacaagaucaccaucugcaacggcuccacuaucguggaccagcggcuuggaagcgagcugggcugcuacaccaucaaccggguaaaaucuuucaagcugugcgagaacagcgccacgggcaaguccugcgagaucgacagcaccccgauaaagugucgccagggguucugccucaaaaucacccaggagggccgggggcacgugaaguugucccggggcagcgaggugguccuggacgcgugcgacuccagcugugagaucaugauccccaagggaaccggcgacauccucguagacugcuccggcgggcagcagcacuuccugaaggacaaccugaucgaccucggcugucccaacaucccccugcuggggaagauggccaucuacauuugccgcaugagcaaccacccgaagacgaccauggccuuccucuucugguucuccuucggcuacgugaucacgugcauccugugcaaggucaucuucuaucugcucaucguggugggcacucuggggaagaaauucaagcaguacagggagcugaagccccagaccugcaccaucugcgagaccacccccgucaacgccaucgacgccgaaaugcacgaccucaacugcagcuacaacaucugccccuacugcgccucccggcugacgucggacggccuggcccgccacgugaugcagugcccgaagcguaaggagaagguggaggagaccgagcucuaccugaaccuggagcgcauccccuggguugugcggaaguuacuccagguguccgaguccaccggggucgcccugaagcgcaguuccuggcuuguggugcugcugguacuccugaccgugagccugucccccgugcagagcgcgcccaucggccacgggaagacggucgagaccuaccagaccagggagggcuacaccuccaucugccucuucgugcugggcagcauccuguucaucguguccugccuuaugaaggggcuggucgacagcgugggcaacucauucuucccggggcugagcauaugcaagacgugcucaaucggcagcaucaacggguucgagaucgagucccacaagugcuacuguagccuauucugcugccccuacugccggcacugcuccgcggaccgggagauccacaagcugcaccugagcaucugcaaaaagcgcaagaccggcuccaacguaaugcucgcaguuuguaagcgcaugugcuuccgcgccaccguggagguuagcaacaaggcccugcuuauccggaacaucaucaacaccacguucgugguaugcauccucauccuagccgucuguguggugagcaccuccgcggucgagauggagagccugcccgccggcaccugggaacgcgaggaagaccucaccaacuucugccaccaggagugccaggugacggagaccgagugccugugccccuaugaggcccugguacugcgcaagccccucuucuccgacucuaucgucaaggggaugaagaaccugcucaauuccaccagccuggagacaucccugagcaucgaggcccccuggggcgccaucaacgugcagucaacguucaagcccaccgugagcgcggccaacaucgcccuguccuggagcuccgucgagcaccgggggaacaagauccucgugagcggucgcuccgagucgaucaugaagcuggaggagcggaccgggaucuccugggaccugggcguggaggacgcgagcgagagcaagcuccugaccgucuccaucauggaccugagccagauguacagccccguguucgaguaccucagcggcgaccgccagguggaagaguggccgaaggcgaccugcacgggggacugccccgagcggugcggcugcaccuccagcacgugccugcacaaggaguggccccacucccgcaacuggcggugcaaccccacauggugcuggggcgucgggaccggcugcacgugcugcggacuggacgugaaggaccucuucaccgacuacauguucgugaaguggaaggucgaguacaucaaaaccgaggccaucgugugcguagagcugaccagccaggagcgucaaugcucccuuaucgaggccggcacucgguucaaccucgggccggucacaaucacccugagcgagcccagaaacauccaacagaaacugccgcccgagauagugacgcuccacccucggauugaggagggcuucuucgaccugaugcacgugaagaagguccuguccgcaagcaccguaugcaagcuccaauccugcacccauggggugcccggcgaucugcaggucuaucacauuggcaaccuuuugaagggagacaaggugaacggccaccugauccacaagaucgagccccacuucaacaccagcuggauguccugggacggcugcgaccuggacuacuacugcaacaugggugacuggccgagcugcuccuacacgggggugacccaacacaaccacgcggccuucguaaacaugcuaaacaucgagaccgacuacaccaagaucuuccacuuccacagcaagcgcgugacggcgcacggcgacacgccccagcuggaccugaaggcccggcccaccuacggcgccggagagaucaccguacucgucgagguggccgauauggagcugcacaccaagaagauagagaucuccggccugaaguucgcgagccugaccugcaccggguguuacgccugcucaucaggcaucagcugcaaggugcgcauacacgucgacgagcccgacgagcugaccgugcacgugaaguccgaagacccggacaucgucgccgccagcuccagccugauggcucggaagcucgaguucgggacggacaguaccuucaaggcguucagcgccaugcccaagaccucccugugcuucuacaucguggagcgcgaguacuguaagagcugcuccaaggaggacacccagaagugcgugaacacgaagcuggaacagccccagagcauucucaucgagcacaagggcaccaucaucggcaagcagaacgacacgugcaccuccaaggccgggugcuggcuggagagcgucaagucuuucuucuaugggcugaagaacauguugucugggauuuucggcaacguguucauugggaucuuccuguuccuagcccccuucauacuccugauccuguuuuucauguucggcuggagaauccucuuuugcuucaagugcugccgccggacgcguggccuguucaaguaucgccaccugaaggacgacgaggagaccggguaccggaagaucaucgagcgccucaacaacaagaagggcaagaacaagcugcuggacggggagcggcucgccgaccgcaagaucgcagaauuguucuccaccaagacccacaucggc

SEQ ID NO: 15471 - RNA, 3495 nt, Artificial Sequence
  derived and/or modified CDS sequence (opt11) from CCHVF(CCHVF UCCR4401)__KY484035.1__Gn-NSm-Gc
agcgaggagcccuccgacgacugcaucagccgcacccagcugcuccggaccgagacggccgagauccacggcgacaacuacgggggcccaggggacaagaucacuaucugcaauggcuccaccaucguggaccagcgccuggguagcgagcugggcugcuacaccaucaaccggguccgcuccuucaagcucugcgagaacagcgccacgggcaagaacugcgagaucgacuccgugcccgugaagugccggcaaggguacugccugcgcaucacccaggagggccgggggcacguaaagcugagcaggggcuccgagguggugcucgacgcaugcgacaccagcugcgaaaucaugauaccgaagggaaccggcgacauccuggucgacugcucgggcgggcagcaacacuuccugaaggacaaccucaucgaccugggcugccccaagaucccgcugcucgggaagauggccaucuacaucugccggaugagcaaccacccgaaaacgaccauggccuuccuguucugguucuccuucggcuacgugaucacguguaucuugugcaaggccaucuucuaccuccugaucaucgugggcacccuggggaagcgccucaagcaguaucgggagcugaaaccucagaccugcaccaucugcgagaccaccccugucaacgccauugacgcugaaaugcacgaucugaacuguagcuacaacaucugcccguacugcgccucccgccucaccagcgacggccuggcccggcacgugauccagugccccaagcgcaaggagaaaguggaggagacggagcuguaccucaaccuugagcggaucccaugggucgugcgcaagcugcuccagguguccgagagcaccggggucgcccugaaacggucgagcuggcugaucgugcuccugguacuguucaccgucagccucucccccgugcagucggcgccgaucggccaggggaagacgaucgaggccuaccgcgcccgcgagggcuacaccuccaucugccuguucgugcugggcagcauccucuucaucgucuccugccugaugaaagggcugguagacagcgugggcaacuccuucuucccugggcucagcaucugcaagaccugcuccauaagcuccaucaacggcuucgagauagagagccacaagugcuacugcucccuguuuuguugccccuacugccgccacugcagcaccgacaaggagauccacaagcugcaccucuccaucugcaagaagagaaagacggggagcaacgucauguuagccgugugcaagcugaugugcuuccgcgccaccauggaagucucgaaccgcgcgcuguuuauccggagcaucauaaacaccaccuucguccugugcauccugauccucgccgugugcguugugucuacgagcgccguugagauggagaaccugcccgccggcaccugggagcgcgaggaggaccugacaaacuucugccaccaggagugccaggucacagagacggagugccugugcccauacgaggcccucguacugcggaagccccuguuccucgacagcaccgcgaagggaaugaagaaccugcugaacuccaccagccucgagaccucccugaguaucgaggcccccuggggcgccaucaacgugcaguccacguacaagcccaccgucagcaccgccaacaucgcccuguccuggagcuccguggagcaccgcggcaacaagauccucgugagcgggcgguccgagagcaucaugaagcuggaggagcgcaccggcaucuccugggaucuuggggucgaggacgcgagcgaguccaagcuacugacagugagcgugauggaccugucccagauguacucaccgguauucgaguaccucagcggugaccgccagguggaagaguggcccaaggcuacgugcacgggcgacugccccgagcggugcgggugcaccuccagcacgugccugcauaaggaguggccucauucccggaacuggcgcugcaacccgaccuggugcuggggcguggggaccggcugcacgugcugcggccuggacgucaaggaccucuucaccgacuacauguucgugaaguggaagguggaguacaucaagaccgaggccaucgucugcguggagcuaaccagccaggagcggcagugcagucugauugaggccggaacccgcuucaaccucggcccagugaccauuacgcugagcgagccccggaacauccagcagaagcuacccccggagaucaucacccuccacccucgcaucgaagagggguucuucgaccuuaugcacguccagaaggugcuguccgccagcaccgugugcaagcuccaauccugcacccacggcguccccggugaccuccagguguaccacaucggcaaccugcucaagggcgauaaggugaacgggcaccugauccacaagaucgaaccgcacuucaacacgagcuggauguccugggacgggugcgaccuggacuacuacugcaacaugggggauuggccgagcugcaccuacaccggcgucacccagcacaaccacgcgaguuuugugaaccuccugaacaucgagacggacuacaccaagaacuuccacuuccacagcaagcgagugaccgcccacggggacacgccccaacuggaccucaaggcccgccccacauauggcgccggcgagaucaccguccugguggaggucgcggacauggaacugcacacgaagaagaucgagaucagugggcucaaguucgccagccuggccugcaccggcuguuacgccugcuccagcgggaucuccugcaagguccggauccacguggacgagccggaugagcucacggugcacgucaagagcgaugaccccgacgugguggccgcgagcuccagccucauggcccgcaagcuggaguucggcaccgacuccacguucaaggcauucagcgccaugcccaaaaccucccugugcuuuuacaucgucgagcgggagcacugcaagagcugcucggaggaggacacaaagaagugcgucaacaccaagcucgagcagccccagagcaucuugaucgagcacaaggggaccauuaucggcaagcaaaauagcacgugcacagccaaggcgagcugcuggcuggaguccgucaagagcuucuucuacggccucaagaacaugcugagcgggaucuucggcaacguguucauggggauuuuccuguuccucgcaccguucauccugcugauccucuucuucauguucggcuggcgcauccuguucugcuucaaguguugccgccgaacccgcgggcuguucaaguaccgccaccucaaggacgacgaggagaccggcuaccgccggaucaucgagaagcugaacaauaagaagggcaagaacaagcugcucgacggggagcgccuggcagaccggagaaucgccgaauuauuuagcaccaagacccacaucggc

SEQ ID NO: 15472 - RNA, 3495 nt, Artificial Sequence
  derived and/or modified CDS sequence (opt11) from CCHVF(CCHVF UCCR4448)__KY484042.1__Gn-NSm-Gc
agcgaggagacuuccgaugacugcaucagccgcacccagcugcuccggacggagaccgccgagauccacggcgauaacuacgggggccccggggacaagaucaccaucugcaacggcuccaccaucguggaccagcgccuggggagcgagcugggcugcuacacgaucaaccgggugaaguccuucaagcucugcgagaacagcgccaccggcaaguccugcgagaucgacagcgugccggugaagugccgccagggguacugccugcggaucacccaggaggggcgcgggcacgucaagcugucccggggcagcgagguugugcucgacgcgugcgauaccuccugcgagaucaugauccccaaggggacgggcgacauccuggucgacugcagcggcgggcagcagcacuuucuaaaggacaaccucaucgaccugggcugccccaagaucccccugcucgggaaaauggccaucuacaucugccgcauguccaaccacccgaagaccaccauggccuuccuguucugguucagcuucggcuacgugaucacgugcauccugugcaaggccaucuucuaccuccugaucaucauuggcacccuggggaagcgguucaagcaguaccgcgagcucaagccccagaccugcaccaucugcgagaccacgcccgugaacgccaucgacgcggagaugcacgaccugaacugcuccuacaacaucugccccuacugcgccagccggcugaccuccgacggccucgcccgccacgucacccagugcccgaagcgcaaggagaagguggaggagaccgagcuguaccugaaccucgagcgcauccccugggugguccggaagcugcuccaggugagcgaguccacggggguggcccucaagcgcagcagcuggcugaucguccuucucgugcuguucaccaucucccugagccccgugcaguccgcgcccaucagccacggcaagaccaucgaggccuaccgggcccgcgagggguacaccuccaucugcuuguuuguccugggcagcauccuguucaucguguccuaccucaugaagggccugguggacagcgucgggaacuccuucuucccgggccugagcaucugcaagacgugcuccaccagcuccaucaacggguucgagaucgagagccacaagugcuacugcucucucuuuugcugccccuacugccggcacugcagcgcggacaaggagauccacaagcugcaccuguccaucugcaagaagcgcaagaccggcagcaacgugaugcucgccgugugcaagcggaugugcuuccgcgcgaccauggaggucuccaaccgcgcccuguucauccggagcaucaucaacacgaccuucguguuaugcauccucauccuggccgucugcguggugagcaccuccgccgucgagauggagaaccugcccgccgggaccugggagcgcgaggaagaccucacgaacuucugucaccaggagugccaggugaccgagaccgagugccugugccccuacgaggcgcuggugcugcggaagccccucuuccuggacagcaucgucaaaggcaugaagaaccugcucaacuccaccagccuggagaccucccugagcaucgaggcacccuggggcgcuaucaacguacaguccaccuacaagcccaccgucuccaccgccaacaucgcccucuccuggagcuccgucgaacaccgcggaaacaagauccuggugagcggccgguccgagagcaucaugaagcuggaggagaagaccgggaucuccugggaccucggcguggaggacgcgagcgaguccaagcugcugacggucagcgugauggaccucagccagauguacucccccguguucgaguaccuguccggcgaccgccaggucgaagaguggccgaaggcgaccugcaccggugacugccccgagcggugcggcugcaccuccuccacgugccuucacaaggaguggccccacagccgcaacuggcggugcaaccccaccuggugcuggggcguggggaccgggugcacgugcugcggccucgacgugaaggaccuguucaccgacuacauguucgugaaguggaagguggaguacauuaaaaccgaggcaaucgugugcgucgagcugaccagucaggagcgccagugcucccucaucgaggccgggacccgguucaaccuggggccggugacgaucacccugagcgagccccgcaacauccagcagaagcucccgcccgagaucaucacccugcacccgcggaucgaggaaggcuucuucgaccugaugcacgugcagaagguccucuccgccagcaccgugugcaagcugcaguccugcacgcacggggugcccggcgaccugcaggucuaccacaucgggaaucuacugaagggcgacaaggugaacggccaccugauccacaagaucgaaccccacuucaacaccagcuggauguccugggacggcugcgaccucgauuacuauugcaacaugggcgacuggccgucgugcaccuacaccggggugacgcagcacaaccacgcuuccuucgucaaccugcugaacaucgagaccgacuacaccaagaacuuccacuuccacagcaagcgcgugaccgcccacggcgacacgccccaacucgaccugaaggccaggcccaccuacggggcaggcgagaucaccgugcuggucgagguggcggacauggagcuccacaccaagaagaucgagaucuccggccugaaguucgccagccuaacgugcacuggguguuacgcgugcuccagcggcaucagcugcaaggugcgcauccacgucgacgagcccgacgagcucaccgugcacgugaaguccgacgauccagacgucguggccgccagcuccagccugauggcgcggaagcuggaguucgggaccgacuccacguucaaggccuucagcgccaugcccaagaccucccucugcuucuacaucguggagcgagagcacugcaagagcugcuccgaggaggacaccaagaagugcgucaacaccaaacuggagcagccccagagcauacugaucgagcauaagggcacgaucaucgggaagcagaacuccacgugcaccgccaaggccagcugcuggcucgaguccgucaagagcuucuucuacggccugaagaacaugcuguccggcaucuucgggaacguguucaucggaaucuuccucuuccuggcgcccuucauccugcucauccuguucuucauguucggguggaagauccuguucugcuucaagugcugccggcgcacccgcggccucuucaaguaccggcaccugaaggacgacgaggagaccggguaccgccggaucaucgagcgccugaacaacaagaagggcaagaacaagcuccuggacggggagauccuggccgaccggcgcaucgccgagcuguucuccaccaagacccacaucggg

SEQ ID NO: 15473 - RNA, 3495 nt, Artificial Sequence
  derived and/or modified CDS sequence (opt11) from CCHVF(CCHVF SPU4/81 )__DQ157175.1__Gn-NSm-Gc
agcgaagaacccucugaugacuguaucagucgaacacaacuccuacgcacagaaaccgcagaaauacacggcgacaacuacggagggcccggcgacaaaauaacaauaugcaacggguccaccauaguugaccaacgccuggguagcgaacuagggugcuacacgauaaaccgcgucaaaucauucaagcuaugcgaaaacucagccacugguaaauccugcgaaauagagucaguacccgucaaaugucgacaaggcuauugccugcgcauaacacaagaaggucgaggacacgucaaacuaucacgcggauccgaagucguacucgacgcaugcgacaccagcugcgaaaucaugauacccaaaggcaccggagacaucuugguagacugcagcggcggccaacaacacuuccuaaaagacaaccuaaucgaccucgguugccccaaaaucccccuccucggcaagauggcaauuuacaucuguagaauguccaaucauccuaaaaccaccauggcguucuuguucugguucagcuuuggcuacgucaucacaugcauccucugcaaagccaucuucuaccuacuaauaauaauaggcacccugggcaagcgcuucaaacaguaucgugagcuaaaaccacaaaccugcaccauuugugaaaccaccccaguuaacgccauagacgcugaaaugcacgaccugaacugcucauacaacaucugcccauacugcgcaucucgccuuacaucugacggccuggcccggcacguaacucagugccccaaacgcaaagaaaaaguagaagaaacagaacuauaccuuaaccuggaaagaauacccugggucguccgaaaauugcugcaagugagcgaauccaccggcgucgcccucaaacgcagcagcuggcuaaucguccuccucguccucuucacagugucucucucaccagugcaauccgccccgaucggccacggcaaaacaaucgaagcauaccgugcgcgcgaaggcuauacuuccaucugccuguucguccucggcucaauucucuucaucguaucgugcuuaaugaaaggacucgucgauagcguagguaacuccuucuuuccagggcucagcaucugcaagaccugcagcaucucuuccauaaacggauucgaaaucgaaucccauaaguguuacugcucacuguuuuguugcccauacugccgacacugcuccgccgacaaagagauccacaaacuccaccugucaauauguaagaaacgaaaaacaggaaguaacguaauguuagccgucugcaaacgaaugugcuuccgcgcaaccauggagguauccaaccgcgcacuauucauaagaucaaucauaaacaccaccuucguacucugcauacucauccuagccgucugcgucgugagcaccagcgccgucgagauggaaaaccugcccgccgggaccugggaacgggaagaagacuuaaccaacuucugccaccaggaaugucaaguaacugaaaccgaaugccucugccccuacgaagcucuuguccuccgaaaaccacuauuccuagacagcaucgucaaaggcaugaaaaaccuccucaacucgacuucacucgaaacgagcuuauccaucgaagccccguggggagccauaaaugugcaauccacuuacaaacccacaguuuccacagcaaauaucgccuugucauggagcuccguagaacaccgcgggaacaagauacucgucuccggccgcagugagagcauaaugaagcucgaagaacgcaccggaauaucgugggaccuaggaguagaagacgcauccgagagcaaacuacucaccgucucaguaauggaccucucacagauguacucgcccguguucgaauaccucucgggggaccgccagguggaggaguggcccaaagccacuugcaccggcgacugcccagaaaggugcggcugcaccucaagcacgugucuacacaaagaauggccgcacagcagaaauuggcgaugcaaccccacaugguguuggggagucgguacaggcugcacaugcugcggacucgacgucaaggauuuauucacagacuacauguucgucaaauggaaagucgaauacaucaaaaccgaggccauagucugcgucgaauuaacaagccaagagcgccagugcagccucaucgaagccgguacacgcuucaaccucggccccgucacgaucacguuauccgagccucguaacauccaacaaaagcuacccccagagaucauaacacuccacccccgaaucgaagaaggguucuuugaccucaugcacguccaaaagguauuguccgcaagcacgguaugcaaacuccaguccugcacccacggaguucccggagacuuacaaguguaccauaucggcaaccuucuaaaaggagacaaagucaacggccaccucauacacaaaaucgaaccccacuucaauacuuccuggauguccugggacggcugugaucuggauuacuacugcaacaugggagacuggccuuccugcaccuacacaggcgucacucaacacaaccaugccucuuuugugaaccugcucaacauagaaacagacuacaccaaaaacuuccacuuccacagcaagcgagugaccgcccacggcgacacaccacaacuagauuuaaaggcccgccccaccuauggagcaggcgagaucacaguccuagucgaaguagcagacauggagcuucauaccaagaaaaucgaaaucuccggcuuaaaauucgcaucacucacauguaccggcugcuacgcaugcucauccgggaucuccugcaaaguacgaauccaugucgacgaaccagacgaacucacaguucacguuaaaagcgacgacccggacgucgucgccgccaguagcucauugauggcacgaaagcucgaguucggaacagacuccaccuucaaagcguuuucggcgaugcccaaaaccucacuaugcuucuacaucguagaacgcgagcacugcaaauccugcucagaagaagacacaaagaaaugcguaaacacgaaauuagaacaaccccagagcauccucaucgaacauaaaggaacgaucaucggaaaacaaaacucaaccuguacugcgaaagccucaugcuggcuugaauccgucaaauccuuuuucuacggccucaaaaacaugcuuucagguauauucggcaacguguucaucggaaucuuccucuuccuaggccccuucauacuucuaaucuuguucuucauguuuggcuggcgcauauuauucugcuucaagugcugccgacgaacacgagggcugcuaaaauacagacaccuaaaagaggacgaagagacaggauaccgccgaauaaucgaacgacucaacaacaagaaaggcaaaaacaaauuacuagauggcgagcgccucgcagaucgccgcauagccgaacuauucagcaccaagacgcacaucggc

SEQ ID NO: 15474 - RNA, 3495 nt, Artificial Sequence
  derived and/or modified CDS sequence (opt11) from CCHVF(CCHVF Sudan Al-Fulah 9-2008)__HQ378185.1__Gn-NSm-Gc
ucagaggaacccuccgacgacugcaucucaaggacccagcugcuccggaccgagacggccgagauccauggcgacaacuacggcggcccaggggacaagaucaccaucugcaacggcuccaccaucguggaccagagguugggcagcgagcugggcugcuauaccaucaaccgggucaagaguuucaagcucugcgagaauagcgccacgggcaaguccugcguaauugacagugugcccgucaagugucgccagggguacugccugcggaucacucaggagggccgcgggcacgugaagcugucccggggcagcgaaguggugcucgacgcgugcgauaccuccugcgagaucaugauccccaaggguaccggcgacauccugguggacugcagcggcggacaacaacacuuccugaaggacaaccucguggaccugggcugccccaagaucccgcugcucgguaagauggccaucuacaucugccgcaugucgaaccaccccaagacgaccauggccuucuuauucugguucagcuucggcuacgucaucacgugcauccugugcaaggccaucuucuaccuucuaaucauaaucggcacccuggggaagcgauuucgccaguaccgggagcuuaagccccaaaccugcacaaucugugagacaacccccgugaaugccaucgaugcggagaugcacgacuugaauugcuccuacaacaucugcccguauugcgccucucgccugacguccgauggccucgcgcggcacguaacccagugccccaagcgcaaggagaagguggaagagaccgaacuguaccugaaccucgagcggauccccuggguggugcgcaagcugcugcaggucagcgaguccaccgggguggcgcucaagagaagcagcuggcugaucgugcuccuuguccuauucacggugucucugagucccgugcaguccgcgccgaucggccacgggaagaccaucgaggccuaccgcgcccgggagggcuacaccagcaucugccucuuuguauuaggcuccauacuguucaucguguccugccugaugaaggggcugguggacuccgucgggaacagcuucuucccagggcugucuaucugcaagaccugcucaaucuccagcaucaacggguuugagaucgagagccacaagugcuauugcagccucuucuguugccccuacugccgccacugcuccgccgacaaggaaauccacaagcugcaccuaagcaucugcaagaaacguaagacggggagcaacgugaugcucgccgucugcaagcgcaugugcuuccgcgcgacuauggaagugagcaaccgggccuuguucauccgcuccaucaucaacaccaccuucgugcugugcauccucauccuggccgucugugugguaagcacgagcgccgucgagauggagaaccuucccgcuggcaccugggagcgggaggaggaccucaccaacuucugccaccaagagugucaggugacugagaccgagugccugugcccguacgaggcgcuggugcugaggcggccccucuuccuggacuccaucgucaagggcaugaagaaccugcucaacaguacuucccuggagaccagccuguccaucgaggcccccuggggcgccaucaacgugcagagcaccuacaagcccacggugagcacggccaacaucgcacucagcuggucgagcgucgagcaccgcgggaacaagauccugguuuccgggcggagcgaguccaucaugaagcuggaggagcgcaccggcaucagcugggaccucgggguggaggacgcguccgagagcaagcugcugaccgucuccgugauggaccucucccagauguacagcccgguauucgaguaccuuucaggugaccggcaggucgaggaguggcccaaggcgaccugcacaggcgacugccccgagcgcugcgggugcaccagcuccacgugcuugcacaaggaguggccccacagccguaacuggcgcuguaacccgaccuggugcuggggcguugggaccggaugcacuugcugcggucucgacgugaaggaccuauucacagacuacauguucgugaaguggaagguagaguacaucaagaccgaggccaucgugugcgucgagcugacaagccaggagcggcagugcagccucaucgaagccgggacccgcuucaaccugggccccgugaccaucacccugagugagccccggaacauccagcagaaauuacccccggagaucaucacccuccacccucgcauagaggagggguucuucgaccugaugcacgugcaaaagguccucagcgcguccaccgugugcaagcugcagagcugcacccacggcgugcccggggaccugcaggucuaccacaucgguaacuuacugaagggcgacaaggugaacgggcaccugauccauaagaucgagccgcacuucaacaccuccuggaugagcugggauggcugcgaccuugauuacuacugcaauaugggggacuggccaucaugcacguacaccggcguaacccagcacaaccacgccagcuucgucaaccugcugaacaucgagaccgacuacacgaagaacuuccacuuccacuccaaacgggugaccgcccacggggacacgccccagcuagaccugaaggcccgcccuaccuacggcgccggcgagaucaccgugcuggucgagguggcugauauggaacuccacaccaagaaaaucgagaucagcgggcugaaguucgccucccugacauguacgggcuguuacgcgugcagcuccgggaucagcugcaaggugcggauccacgucgacgagccggacgagcucacgguucacgucaagagcgacgaccccgacgugguggccgccuccagcucccugauggcgcgcaagcuggaguucggcaccgacagcaccuucaaggccuuuuccgccaugccuaagaccagucucugcuucuacaucguggagaaggaauacugcaaguccugcuccgaggaggacacgaagaagugcguuaacaccaagcuggagcagccgcaguccauccugaucgagcacaagggcaccauaauugggaagcagaacagcacaugcaccgccaagguuuccugcuggcucgagagcgcuaaguccuucuucuacggccugaaagacaugcugagcgggaucuuuggcaacguguucaucgggauauuccucuuccuggcgccguucguccugcucguguuauuuuucauguucggcuggcgcauccuguuaugcuuuagaugcugccgacgaaccagggggcuguuuaaguaccggcacuuaaaggaugaugaggagaccggcuaccgccggaucaucgagcgccucaacaacaaaaagggcaagaacaagcugcuggacggggagcggcucgccgaccgcaaaaucgcugagcuguucuccaccaagacccacaucggu

SEQ ID NO: 15475 - RNA, 3495 nt, Artificial Sequence
  derived and/or modified CDS sequence (opt11) from CCHVF(CCHVF NIV161064)__KY213713.1__Gn-NSm-Gc
agcgaggaguccggcgacgacugcaucagccgcacgcaacugcuccggacggagacggcggaaguucauggggacaacuacggcgggcccggcgacaagaucacuaucugcaauggguccaccgucguggaucagcgccugggcagcgagcugggcuguuacaccauuaaccgggugcguuccuucaagcucugcgagaacagcgccacagggaaguccugcgagauugacagcauccccgucaagugcaagcagggcuacugccugaagaucacccaggaggggcggggccacgugaagcugucccgcgggagcgagguaguccuagacguuugcgacuccagcugcgagguaaugauccccaagggcaccggcgacauccuggucgacugcuccgggggacagcaacacuuccugaaagacaaccugguggaucuggggugccccaagaucccccugcucggcaagauggcgaucuacaucugccggauguccaaucacccgaagacgacgauggccuuccucuucugguucucauucggguaugugaucacgugcauacugugcaaggccaucuuuuuccuacugaucaucuucgguacccugggaaaacgauucaaacaguaucgggagcucaagccgcagaccugcaccaucugcgaaacaaccccagucaacgccaucgacgccgagaugcaugaccugaacugcagcuacaacaucugccccuauugcgcgucccgccucaccagcgacggccucgcaagacacgugacgcagugcccucgccggaaggagaagguagaggaaaccgagcucuaccugaaccucgagcgcauaccuugggucgugcggaagcugcuccagguguccgagagcaccggcaccguccugaaacgcagcuccuggcugaucguacugcucgugcuguucacggucucucugucccccgugcagucugcccccaucgggcacggcaagacuaucgagaccuaccgggugcgcgaggaguacaccuccaucugccucuucguccugggcucaauccuguucaucguguccuuccucaugaaagggcuggucgacggcgucgggaauaucuuuuucccgggccugagcgugugcaagacaugcuccauaggcagcaucaacggcuucgagaucgagucccauaagugcuacugcagccuauucugcugccccuacugccggcacugcuccgccgauggcgagauucaccagcuacaccugagcaucuguaagaagcgcaaaaccgggucaaacguuaugcucgcgguaugcaagcgaaugugcuuccgcgccaccauggaggugagcaacaaggcccuauucauccgcuccauaaucaacacuacguucgucgugugcauccugauccucgccgugugcgucguuagcacguccgcgguggaaauggagucccuucccgcgggcaccugggagagagaggaggacuugaccaacuucugccaccaggagugccaggucacggagaccgagugccuaugccccuacgaggcccuggugcugcgccggccucuuuuccucgacagcaucgugaaggggaugaagaaccugcugaacuccaccagucucgagaccucccugucaauugaggcccccuggggcgccaucaacguccaauccacguacaagcccaccgugagcacggccaacaucgcgcuguccuggagcuccguggagcaccgcgggaacaagguccucguuagcggccgcuccgagagcaucaugaagcuggaggaacgcaccggcaucuccugggaccuggggguggaggacgccucugaguccaagcuccugaccguuagcgugauggaccugucccagauguacucccccguguucgaguaccucagcggcgaccggcaggucgaggaguggccgaaggccacgugcaccggagacugccccgagcgcugcggaugcaccuccuccacgugccugcacaaggaguggccccacucccggaacuggaggugcaaccccaccugguguuggggcguggggaccggcugcacuugcugugggcuggacgugaaggaccucuucacagacuacauguucgucaaauggaagguggaguacaucaagacagaggccaucgugugugucgagcugaccucccaggagcggcagugcucccugaucgaggccggcacccgcuucaaccucgggagcgugaccaucacucugagcgagccgcggaacauccagcagaagcugccucccgagauaaucacucuccaccccaagaucgaggagggcuucuucgaccucaugcacgugcagaagguccuaagcgcguccaccgugugcaagcuccagagcugcacccacggugugcccggggaccugcaaguauaccacaucggcaacuuacucaagggggaccgcgugaacggacaccugauccacaagaucgagcagcauuuuaacacuuccuggaugagcugggacgggugcgaccuggacuacuacugcaacaugggcgacuggcccuccugcaccuacaccggcgugacccaacacaaccacgccagcuucgucaaccuccugaacaucgaaacggacuacaccaagaccuuucacuuucacuccaagcgggugaccgcccacggggacacgccccagcuggaccucaaagcccgaccgaccuacggugccggggaggugaccguccugguagagguggcggacauggagcuucacaccaagaaaaucgaaaucagcggccucaaguucgccggguuaacguguaccggcugcuacgccugcuccaguggcaucagcugcaaaguccggauccacguggacgagcccgacgagcugaccgugcaugucaaaagcgaugacccugacgugguggccgcgagcuccagccucauggcccgcaaacuggaguucgggaccgacuccacguucaaagccuucagcgcaaugcccaagaccucccuaugcuucuacaucgucgagagagaguacugcaagucaugcuccaaggaggacacccagaagugcgugaauaccaagcucgagcaaccgcaguccauucugaucgagcacaagggcacgaucaucgggaagcagaacaacacgugcaccgccaaagcguccugcuggcuggagagcguuaagucguuuuucuacggccucaagaacaugcucgggggaaucuuuggcaacguguucauagggaucuucaccuuccugacccccuucauccugcugaucuuauucuucauguucgguuggaggauccuauucugcuucaagugcugccgccggaccagggggcuguucaaguaccggcaccugaaggacgacgaagagaccggcuacaggaagauuauugagaggcucaacaacaagaaaggcaagaaccgccugcuggacggggagcggcucgccgaccgcaagaucgccgaacuguucagcaccaagacccacaucggc

SEQ ID NO: 15476 - RNA, 3495 nt, Artificial Sequence
  derived and/or modified CDS sequence (opt11) from CCHVF(CCHVF 5180-R-2011)__KR814874.1__Gn-NSm-Gc
uccgaagaaccaggggaugacugcauaagucgcacacaacuccuucgcacagaaacagccgaaauccacgacgacaacuacgggggaccuggcgacaaaauaacgauaugcaacggcucaacaauaguagaucagaggcugggaucagaacucgggugcuacacaauaaaccgcguuaaauccuucaaacucugcgaaaacucagcuaccggaaagacaugcgaaauagacucgacccccgucaaauguaggcaaggcuucugccuaaaaauaacccaggaaggccgcgggcacguaaaacucagccgcggaucagaaguuguccuagacgcuugugauaccagcugcgaaguaaugauaccgaaggggaccggugauauucuagucgacugcagcggaggccaacagcacuuccucaaagacaaccucaucgaccuaggaugcccgcacauaccccuacucggcaaaauggcuaucuauauaugccgaaugagcaaccauccccgcacgaccauggccuuccucuucugguucagcuucggcuacguaauaaccugcaucuucugcaaagcacucuucuacucccucauaaucaucggcacccucgggaaaaagauaaaacaauaccgggaacucaagccccagacaugcacgaucugcgagacagcccccgucaacgcgaucgacgcagaaaugcacgaccucaacugcucuuacaacauaugccccuacugugccucacgucucaccucugacggacucgcccggcacgucccccaauguccuaaacgcaaagaaaaaguagaagaaacagagcucuaccucaaccucgaaagaauacccuggauaguaagaaaacuucuucagguuuccgaaucgacaggaguugcccucaaacgcagcaguugguuaaucgugcuccuaguccuacuaacaguaagucucucccccguccaaucggcccccgucggacacggcaaaacaaucgaaacuuaccaaacccgggaaggcuucacgucagucugccucuuuaugcucggaucaauccuauuuuuaguaucuugccucgugaaaggccugguggacucggucucagacucuuucuucccggggcuaagcguaugcaaaaccugcucaaucggcaguaucaaugguuucgaaauagaaucucacaaaugcuauugcucacucuucugcugccccuacugccgccacugcucagccgaccgugaaauacaucaacuccaccuaucaauaugcaagaaacgcaaaaugggcucaaauguaaugcuggcugucugcaaacgcaugugcuuccgagccaccauagaagcaucacgccgggcacuuuugauccgcucgauaaucaacacuaccuucgucauaugcauccucacacucaccaucugcguaguaucaaccucugcugucgagauggaaaaucucccaagcggcaccugggaaagggaagaagaccucacuaacuucugccaucaagaaugccaaguaaccgagaccgaaugccucugcccuuacgaagcacucguacuacgcaaaccucuauuuuuagacagcaucgucaaaggcaugaaaaacuuacuaaacagcacaagccuugagacaucccucuccauagaagcgcccuggggcgccauaaacgugcaguccacauuuaaaccuacaguuucuaccgccaauaucgcccuuuccugguccucgguagaacacagaggaaacaagauccuagucaccggcaggagcgaaagcauaaugaagcuagaagagagaacggguguaucaugggaccucggaguagaggacgccagcgaauccaaacuccuuacaguaaguauaauggaccucagccaaauguacucccccguauucgaauaccuguccggcgaccgucaagucgaagaauggcccaaagcaaccugcacaggagacugucccgaacgaugcggauguacauccucaaccugccuccacaaagaguggccccacagccgcaacuggagaugcaacccuaccuggugcuggggugucggaaccggaugcacaugcugcggagucgacgucaaagauuuauucaccgaccacauguucgucaaauggaaaguagaauacaucaaaaccgaagccauaguuugcguggagcucaccagccaggagagacagugcagucuuauugaagccggaaccagguucaaccuaggaccggucacuauaacccugucggagccuagaaacauccaacagaaacugccucccgagaucauaacguuacaccccaaagucgaagaaggauucuucgaccuaaugcacguccagaagguacuguccgccuccacaguaugcaaacuacaauccuguacccacgggauacccggcgaccuccaaguauaucacaucggcaaucuccuaaagggcgaccgcgucaacggccaccucauccacaaaauagagccccacuucaacaccagcuggaugucaugggacggaugugaccucgacuauuacugcaacaugggugacuggccuucuugcaccuacaccggagucacccaacauaaccacgccgccuucgucaaccuacuaaacaucgaaaccgacuauaccaaaaccuuccacuuccacucgaaacgaguuacggcccacggcgacacgccccaacucgaccugaaagcgcggccaaccuacggagcgggggagaucaccguauuaguagaaguagcggauauggagcugcacaccaagaaagucgaaaucucaggacugaaauucgcaagccucgccugcaccgggugcuacgccugcuccagcggcaucuccugcaaaguccgaauccaugucgacgaaccugacgagcucacaguacacguuaaaagcaacgacccggauguaguagccgcuuccacgucacucauggccaggaagcucgaguucggaaccgacagcaccuucaaagccuucucagcgaugccaaaaacaucacucugcuucuacauagucgaaagagaauacugcaaauccuguuccgaagaagauacccagaaauguguagacacaaaacuagaacaaccacaaagcauccuaauagaacacaaaggcacgaucauaggcaaacaaaacgacacauguaccgccaaagccaguuguuggcucgaaucggugaaaucguucuucuacggacucaagaacaugcuaggcagcgucuucggcaacuuuuucauugguauccugcuauuucuugcacccuucguguugcucguccuauucuucauguucggcuggaaaauucucuucuguuucaaaugcugccgccgcacccgcggucugcugaaguaccgccugcuuaaagacgacgaagaaacaggguacagacgaauaaucgagagacuuaauaauaagaaaggcaaaaaccggcuacuggacggagaaagacuagcagaccgcaaaaucgcagaacuguuuagcacaaagacccacaucgga

SEQ ID NO: 15477 - RNA, 3495 nt, Artificial Sequence
  derived and/or modified CDS sequence (opt11) from CCHVF(CCHVF 4574-ST-2008)__KR814870.1__Gn-NSm-Gc
agcgaggaaucgggcgacgauugcaucagccgcacccagcuucuccggaccgagacagccgaaauccacgacgacaacuacgggggccccggggacaagaucaccaucugcaacggcuccaccaucguggaccagagacuggggagcgagcugggcugcuacaccaucaaccgggucaaguccuucaaacucugcgagaacagcgcuacgggcaaaaccugcgagaucgacuccaccccggugaaaugccgccagggguuuugccugaagaucacccaggagggccgggggcacgugaagcugucacgcggcuccgaggucguacucgacgcgugcgacucaagcugcgaagugaugauccccaaggggacgggcgacauccucgucgacugcucaggcgggcagcagcacuuccugaaggacaaccucaucgaccugggaugcccacacaucccucuacucgggaagauggccauauacaucugccgaauguccaaccacccucgaaccaccauggcguuccuguucugguucagcuucggcuacgugauaacgugccuguucugcaaggcacucuucuacuccuuaaucaucaucggcacccuggggaagaagaucaaacaguaccgggagcuccgcccccaaaccugcaccaucugcgagaccgcccccgugaacgcgaucgacgccgagaugcacgaccugaacugcucguacaacaucugccccuacugugcaucgcggcugacaagcgacggccucgcccgccacgucccccagugccccaagaggaaggagaaggucgaggagaccgagcuguaccugaaccuugaacgcaucccguggaucgugcggaaguuguuacaggucuccgagagcacugggguggcgcucaagcgcagcuccugguugaucgugcugcucguccugcugacggugucgcucucccccgugcagagcgccccggucggccacgggaagacgaucgagaccuaccagacccgggagggcuuuaccuccaucugcuuguucaugcugggcagcauccucuuccugguguccugucuggugaaagggcucgucgacucuguguccgacagcuuuuuccccggccugucgguaugcaaaacaugcucuaucggguccauaaauggauuugagaucgagagccacaagugcuacugcucccugcucuguugccccuacugccgccacugcagcgccgaccgggagauccaccaacugcaccugaguaucugcaagaagcgcaagacugggagcaacgucaugcucgccgugugcaagcggaugugcuuccgcgcaacuaucgaggcgucccgccgagcccugcugauccgcucuaucaucaacaccacguucgucauuugcauacucacccugaccauaugcgugguuagcaccuccgccgucgagauggaaaaucugcccagcggcacgugggagaaggaggaggaccugaccaacuucugccaccaggagugucaggugaccgagaccgagugucucugcccguacgaggcccuggugcugcgaaagccccucuuccuggacuccaucgucaagggcaugaagaaccugcucaacagcacgucccuggagaccagccuguccauugaggccccguggggcgcgaucaacgugcagagcaccuucaaacccacuguguccaccgcaaauaucgcccucagcugguccagcgucgagcaccgcggcaacaagauccuggucacgggccgcuccgagagcauuaugaagcuggaggagcgcaccgggguauccugggaccucggugucgaggaugccagcgagagcaaacugcugaccgugagcaucauggaccucagccagauguacuccccgguuuucgaguaccugagcggcgaccggcagguagaagaguggccuaaagcgaccugcacuggagacugccccgagcgcugcggaugcaccuccagcacgugccuucacaaggaguggccccauucccggaacuggcgcugcaaucccaccugguguuggggcguggggaccggcuguacgugcugcggcguggacgucaaggaccuguucaccgaccacauguuuguuaaauggaagguggaguacaucaagacugaggccaucgucugcguggaacugacaagccaggaacgccaguguucccugaucgaagccgggacccgcuucaaccucggcccagugacgaucacccugagcgagccccggaacauccaacagaagcugcccccggagaucaucacgcuccaccccaaggucgaggagggcuucuucgaccugaugcacgugcagaaggugcugagugccagcacugucugcaagcuccaguccuguacccacggcauccccggcgaccuccagguguaccacauaggcaaccuguuaaagggcgaccgcgugaacggucacuuaauccacaagaucgagccgcacuucaauaccagcuggauguccugggacggcugcgaccuggacuacuacuguaacaugggggacuggcccagcuguacguauaccggagucacccaacacaaccacgccgccuucgugaaccuccuuaauaucgagaccgacuacaccaagacuuuccacuuccauuccaagcgggugaccgcgcacggggauacuccccagcuggaccucaaggccaggcccaccuacggcgccggcgagaucacgguccugguggagguugccgauauggagcugcacaccaaaaaggucgaaaucucugggcucaaguucgcgagccuggcaugcaccggcugcuacgccugcagcuccgguaucagcugcaaggugcggauccacguggacgagccggacgagcucacgguccacguaaaaagcucagaccccgacgugguggccgcgagcaccucucucauggcgcgcaagcuggaguucgguaccgacucuaccuucaaggcuuucuccgccaugccgaaaacgagccugugcuucuacaucguggagcgggaguacugcaaguccugcagcgaagaggacacucagaagugcguugacaccaagcucgagcagccccaguccauucugaucgagcacaaggguaccauaaucggcaagcagaacgacacgugcacugcuaaggcgaguugcuggcuugaguccgucaagucguucuucuacgggcucaagaacaugcugggguccgucuucggcaacuucuucaucgggauccugcuguuccuggcgccguucgugcugcucguccucuucuucauguucggcuggaagauccuguucugcuucaagugcugccgccgcgcccggggacuccugaaguaccgccaccugaaggaugacgaagagaccggcuaccggaaaaucauagaacgccucaacaacaagaagggcaaaaaccggcugcuggacggugagcgccucgcggaccggaagaucgccgagcuauucucgaccaaaacccacaucggc

SEQ ID NO: 15478 - RNA, 3495 nt, Artificial Sequence
  derived and/or modified CDS sequence (opt11) from CCHVF(CCHVF 3010)__DQ019222.1__Gn-NSm-Gc
gcugagggcgugagcaacgacugcgucucccgcacccagcugaucaagacugagguggccgagauccacgaggacagcuacgggggccccggggagaagaucacgaucugcaacggcuccaccauuguggaccagcgguuggggagcgaacuaggcugcuacaccaucaaccgcgucaagaccuacaagcugugcgagaacucagcgacagagaagggcugcgagauagacagcgugccggugaaaugcaagcagggguucugucucaaggucacccaggagggccgggggcacgugaaguugucccgcggcaccgagaucgugcuggacgucugcgacaccagcugcgagcucaugauccccaaggggacgggcgacaucuugguggauuguuccggcgggcaacagcacuuccugcaggacaaccucaucgaccugggcugccccaacgugccccugcucgggaagauggcaaucuauaucugccggaugagcaaccacccgaagaccaccauggccuuccuguucugguucuccuucggcuacgucaucacgugcaucgugugcaaggugcuguucuaccuccugaucgucaucggcacgcugagcaagaagcucaaacaguaccgcgagcugaagccucagacaugcaucgugugcgaguccacccccgugaacgccaucgacgccgagaugcacgaacugaacugcaacuacaacaucugcccguacugcgcuagccggcucacgucagacgggcugguucgccaugugaaccaaugcccgaagcggaaggagaagguggaggagacggagcuguaccucaacuuagagagaauccccuggcugguccggcgccuccuccaaguaagcgaauccaccggcauggcccugaagcggagcugcuggaugaccacccuccugauccuguuaguuguuucacugagccccgugcagagcgcccccgucggucagggcaaagccguggagguguaccgcguccgggagucuuacacgagcaucugccuguucguccucggguccgugcuguuugcggucucauggcuaaucaagggccucaucgacggcaucggcaacuccuucuucccgggccugagcguguguaaaaccugcuccauaggcucgaucaacggcuucgagaucgagucccauaaaugcuacugcagccuguucugcugccccuacugccgcgccugcucgucggacaagauaacccaccggaugcaccuuaacgugugcaaaaagcgcaaggccggguccaauguaaugcuagcuguaugcaagaggaugugcuucaaagccacuguggaggcgucaaacacggcccugcucauccgcggcauuaucaacuccaccuucgucaucugcgugcugauccugguaaucugcgucgugaguaccuccgccguggacauggagaaccucccggcaggcaucugggagcgggaagaggauuuaaccaacuucugccaccaggagugccaggucacagagaccgagugccugugccccuaugaggcccugauccuccgcaagccacuguaucuggauagcaucgcgaaggguaugaagucccuccugaacucgacgaaccuggagaccagccucuccaucgaggccccguggggcgccaucaacgugcagagcacauucaagcccaccgugagcgccgccaacaucgcgcugagcugguccagcgucgagcaccgagggaacaagaucuugguguccggccggagcgaguccauuaugaagcucgaggagcgcaccgggaucagcuggucccugggcguggaggacgccagcgagucaaagacccugacggucagcgugauggaccucucccaaauguacagcccagucuucgaguaccugagcggcgaccggcaggucgaggaguggccgaaggcgaccugcaccggggacugccaggagcgcugcgggugcaccagcagcaccugucugcacaaggaguggccccacucccggaauuggaggugcaaucccaccuggugcuggggcguggggaccggcugcacgugcugcgggcucgacgugcgggaccucuucaccgacuacaugauggucaaguggaagguugaguacgugaagaccgaggccaucaugugcguugagcugaccagccaggagcgccaaugcucccucaucgaggccgggacccgguuuaaccuggggccggugaccaucacgcugagcgagccgcgcaacauccagcagaggcucccauccgagaucgucaccuuacaccccaagaucgaggaagguuucuucgaucugaugcauguccagaaggugcucucagccuccaccgugugcaaacugcaguccuguacccacgggguccccggcgaccuccagguguaccaugugggcaaucuccugaagggggacaaggucaacggccauucaauccauaagaucgagagccacuucaacacuuccuggaugagcugggacgggugcgaccuggacuacuucuguaacaugggcgacuggccguccugcacuuacacuggggugacacagcacaaucgggccgccuucaucaacaugcucaacauagaaacggacuacaccaagaccuuccacuuccacucaaagcgggugaccgcccacggcgacacuccccagcuggaccuaaaggcgcgccccaccuauggagccggggaggucaccguacucguggaaguagccgaccuggagcugcacaccaagaaaaucgagguguccgggcucaaguucgccagccuaacaugcuccgggugcuacgcaugcagcuccggcauuuccugcaaagugcggauccacgucaacgaaccggacgaguucaccgugcacgucaagucuuccgaccccgacgugguggcagccgggagcagccugauggcgcgcaagauagaguucggcgccgacaguaccuucaaagccuucuccagcaugcccaagaacucccucugcuucuacauagucgagcgggacuacugcagcuccugcacuaacgacgauacgcagaagugcguggacaccaagcuggagcacccccagagcauccugaucgagcacaaaggcaccauuaucgggaagcagaacgacacgugcuccaccaagaccagcuguuggcucgaguccguuaagagcuucuucuauggccugaagaacaugcucgggggcauuuucgggaacgucuuccugggcaucuuccuguuccuggcuccguucgcgcuccugaucuucuucuucuucuucggcuggcgccugcuguuuugccugaagugcugucggcgcacccgcggacugcucaaguacaagcagcuuaaggacgaggaggaggccggcuacaagaagaucaucgagcggcugaacgacaaaaagggaaagucccgccuguucgacggcgagcgguuggccgaccgcaagaucgccgagcuguucagcaccaaaacacacaucggc

SEQ ID NO: 15479 - RNA, 3495 nt, Artificial Sequence
  derived and/or modified CDS sequence (opt11) from CCHVF(CCHVF UG3010)__DQ211637.1__Gn-NSm-Gc
gccgaaggcgugagcaacgacugcgucagucgcacccagcugaucaagaccgagguggccgagauccacgaggacagcuacgguggccccggggagaagaucacgaucugcaacggcuccaccaucguggaccagcggcucgggagcgagcuggguugcuacaccaucaaccgcgucaagaccuacaagcugugcgagaacuccgcgacggagaagggcugugaaaucgacagcgugccggugaagugcaagcagggguucugccucaaggucacccaggagggccgggggcacgugaaacugucccgcggcaccgagaucguucuggacgucugcgacaccagcugcgagcuuaugauccccaaggggacgggugacauccugguggacugcuccggagggcagcagcacuuccugcaggacaaccucaucgaccugggcugccccaacgugccccugcucgguaagauggccaucuacaucugccggaugagcaaccacccgaagaccaccauggccuuccuguucugguucuccuucggcuacgucaucacgugcaucgucugcaaggugcuguucuaccuccugaucgucaucggcacccugagcaagaaacuuaagcaguaccgcgagcugaagccccagaccugcaucgugugcgaguccacccccgugaacgccaucgacgccgagaugcacgagcugaacugcaauuacaacaucugucccuacugcgcgagccggcucaccuccgacgggcugguccgccacgugaaccagugcccgaagcggaaagagaagguugaggagacggagcuguaccucaaccuggagcgcauccccuggcugguccggcgccugcuccaggugagcgaguccaccgggauggcccugaagcggagcugcuggaugaccacccuccugauccugcucguggucucacuuagcccggugcagagcgcccccgucgggcagggaaaggccguggagguguaccgcguccgggaguccuacacgagcaucugccuguucguucucggguccgugcuguucgcggucagcuggcugaucaagggccucaucgacggcaucgggaacuccuucuucccgggccugagcgugugcaagaccugcuccaucgggagcaucaacggcuucgagaucgagucccacaagugcuacugcagccuguucugcugccccuacugccgcgccugcagcagcgacaagaucacccaccggaugcaccucaacgugugcaagaagcgcaaggccggguccaacgucaugcuggccgugugcaagcggaugugcuucaaggccaccguggaggcgagcaacacggcucuguuaauccgcggcaucaucaacuccaccuucgucaucugcgugcugauccuggucaucugcgucgugagcaccuccgcgguggacauggagaaccuccccgccggcaucugggaacgagaggaggaccugaccaacuucugccaccaggagugccaggucacggagaccgagugccugugccccuacgaggcccugauccuccgcaagccgcuguaccuggacagcaucgcaaaggggaugaagucccuccugaacagcaccaaccuggagaccagccucucaaucgaggcccccuggggcgccaucaacguucagagcacguucaagcccaccguguccgccgccaacaucgcguugagcugguccagugucgagcaccgcgggaacaagauccugguguccggucggagcgaguccauaaugaagcucgaggagcgcaccgggaucagcuggucccugggcguggaggacgccagcgaguccaagacccugacggucagcgugauggaccucucccagauguacagccccguguucgaguaccuguccggcgaccggcaggucgaggaguggccgaaggcgaccugcaccggggacugccaggagcgcugcggcugcacuagcagcacgugccugcacaaggaguggccccacucccggaacuggcgcugcaaccccaccuggugcuggggcguggggaccggcugcacgugcugcgggcucgacgugcgggaucuguucaccgacuacaugauggucaaguggaagguggaauacgugaagaccgaggccaucaugugcguugagcugaccagccaagagcgccaaugcucccucaucgaggccggcacccgguucaaccuggggcccgugaccaucacgcugagcgagccgcgcaacauccagcagcggcuccccuccgagaucgugacccugcacccaaaaaucgaggagggcuucuucgaccugaugcacguacagaaggugcucagcgccuccaccgugugcaagcugcagagcugcacccacggggugcccggcgaccuccagguguaccacgugggcaaccugcugaagggggacaaggucaacggccacuccauccacaagaucgagagccacuucaacacguccuggaugucaugggacgggugcgaccuggacuacuucuguaacaugggcgacuggccguccuguaccuacaccgggguaacccagcacaaccgcgccgccuucaucaacaugcucaacaucgagacggacuacaccaagacuuuccauuuccacagcaagcgggugaccgcacacggcgacacgccccagcuggaccugaaggcgcgcccuaccuacggcgccggggaggucaccgugcucguggaggucgcugaccuggagcugcacaccaagaagaucgagguguccggccucaaguucgccagccugacgugcuccgggugcuacgcgugcagcuccggcaucagcugcaaggugcggauccacgucaacgagccggacgaguucaccguucacgucaagagcuccgaccccgacgugguggcggccgggagcucccucauggcccgcaagaucgaguuuggcgccgacagcaccuucaaggccuucuccagcaugcccaagaacucccucuguuucuacaucgucgagcgggacuacugcagcaguugcaccaacgacgacacgcagaagugcguggacaccaagcuggagcacccccagagcauccugaucgagcacaaggguaccaucaucgggaagcagaacgacacgugcuccaccaagaccagcugcuggcucgaguccgucaagagcuucuucuacggccugaagaacaugcuugggggcaucuucgggaacguguuccugggcaucuuccuguuccuggcgccguucgcccuccugaucuucuucuucuucuucggcuggcgccugcuguucugccugaagugcugccggcgcacccgcgggcugcucaaguacaagcaacugaaggacgaggaggaggccggcuacaagaagaucaucgagcggcugaacgacaagaaggggaagucccgccucuucgacggcgagcggcuggccgaccgcaagaucgccgagcuguucagcaccaagacgcacaucggc

SEQ ID NO: 15480 - RNA, 2916 nt, Artificial Sequence
  derived and/or modified CDS sequence (opt11) from CCHFV(10200, Artificial)__U39455.2__Gn-4aa-Gc
agcgaagaaccauccgacgacugcgucucccgaacacagcuucuccgaacugaaacagcggagauccacggcgacaacuacggcggccccggagacaaaauaaccauaugcaauggauccacuaucguggaccaacgccuaggcuccgaacucggaugcuacaccaucaacagaguccgcucuuucaaacugugcgaaaacagcgccacaggcaaaaacugcgaaauagacucggucccgguaaaaugccgacaaggauacugccuacgcauaacacaagaaggacgcggccacguuaagcugaguagaggcucagaaguuguccuagacgccugcgauaccuccugcgaaaucaugauaccgaaagggaccggagacauccucguagacugcuccggcggacaacaacacuuccucaaagacaaccucaucgaccucggaugcccgaaaauccccuugcugggcaaaauggccaucuacauuugccgaaugucgaaccacccaaaaacaacaauggcauucuuauucugguucucauucggauacgugaucacaugcauccucugcaaagccaucuucuaccugcuaaucauuguggguaccuuaggccgccggcucaaacaauaccgagaacuaaaaccccagaccugcaccaucugcgagacuacacccgugaacgcgaucgaugccgagaugcacgaccuaaacugcucauacaauauaugccccuacugugccucccggcucaccucagacgggcucgcccgccauguuauacaaugcccaaagagaaaggaaaaagucgaagaaaccgaacucuaccucaaccuugaacgcauccccugggucguccguaaacuacuccaaguaucagagagcaccggagucgcucuaaaacggucguccuggcuaaucguacugcugguacucuucaccgugagucuauccccaguccagagcgccccgauugggcgaaaaccacuauuccucgacucaaccgcgaaagguaugaagaaccucuuaaacagcacgucacucgaaacaucccuauccauugaagccccguggggagccaucaacgugcaaucgaccuauaaacccaccgucagcacagccaacauagcucucagcuggucuucgguggaacaccgagggaacaaaauacuggucagcggcagguccgaaucaaucaugaagcuagaagaacgaaccggaaucucaugggaucucggagucgaagacgccagcgaguccaaacuccuaacugucuccgucauggaucucucgcaaauguacucaccagucuucgaauaccucuccggagacagacaaguagaagaauggccaaaagcaacaugcaccggagacugccccgagcgcugcggcugcaccucaucgaccugccuacacaaggaguggccucauagccggaacuggaggugcaacccaacauggugcuggggcgucggcacaggaugcacaugcuguggccuagacgucaaagaccuauucaccgacuacauguucgugaaauggaaaguagaauauauaaaaacagaagccaucguauguguagaacuaacaagccaagagcgccaaugcucccuaaucgaagcaggcacccgauucaaccuaggcccagucaccaucacccucagcgagccgcgcaacauccagcagaaauuacccccagagauaauaacccuccacccccgaaucgaggagggauucuucgaccuaaugcauguacaaaaggugcuaagcgccagcaccgucuguaaacuccaaucaugcacccacggcgucccaggcgaccuccaaguauaucacauaggaaaccuauuaaaaggagacaaagucaacggacaccucauccacaaaaucgagccacacuucaacacuagcuggauguccugggacggcugcgaccucgauuacuacugcaauaugggugacuggcccagcugcacguacacuggaguaacccaacacaaucacgccagcuucgucaaccugcucaacaucgaaaccgacuacaccaaaaacuuccacuuccacuccaagaggguaacagcgcauggagacacgccccagcuggaccugaaagcccgcccgacauacggcgcgggagagaucacaguccugguugagguagcagacauggaacuccacacaaagaaaaucgagauuuccggccucaaauucgccucacuagccugcaccggaugcuacgcaugcucgagcuccaucucaugcaaaguccgcauccacguagacgaacccgacgagcucacgguacacgucaaaagcgacgacccggacguagucgcagccucuuccucccugauggcucgcaagcuggaguucggcacugacucuaccuucaaggcuuucuccgcaaugcccaaaaccucccucugcuucuacauagucgaacgagaacacugcaagaguugcuccgaagaagauaccaagaagugcgugaacacaaagcuagaacaaccccagucuauacuaaucgaacacaaaggcacaauaaucgggaagcaaaacuccacaugcaccgccaaggcaagcugcuggcucgaauccguuaaauccuucuuuuacggccucaaaaacaugcuguccggcauauucggcaacgucuucaugggaaucuuccucuuccuagcgccguucauccuccuaauauuauucuucauguucggcuggcgaauccucuuuugcuucaaaugcugccgaagaacccguggacuauucaaauaccgacaccucaaggacgaugaggaaacgggauaccgccggaucaucgaaaagcucaauaauaaaaagggcaaaaacaaacuccucgacggagaacggcucgcagacggccgaaucgccgaacucuucuccaccaaaacccacauaggu

SEQ ID NO: 15481 - RNA, 2916 nt, Artificial Sequence
  derived and/or modified CDS sequence (opt11) from CCHFV(IbAr10200, Artificial)__AF467768.2__Gn-4aa-Gc
agcgaggagcccuccgaugacugcaucagccgcacccagcuccuccggaccgagacggccgagauccauggcgacaacuacgggggcccgggggacaagaucaccaucugcaacggauccaccaucguggaccagcgccuggggucggaacugggcugcuacaccaucaaccgggucagauccuucaagcucugcgagaacagcgcgacgggcaagaacugcgagaucgacuccgugccggugaagugccggcagggguacugucugcgcaucacucaggagggccgggggcacgucaagcugagccgcggcuccgagguggugcucgacgcgugcgacaccaguugcgagaucaugaucccgaaggggacgggcgacauccuggucgauuguuccggcgggcagcagcacuuccugaaggacaaucucaucgaccuugggugccccaagaucccgcugcucgggaagauggccaucuacaucugccggaugagcaaccacccaaagacgaccauggccuuccuguucugguucuccuuuggcuacgugaucacgugcaucuuaugcaaggccauauucuaccuccugaucaucguggggacccuggggaagcgccucaaacaguaccgggaacugaagccccagacauguaccaucugcgagaccacucccgucaacgccaucgacgccgaaaugcacgaccugaacugcagcuacaacaucugcccguacugcgccuccagacucacgucagacggucuggcccggcaugugauccagugccccaagcgcaaggagaaggucgaggagacugagcuuuaccucaaucuggagcggauucccugggucgugcgcaagcugcuccagguguccgagagcaccggggucgcccugaagcgguccagcuggcugaucguucuccuggugcuguucaccguuucacucucccccgugcagagcgcaccgaucggccgcaagccccuguuccuggacuccacggccaaggggaugaagaaccuacugaacagcaccucccuggagaccagccucucuaucgaggccccauggggugccaucaacgugcagagcaccuacaagcccacggucuccaccgccaacaucgcgcugagcugguccagcguggagcaccgggggaacaaaauccuuguuuccgggcgcagcgaguccaucaugaagcucgaggagcggaccggcaucagcugggaccuggggguggaggacgccuccgagagcaagcugcuuaccgugucugucauggaccugagccagauguacucuccgguguucgaauaccugagcggcgaccgccaggugggggaguggcccaaagccacuugcaccggcgacugccccgagcgcugcgguugcacgagcucaacaugccuccacaaggaguggccccauucgcggaacuggcgcugcaacccuaccuggugcuggggagucgggaccgggugcacgugcugcggccuggacgugaaggaccuguucaccgauuacauguucgugaaauggaaggucgaguauaucaagaccgaggccaucgugugcguggaacugaccucccaagaacggcagugcagccucaucgaggccgggacgcgcuuuaaccugggccccgucaccaucacccuguccgagccccggaacauccagcagaaacugcccccggagaucauaacgcugcacccccgcaucgaggagggcuucuucgaccugaugcacgugcaaaaggugcucagcgcguccaccgucugcaagcugcaaagcugcacccauggggugcccggcgaccuccagguguaccacaucgggaaccucuugaagggcgauaaggucaacggccaccugauccacaagaucgaaccccacuucaacaccuccuggaugagcugggacggcugcgaccucgacuacuacugcaacaugggcgacuggccguccugcacguacaccggagugacccaacacaaccacgccagcuuugugaaccugcugaacaucgaaaccgacuauacgaagaacuuccacuuccacaguaaacgggucaccgcccacggcgacacgccccagcucgaucugaaggcccgccccaccuacggugccggcgaaaucaccguccugguggaagucgccgacauggagcuccacaccaagaagaucgagauaagcggccugaaguucgccucccuggccugcaccgggugcuacgccugcagcagcggcaucuccugcaaggugcggauccacguggacgagccugacgaguuaacggugcacgucaagagcgacgaccccgacgugguggccgcguccagcucccugauggcccgcaaauuagaguucgggacggacagcaccuucaaggcauucuccgccaugcccaagaccagccucugcuucuauaucguggaacgggagcacugcaaauccugcuccgaggaggacaccaagaagugcguaaacacgaagcuagagcagccccaguccauccugauugaacacaagggcaccaucaucgggaagcagaacagcacuugcaccgcgaaggccuccugcuggcucgaaagcgucaaguccuucuucuacggacugaagaacaugcugagcggcaucuucgggaacguguucaugggcaucuuccucuuccuggccccguucauccugcucauccuguucuucauguucggguggcgcauccuguucugcuucaaaugcugccggcgcacccggggccucuucaaguaccgccacuugaaggacgacgaggagaccggguaccggcggaucaucgagaagcugaacaacaagaagggaaagaacaagcuccuugacggcgagcggcuggcggaccgccgcaucgccgagcuguucuccaccaagacccacaucggg

SEQ ID NO: 15482 - RNA, 2916 nt, Artificial Sequence
  derived and/or modified CDS sequence (opt11) from CCHFV(Turkey-Kelkit06, Artificial)__GQ337054.1__Gn-4aa-Gc
agcgaagaacccggcgacgacugcauuucccgcacacaacugcuccgcaccgagacggcggagauccacgacgacaacuacgggggcccgggggacaaaaucaccaucugcaacggcagcaccauaguggaccaacgccugggaucugagcugggcugcuacacgaucaacagagucaagagcuuuaagcucugcaaaaauuccgccacgggcaagaccugcgaaguggacagcacucccgugaagugccgccagggguucugccugaagaucacccaagagggccgggggcacgucaagcugucccgcgggagcgaggugguucuggacgcgugcgacaguucaugcgaggucaugauccccaaggguacgggcgacaucuuaguggacugcuccggcgggcagcagcacuuucugaaggacaaccugauagaccugggcugcccccacaucccgcugcucgggcggauggccauauacaucugcaggaugagcaaccacccccggaccaccauggccuuccuguucugguucuccuucggguacgugaucacgugcaucuucugcaaggcccuguucuacagccucaucaucaucggcacccugggaaagaagaucaagcaguaccgcgagcugaagccgcagaccugcaccaucugugagaccgccccggucaacgcuaucgacgccgagaugcacgaccucaacugcuccuacaacaucugcccguauugcgcaagccggcugacguccgauggccuggcccgccacgugacccagugcccgaagcggaaggagaagguggaggaaaccgagcucuaccugaaucuggagcgcauccccuggauaguccggaagcuccuccagguaagcgaguccaccgggguggcgcugaagcgcagcagcuggcucaucguccugcuaguucugcugacggugucccugucucccguccaguccgccccggugggccggaagccccucuucuuggauucaaucgucaaggggaugaagaauuuacuuaacuccacaagccuggagaccuccuugagcaucgaggccccguggggcgccaucaacguccaguccaccuuuaagccuacgguuagcaccgccaacaucgcgcucuccuggucauccguagugcaccgagggaacaagauccuggugaccgggcggagcgagaguaucaugaagcuggaggagcgcaccggcgucagcugggaccucgggguggaggacgccuccgaaagcaagcugcugaccguguccaucauggaccucucccagauguacagcccggucuuugaauaccuguccggggaccgccagguggaggaguggcccaaggcgaccugcaccggggacugccccgagagaugcggcugcaccuccuccacuugccugcacaaggaguggagccacucccgcaacuggcggugcaaucccaccuggugcugggguguggggaccggcugcacaugcugcggggucgacgugaaagaccucuucaccgaccacauguucgugaaguggaaggucgaguacaucaagaccgaggccaucgugugcguggcccugaccagccaggagcgccagugcucccugaucgaagcaggcacacgguuuaaucuggguccagucaccaucacgcucucagagccacgcaacauccagcagaagcugccgcccgagaucaucacccugcauccaaaaaucgaggagggcuucuucgaccuuaugcacgugcagaagguccugagcgcgagcaccgucugcaagcugcaguccugcacucacggcauccccggugaccuccagguguaccacaucggcaaccugcugaagggggaucgggugaacggccaccucauacacaagaucgagagccacuucaacacguccuggaugagcugggacggcugcgaccuggauuacuacuguaacaugggggacuggccuuccugcaccuacaccggcgucacccagcacaaccacgcugccuucguaaauuugcucaacaucgagacggacuacaccaagaccuuccacuuccacagcaagcgcguaacggcccacggggacacgccccagcuggaccugaaggcgagaccgaccuacggcgccgguggcaucaccguccuuguggaaguggccgacauggagcuucacacgaagaaggucgaaaucuccggccucaaguuugccagccucgcaugcacggggugcuacgcguguucuuccggcaucucaugcaaggugcgcauccacguggacgagcccgacgaacugaccguccacgucaagagcagcgaccccgacgugguggccgccuccaccagcuuaauggcccggaagcucgaauuugggaccgacuccacguucaaggcguuuagcgccaugccgaagaccucccucugcuucuacaucguggagcgggaguacugcaagagcugcagcgaggacgacacccagaagugcguggacacacgccuggagcagccacagagcauacucauugagcacaagggcacgaucaucgggaagcagaacgacacguguaccgccaaggccuccuguuggcuggagagcgucaaguccuucuucuacggccugaagaacaugcuuggcagcguuuucgggaauuuauucaucggcauccuccuguuccuggcccccuucgugcugcucguccuguucuucauguucgguuggaagauccuguucuguuucaaaugcugccgccggacccgcggccucuuuaaguaccggcaccugaaagacgacgaggagaccggguacagacggaucaucgagcgccugaacucuaagaagggcaagaaccggcuacuagauggcgaccgccuggcagaccgcaagaucgccgagcuguucaguacuaagacucacaucggg

SEQ ID NO: 15483 - RNA, 2919 nt, Artificial Sequence
  derived and/or modified CDS sequence (opt11) from CCHFV(SR3, Artificial)__AJ538199.1__Gn-4aa-Gc
agcgaggaguccggagacgacugcaucagccgcacccagcugcuucguaccgagaccgccgaagugcacggggacaacuacggcgggccgggcgacaagaucaccaucugcaacggguccaccgugguggaccagcgcuuaggcagcgagcucggaugcuacaccaucaaccgggugcgcuccuucaagcucugcgagaacagcgccacggggaaguccugcgagaucgacagcaucccggugaagugcaagcagggcuacugccugaagaucacgcaggaggggagaggccacgugaaacugucucgcgggagcgaggugguacucgaugugugugacuccaguugcgaggucaugauacccaagggcacuggcgauauccuggucgacugcuccgggggccagcagcacuuccuuaaggacaacuuaguggaccuggggugucccaagaucccccugcucggcaaaauggcgaucuacaucugccgaaugagcaaccacccgaagaccacgauggcguuccuguucugguucuccuucggcuacgugauaaccugcauacugugcaaagcaaucuucuuucuccugaucaucuucgguacccugggcaagcgcuucaagcaguaccgggagcucaagccccagaccugcaccaucugcgagaccacccccgucaacgccaucgacgccgagaugcacgaucugaacugcagcuacaacaucugucccuauugcgcgucccggcugaccagcgacgggcucgcccggcaugugacucagugcccacgccggaaggagaagguggaggagaccgagcucuaccugaaccucgagcgcauuccguggguagugcggaagcugcuccaggucuccgagagcacgggcaccguccuuaagcgcagcuccuggcugaucguccugcucgugcuguucacggucagcuuaagucccgugcagagcgcgcccaucgggcuccggagaccgcuguuucuggacaguaucguaaaggggaugaaaaaccugcugaacaguaccucccuggagacaagccucucuaucgaggcccccuggggcgcgaucaauguccagagcaccuacaagcccacgguguccacggccaacauagcacugagcugguccagcgucgagcacagaggcaacaaggugcugguguccggccgcagcgaguccaucaugaagcucgaggagcggaccgggaucagcugggacuugggcgucgaggacgccuccgagagcaaguugcugaccgugagcgugauggaccugagucagauguauagccccgucuucgaguaccuguccggggaccgccagguggaggaguggccgaaggccacgugcacaggcgacugccccgagcgcuguggcugcaccagcaguacgugccuccacaaagaguggccccacagucggaacuggcgcugcaaccccaccuggugcuggggcguggggaccggguguacgugcugcggccuggacgucaaggaccuguucaccgacuacauguucgugaaguggaagguggaguacauaaagaccgaggcuaucgucugcguggagcugacaucccaggagagacaaugcagccucaucgaggccgggacccgcuuuaaucugggcuccguuacaaucacccuguccgaaccgcguaacauccagcagaaacucccgcccgagaucauuacgcugcacccaaagaucgaggagggauucuucgaccugaugcacguccaaaaagugcucucagccagcaccguuuguaagcugcaguccugcacccacggggucccaggcgaccuccaaguguaccauaucgggaaucugcugaagggcgaucgcgugaacggccaccugauccacaagauugagcaacacuuuaacaccucguggauguccugggacgggugugaccucgacuacuacugcaauaugggugacuggccgagcugcacguacaccggcgucacccagcacaaccacgccuccuucgugaaccugcugaacaucgagaccgacuacacgaagaccuuccacuuccacagcaagagggugaccgcccacggcgauacgccccagcucgaccucaaagcacgccccaccuacggggccggcgagaucacuguccuggucgagguagccgacauggagcuucacaccaagaaaaucgagaucuccggcuugaaauucgcugggcugaccugcacgggaugcuacgccuguuccagcgggauuucuugcaaggugcggauccacgucgacgagccggacgagcucacggugcacgugaagucagacgaccccgacgugguggcggccuccagcucccugauggcgcgcaagcuggaguuuggcaccgacagcaccuucaaggccuucuccgccaugcccaaaacgagccucugcuucuacaucgucgagcgggaguacugcaaguccugcaacaaagaggacacccagaagugcgugaacaccaagcuggagcagccgcagagcauccucauagaacacaaggggaccauaaucggcaagcagaacaauacguguacggcgaaggcuuccugcuggcucgagagcguaaaguccuucuucuacggacugaagaacaugcucggggguaucuucgguaacgucuucaucggcauauuuaccuuucugacccccuucauccugcugauccucuucuucauguucggguggcgaauccuguucugcuucaagugcugccggagaacgcggggccuguucaaguaccgccauuuaaaggacgacgaggaaaccggcuaccggaagaucauugaaaggcugaacaacaagaaggggaagaaccggcuguuagacggcgagcgccuggcagaccgcaagauagccgagcuguucagcaccaagacccacaucggc

SEQ ID NO: 15484 - RNA, 2919 nt, Artificial Sequence
  derived and/or modified CDS sequence (opt11) from CCHFV(UCCR4413, Artificial)__KY484038.1__Gn-4aa-Gc
agcgaguccagcgccagcggcugcaucagcagaacccaaaugaucaagucggagaccgccgaaauccacgacgacaucuacgggggccccggggagaagcugacgaucugcaacggcacgaccgucguagaccagcggcucgggucagagcugggcugcuacaccaucaaccgcaucaagacguacaagcugugugaaaauuccgugaaggagaagaccugcgagaucgacuccgugcccgucaagugccggcagggccucugccugaagaucacccaggaggggcgcggacacgugaagcugucccgggggagcgagaucgugcucgacaucugcgacuccagcugcgagcugaugauccccaaggggaccggggauauauuggucgacugcuccggcggccaacagcacuuccuccaggacaaucugguagaccuggggugccccaauaucccccuccugggcaagguggcgaucuacaucugccgcaugagcaaccacccgaagacgaccauggccuuccuguucugguucuccuucggguacgucauuaccugcauccucugcaagauccuuuucuaccugcucaucaucaccgggacgcugggcaagaagcugaagcaauaccgggaguuaaagccccagaccugcaccaucugcgagagcacccccgugaacgccaucgacgccgagaugcacgaccugaacugcuccuacaacaucugcccuuacugcgccagccgccugacguccgacggguugauccgucacgugaaccugugccccaagcgcaaggagaagguggaggagaccgagcuguaccucaaccuggagcgaauccccugguuugugcgcaagcugcuccaggucagcgagagcaccggcgucgcgcugaagcgguccucuuggcugcugauccuggugauccugcucaccguguccaugagccccguucaguccgcccccaucaaccgcaagccgcuguuccugagcuccaucgugaaggguaagaagaaccuccugaacagcgccuccuuagagacgagccucuccaucgaggcccccuggggcgcgaucaacgcccagagcaccuucaagcccaccaucuccaccgccaacaucgcucugagcugguccagcguggagcaccgggggaacaagguccuggucuccggccgcagcgaguccaucaugaagcucgaggagcggacgggcaucucuuggaaccuggggguggaggacgccagcgaaucccgcaugcuuaccgucagcgugauggaccucucccagauguaccugcccguuuucgaguaccugagcggcgaccggcaaguggaggaguggcccaaggcuaccugcaccggggacugccccgagagaugcggcugcacguccagcaccugucuucacaaggaguggccccacucccggaacuggcgcugcaaccccaccuggugcuggggcgucgggaccggcuguaccugcugcgggcuggacgucaaggaccuguucaccgacuacauguucgugaaguggaagguggaguacaucaagacugaggccaucgucugcguagaacugaccucucaggagcgccagugcucccucaucgaggccgggacgcgguucaacuuggggccggugaccaucacccugagcgagccccgcaacauccagcagaagcuccccuccgagaucgucacacugcaccccaagaucgaggaaggcuucuucgaccugaugcacgugcagaaggugcucagcgccuccaccgucugcaagcugcagagcugcacgcacgggguggccggggaccugcaaguguaucacgucggaaaccucuugaagggggacaagaucaacggccacuccauccacaagaucgagccgcaccugaacaccagcuggauguccugggacgggugcgaccucgacuacuacugcaacaugggcgacuggcccagcugcaccuacaccggcgugacgcagcacaaccacgcggccuucguaaaccugcugaacaucgagaccgacuacaccaagagcuuccacuuccacuccaagcgggucaccgcccauggggacacgccccaacuggaccugaaggcccgccccauguacggcgcuggagagaucaccgugcugguggaggucgcagacauggagcuccacagcaagaacaucgagauauccggccugaaguucgccagcuugaccuguuccgguugcuacgccugcagcuccggcaucagcugcaaggugagaauccacguggacgagccggacgagcucgccguccacgugaaguccgacgaccuggacguggucgccgcgagcuccucacugauggcccgcaagauagaguucggcaccgacuccacguucaaagccuucagcuccaugccuaaagagucccucugcuucuacaucguggagcgggacuucuguaaguccugcgccgcggaggacacucagaagugcgugaaggccaaguuagagcagccccagagcaucuuaaucgagcacaaggggaccaucaucggcaagcagaacgauaccugcuccaccaagaccagcugcuggcucgagagcuuuaaguccuucuucuacggacugaagaacaugcugagcggcgucuucggguccgccaucaugggcauccuccuguucuuagccccguuuauucuccugauccuguucuucuucuucggcuggcgaauccucuucugccugcggugcugccgccgaaccagggggcuguuuaaguacaaacacaucaaggacgacgaggaggccggcuacaagaagaucaucgagaagcucaacaacaagaaggguggcaccagcaagcugcuggacggggagcggcucgcggaccgcaagaucgccgagcuguucuccacgaaggcucacaucggc

SEQ ID NO: 15485 - RNA, 2916 nt, Artificial Sequence
  derived and/or modified CDS sequence (opt11) from CCHFV(66019, Artificial)__AB069669.1__Gn-4aa-Gc
agcgaagagucgggagacgacugcauauccagaacccaauugcugcgcaccgaaacagcagagguccacggagacaacuacggaggaccaggcgacaaaauaaccaucuguaacggcucgaccauaguugaccagcggcuaggauccgaacucggauguuacaccaucaaucgggugaaaucauuuaagcucugcgaaaacucaggaaccgggaaaagcugcaagauagauaauacccccguaaaaugcaggcaagguuucugccuuaagaucacacaagaaggccgcggccacguaaaacuaagccgcggaucagaggugguccucgacgccugugacagcucaugcgaaaucaugauccccaaaggcacaggagacauacucgucgacugcagcgggggccagcaacacuuucuaaaagacaaucucgucgaccucggcugcccaaacauaccccucuuaggcaagauggcgaucuacaucugccguaugagcaaccaucccaagacgaccauggccuuucucuucugguucucauucggcuacguuaucacauguaucuucugcaaaauaaucuucuaccuacugaucguaguaggcacccuaggcaaaaaguucaaacaauaccgagaacucaaaccacaaacaugcacaauuugcgaaaccacacccacaaaugccaucgaugcggaaaugcacgaccuaaaaugcucauacaacauaugccccuacugcgcgucccgucugacaucugaugggcucgcacgccacguaacgcaaugccccaaacgaaaagaaaaggucgaagaaacagaacucuaccucaaccucgaacgcaucccauggaucguucgaaaacuccuccaaguaucggaauccaccggagucgcccuaaaacguagcagcuggcuaaucguacuccucgucuugcuaaccguaucacuaucucccguucagagcgcccccauaggacgaaaaccacuauucucggacucaauuguuaaaggcaugaagaaccuguugaacucaaccagucucgaaacuucacuaagcauagaagccccauggggcgccaucaacguccaaucaacauucaaaccaaccgucucaacggcaaacauagcacuauccuggagcucaguagaacacagaggcaacaaaauccucgucucgggacgauccgaauccauaaugaaacucgaggaacgcacgggcaucuccugggaccuaggggucgaggacgcuuccgaaucgaaacucuuaacagugagcgucauggacuuaucccagauguacuccccaguauuugaauaccuaucgggagaccggcaaguagaagaauggccaaaagcaaccugcacgggaaacugccccgacagaugcggcugcaccuccagcacaugcuuacauaaggaauggccacacagcagaaacuggcgaugcaauccaaccuggugcuggggcgucggcaccggaugcacaugcugcggccucgacgugaaagaccucuucaccgacuacauguucgucaaguggaaagucgaauauaucaaaacagaggccaucgugugcguagagcuaaacagccaagaaagacaaugcucccuuaucgaggccggaacccgcuucaaccuaggcccaguaacuaucacccuuagcgaaccccgcaacauacaacagaaacuacccuccgaaauaaucacccugcaccccagaaucgaagagggauucuucgaccucaugcacguccaaaaagugcucucagccucaacggucuguaaacuccaauccuguacacacggcguccccggagaccuacaaaucuaccacaucggaaaccuccucaagggcgaccgagucaacggccaccuaauccauaaaauugaaccacacuucaacaccuccuggaugucaugggacggcugcgaccuagacuacuacugcaacaugggcgacuggcccuccugcaccuacaccggcguaacacaacacaaccacgccgccuucgucaacuuacuaaacauugagacggacuacacgaaaaacuuccacuuccacagcaagcgugugacggcgcacggagacacaccccaacuugaccugaaggcacgacccaccuacggagcgggcgagauaaccguccucguagaagucgcugauauggaacuccacacgaagaagaucgccauaagcggcuuaaaauucgccagccuaacaugcaccggcuguuacgccugcuccucugggaucuccugcaaaguccgaauccacguagacgaaccagaugagcucaccguacacguaaaaucagaagacccagacaucguagccgccucauccucgcugauggccagaaagcuagaguucggcaccgauucaaccuucaaagccuucucagcaaugccgaaaacuucacucugcuuuuacaucguggaaagagaauacugcgaauccuguucaaaagaggacacacaaaaaugcguaaacaccaagcucgagcaaccucaaagcauacuaauagaacacaaggguacgauaaucggaaaacagaacgacacaugcacggccaaagcgagcugcuggcuugaaagcguuaaguccuucuuuuacggccugaagaauaugcucucaggcaucuucggaaacgucuucauuggcaucuuccucuuccuagccccauucauacuccucauacuauucuucauguucggcuggagaauccuauucugcuucaagugcugcagaagaacgaggggauuauucaaauaucgauaccucaaggacgacgaagaauccggcuaccgcagaauaauagagaggcuaaauaacaagaaagguaaaaacaagcucuuagacggagaacgccucgccgacagaaggauugccgaacucuucagcaccaaaacccacaucgga

SEQ ID NO: 15486 - RNA, 2916 nt, Artificial Sequence
  derived and/or modified CDS sequence (opt11) from CCHFV(7001, Artificial)__AB069670.1__Gn-4aa-Gc
gccgagggcggaucaucggacugcauaucccgcacacagcuaguaaaaacggaagucgccgaaauacacgaagauagcuacggcggaccaggcgagaaaauuacaaucugcaacggcucaaccaucguagaucaacgccuggguucagaguuaggcugcuacacuauaaacagagugcgaagcuacaaacucugcgagaacagugccagcggcaaaucaugcgagauagacucaaucccagugaaaugcaaacaaggcuucugucuuaaaauaacccaggaaggacguggccacgucaaacugagccggggcacggaaauaguccuggacgucugcgacucgagcugcgaacucaugauacccaaagggaccggcgacauacucguggacugcagcggaggccaacaacacuuccuacaaaacaaccucauagaccucgguugcccaaacgucccucuacuaggaaagauggcaaucuacguauguagaauguccaaucacccaaaaaccaccauggcguuccuauucugguucucauucggauacguaauaacaugcaucgccugccgaguccuguuuuaccuacuaaucgcuaucggcaccguuggcaaaaagcugaagcaauaccgcgaacugaaaccccaaaccugcauaguaugcgagagcguuccagucaacgcgaucgacgccgagaugcacgaacuaaacugcagcuacaacauuugcccauauugcgcgucccgccucagcaccgacgggcucaucagacacgucacccaaugccccaaaagacgagaaaaggucgaagaaaccgaacuuuuccuaaaccucgaaagaauacccuggcucguacgcaaacuccuccaaguaucggaauccaccggcauggcacucaagcgcuccugcuggaugauaacccugcuaauccuacuccuggucagcaucucacccguccaauccgccccagugggaagaaaaccgcuauuccuagauaacauagcaaagggcaugaaaagccugcuuaacucuaccucgcucgagacaucccugucgaucgaagcgccauggggagcaaucaacguacaaucuacuuucaaaccaacugucuccgccgccaacaucgcccuuuccuggucaagcguggaacaccgcggaaacaaaauccuagucagcggacgcagcgagaguauaaugaaacuagaagaacgcaccggagucagcuggaaccuaggaguugaggacgccagcgaaucaaagacucuuaccgucagcguaauggaucuaucccaaauguacuccccaguguucgaauaccuauccggggaccgacaagucgaagaguggccaaaagcuaccugcaccggagacuguccagagcgcugcggcugcacauccagcacaugccuacacaaggaauggccccacucccgaaacuggcgcugcaaccccaccuggugcuggggaguaggcaccggcuguaccugcugcgggcuggaugucaaggacuucuucaccgacuacaugcucgucaaauggaaagucgaguacauaaaaacagaggccaucguaugcgucgaacuaaccucccaggagagacaaugcucucucauugaagccggcacgagauucaaccuaggacccgucacaaucacgcuaagcgaacccagaaauguucaacaacgccuuccacccgagauugucacccuucaccccaagauagaagaaggauucuucgaccuuaugcacguucagaaaauccuaagcgccagcacaguaugcaaacugcaauccugcacacauggcgucccgggcgacuuccaggucuaccacgucggcaaccugcuccgcggcgacaaagucaauggccacucaauacacaaaaucgaaccucacuucaacaccucguggaugagcugggacgguugcgaccuagauuacuucugcaacaugggagacuggccaagcugcaccuacaccggcgucacccagcacaaccgugccgccuucauaaacauguugaacauagaaacugacuacaccaagacauuccacuuccacagcaaacgaguaaccgcccacggcgacaccccacaacuagaccuaaaggcccgaccggcuuacggagcgggcgaagucaccgucuuaguugaagucgcggaccucgaacuacacacuaaaaagcucgaagucucaggccucaaaaucgccucccuuaccugcuccggauguuaugcuugcagcaguggaaucucaugcaagguacgcauccacgucaacgaaccggaugaguucacuguccacgugcgaaguuccgaccccgacguggucgccgccggaagcucgcuaauggcgcgaaaaaucgaauuuggagccgacuccaccuucaaagcauucuccuccaugccaaaagacucccucuguuucuacauuguagaaaaagacuauugcucgagcugcacagacgacgacacccaaaaaugcguuaacacaaagcuagaccacccccaaaguauccucauagaacacaaaggaacuauaaucggaaagcaaaacgauaccugcucgaccaaaaccucgugcuggcucgaguccgucaagggcuucuucuaugggcucaaaaacaugcucuccggcaucuucggcaacguauuccuuggcauauuccuauucuuagcccccuuugugcuccuaaucuucuucuucuucuucggcuggcgcuuacucuucugucucaaaugcugccgccgcacccgcggcuuacucaaguacaaacaucucaaggacgaagaggaagccggcuacaagaaaaucauagaacgacugaacggaaagaaaggcaaaucccaacucuucgacggagaacggcuagccgacagaaaaaucgccgaacucuucucaacgaaaauacacauagga

SEQ ID NO: 15487 - RNA, 2916 nt, Artificial Sequence
  derived and/or modified CDS sequence (opt11) from CCHFV(75024, Artificial)__AB069671.1__Gn-4aa-Gc
ucagaagaaucaggcgacgacugcaucagccgaacccaacuccuacgaacagaaacugccgagauccacggcgacaauuacggcggccccggggacaaaauaacuaucugcaacggaagcaccaucguugaccaacgccuuggcucggaaauggguugcuacaccauuaaucgcguaaaaucauucaaauugugcgaaaacucugccacuggcaaaagcugcgagaucgacaguauacccgucaaaugccggcagggauacugccuuaaaauaacacaagaaggacgcggccaugucaaacuaagccgcggaucagaagucguccucgacgccugugacagcuccugcgaagucaugauuccuaaaggaaccggugacauacucgucgacugcuccggcggacaacagcacuucuuaaaagacaaccucauagaccucgggugccccucaaucccccuccucgguaaaauggcuaucuacaucugcagaauguccaaccaccccaaaaccaccauggcuuuccucuucugguucuccuucgguuacgucauaaccugcauccucugcaaagcaaucuucuaccuccucauaauagucggcacccuuggaaaacgcuucaagcaauaccgcgaacuaaaaccacaaaccuguacaaucugcgaaaccacacccgcuaacgcuauagaugcagaaaugcaugaucugaacugcuccuacaacauaugccccuacugcgccucccgacucaccagcgacggccucgcgagacacguaacacaaugucccaagcgcaaagaaaaaguagaggaaaccgaacuguaccuaaaucucgaacgcauccccugggucguaagaaaacuccuucaagucucggaaucaacaggcguggcccucaaacgcucauccugguuaaucguccuccugguacucuucgccauaucauugaguccgguccagucagccccuaucggucgcaggccccucuuccuugacagcauugugcgcggaaugaaaaaucaacucaacucaaccagccuggaaaccucccuuucaauagaagccccguggggagcaaucaacguccaaucaacuuacaaacccaccguuagcaccgccaacaucgcccucuccuggucgucuguggaacaccgcgggaacaagauccuaguaucaggccgauccgaaucuauuaugaaacucgaagaacgcaccggcauaucaugggaccugggagucgaagacgccucagaauccaaacuccucacaguaucagugauggaccugucucaaauguacagcccgguauuugaauaccuuucaggggaccgacaagucgaagaguggccaaaagcuaccugcacaggagacugccccgaacgcugcggcugcaccaccucaacgugccuccacaaggaguggccacacucucgaaacuggcgcugcaacccaacauggugcuggggaguugguacaggcugcacaugcugcggccuggaugucaaagaucuauuuacagacuacaugaucgugaaauggaaggucgaauacaucaaaaccgaagccaucgucugugucgagcucaccucccaagaacgccaauguucgcucaucgaagcaggcacgcgcuuuaaucuagggucagucacuauuacccucagcgaaccacgaaacauccaacagaaacucccucccgagauaaucacccuccacccccgcaucgaagaaggcuucuucgaucuaaugcacguccagaaaguauuauccgccagcaccguaugcaagcuacaaucgugcacccacggaguacccggggaccugcaagucuaccacgucggaaaucuacucaaaggagacaaggucaacgggcaccucauacacaaaaucgagccccaccuuaacaccuccuggaugucuugggacggcugcgaccuugacuacuacugcaacaugggcgacuggcccuccugcacauacacaggaguaacacaacacaaccacgccuccuucgucaaccuucuaaacaucgagacggacuacacaaaauccuuccacuuccacuccaagcgagugaccgcccacggagauacaccacagcuggaccucaaggcgcgcccaacauauggagccggcgaaauaaccguacucguggaaguugccgacauggaguucacccccaagaagaucgaaaucagcggccuaaaauucgcgagucuuaccugcaccgguugcuaugccuguucuuccggaaucagcugcaaagugagaauccacguagaugaacccgacgaacuaacaguccacguaaaaucugacgaccccgacgugguagccgcauccucuucucucauggcaagaaagcuagaguucggcaccgacuccaccuucaaagccuucuccgcuaugcccaaaaccucucucugcuucuacauugucgagagggaauauugcaaaucaugcucaaaggaagacacccaaaaaugcguaaacacgaaacuugaacaaccucaauccauccugaucgaacacaaaggaaccaucauuggcaaacaaaauaacacuugcaccgcgaaagccagcugcuggcucgaauccguaaaauccuucuucuacggccuuaaaaauaugcucucagggaucuucggaaaccuguucaugggcaucuuccuauuccuagcccccuucauccuccucauacuauucuucauguuuggcuggcgaauccucuucuguuucaaaugcugccgccgcacucgaggccucuucaaauaccgccacuuaaaagacgacgaggaaaccggcuaccggcgaaucaucgaaagguuaaacaacaagaaaggaaagaauaagcugcuagacggcgaacgcuuagcugaccgccgcaucgccgaacuauucuccacgaaaacacacauaggc

SEQ ID NO: 15488 - RNA, 2916 nt, Artificial Sequence
  derived and/or modified CDS sequence (opt11) from CCHFV(7803, Artificial)__AB069672.1__Gn-4aa-Gc
agugaggaguccggcgacgacugcaucagccgcacccaguugcuccggaccgagacggccgagauccacggggacaacuacggcgggcccggcgauaaaaucaccaucugcaacggguccaccaucguggaccagcgcuuaggcagcgagaugggcuguuacaccaucaaccggguuaaguccuucaagcugugcgaaaacagcgccacggggaaguccugugagaucgacagcauaccggucaaaugccgccagggcuacugccucaaaaucacccaggaggggcggggccacgugaaacugagucgcggaucugaggucauccuggacgcgugcgauuccagcugugaggugaugauccccaagggcaccggcgacauccucguggacugcuccggcgggcagcagcacuuccugaaggauaaucugaucgaccucgggugccccagcaucccccugcuggggaagauggccaucuacaucugccggauguccaaccacccgaagaccacgauggccuuccucuucugguucagcuucggcuacgucaucacgugcauccugugcaaggcaaucuucuaccugcucaucaucguugggacgcugggcaagcgcuucaagcaguaccgggagcugaaaccccagaccugcaccaucugcgaaaccaccccagccaacgcgaucgacgccgaaaugcacgaccucaacugcuccuacaacaucugccccuauugcgccagccgccugaccuccgacgggcuggcccggcacgugacgcaguguccgaagcgcaaggagaaggucgaggagaccgagcucuaucugaaccuggagcggauucccuggguggugcgcaaauuacugcaagucagcgagagcaccggcguggcccugaagagguccaguugguugauugugcugcugguccucuucgccaucucccugagccccgugcagagcgcccccaucagccggcguccgcuguuucucgacuccaucgugcgcgggaugaaaaacccccugaacagcaccucccuggagacgagccucuccaucgaggcccccuggggcgccaucaacguccagagcaccuacaagcccaccgugucuaccgcgaacaucgcccugagcugguccagcguggagcaccgggggaacaagauccuggucuccgggcgcagcgaguccaucaugaagcucgaggaacggacgggcaucagcugggaccuggggguggaggacgcaagcgaguccaagcugcucaccgugucugucauggaccugucccagauguacagcccgguguucgaguaccuguccggcgaccgccagguagaggaguggcccaaggcgaccugcacgggagacugccccgagcgcuguggcugcacgacgagcaccugucuccacaaggaguggccccacucccggaacuggcgaugcaacccgaccuggugcuggggcguggggaccggcugcacgugcugcgggcuggacguuaaggaccuguucaccgacuacaugaucgucaaguggaagguggaguacaucaagacccggggcaucgugugcgucgaacucacuagccaggagcgccagugcucccugaucgaggccgggacccgguucaaccugggcagcgugaccaucacccuguccgagccccguaacauccagcaaaagcucccgcccgagaucaucacccugcacccccggaucgaggagggcuucuucgaccucaugcacgugcagaagguccucagcgcauccacgguguguaaacugcaaagcugcacccacggggugcccggcgaccugcaagucuaccacguggggaaccuccugaagggcgacaaggugaacggccacuuaauccacaagaucgagccccaccucaauaccuccuggaugucgugggacgggugcgaccuugacuacuacugcaacaugggcgacuggcccuccugcaccuacacgggggucacccagcacaaccacgccagcuuugugaaccugcucaauaucgagaccgacuacaccaagagcuuccacuuccacuccaagcgggugacggcccacggcgacaccccacaacuggaccugaaggcccggccgaccuacggugccggcgagaucaccguccuuguggagguggcggacauggaguucacccccaagaagauagagaucagcggccugaaauucgcuucccugaccugcaccgggugcuacgccugcagcuccggcaucagcugcaagguccgcauccacguggacgagccggacgagcuaaccgugcacgucaaaucagacgaccccgacgugguggcggccagcuccagccugauggcgcggaagcuggaguucgggaccgacuccaccuuuaaggccuucagcgccaugcccaagaccucccucugcuucuacaucgucgagcgcgaauacuguaagagcuguuccaaggaggauacgcagaagugcgugaacacgaagcuggagcagccccagagcauccugaucgagcauaagggcaccaucaucgggaagcagaacaacacgugcaccgccaaggcguccugcuggcucgagucagugaaguccuuuuucuacggccugaagaacaugcugagcggcaucuucgggaacuucuucaugggcaucuuucucuuucuggccccguucauccugcugauccuguucuucauguucggguggcggauccuguuuugcuucaagugcugccgccggacccgcggccuuuucaaguaccggcaccuuaaggacgacgaggagaccgguuaccgccggaucaucgagagacugaacaacaagaagggcaagaacaagcuccuggacggcgagcgccuggcggaccggcgcaucgccgagcuguucagcacgaagacccauaucggg

SEQ ID NO: 15489 - RNA, 2916 nt, Artificial Sequence
  derived and/or modified CDS sequence (opt11) from CCHFV(79121, Artificial)__AB069673.1__Gn-4aa-Gc
gccgaaggaggauccucagacugcaucagccggacccagcucguaaaaacagaggucgcagaaauccacgaagacagcuacgggggccccggcgagaaaaucaccauaugcaacggaagcaccauagucgaccaaggucuagguucagaacuaggcugcuacacaaucaacagaguccgcuccuacaaacuaugcgaaaacucagccuccggcaaaucgugcgaaauagacucaaucccugucaaaugcaaacaaggauucugccucaaaaucacucaagaaggcagaggacacgucaaacuaucacgcggcacggaaauaguccucgauguaugcgacagcagcugcgaacucaugauccccaaagguaccggcgacauucucgucgacuguuccggcggccaacaacauuuccuccaaaacaaccucaucgaccuaggaugcccgaacgucccacuccuaggcaaaauggcaaucuacguaugccgaauguccaaccacccuaagacgacaauggcauuccuauucugguucuccuucggauacgucauaaccugcaucgcuugccgcgugcuauucuaccuacuuaucgccaucggcacagugggcaagaaacugaagcaguaccgcgaacuaaaaccccaaacuugcaucgucugcgaaucagucccagucaacgcaaucgacgccgaaaugcacgaacucaacugcagcuacaacauaugccccuacugugcaagccgauuaucaacagacggccucauccgacacguaacacaaugucccaaaagacgcgagaaaguagaagaaacagaauuguuucucaaccuugaacgcauccccuggcucgugcguaaacugcuacaggucuccgaguccacaggaauggcccucaaacgaagcugcuggaugaucacacuccucaucuuacuacucguauccaucucucccguccaguccgcacccgucggccguaaaccccucuuccuagauuccaccgccaagggcaugaaaagccuccuaaacagcacaagccucgaaaccagccuauccaucgaagcucccuggggagcaaucaauguccaaucuaccuuuaaaccuacagucagcgccgcaaacaucgcccuuagcuggucaagcgucgaacaucgagguaacaaaauccuagucucaggacguagugaguccauaaugaagcuggaagaacggaccggagucagcuggaaccugggcguagaagacgccuccgagagcaagacgcucaccguuucaguaauggaccucucccaaauguacucgccugucuuugaauaccuaagcggagaccgacaaguagaagaauggcccaaggcaacauguacaggagacugccccgaacgauguggcugcaccagcucgaccugucugcacaaggaauggccacauucaagaaauuggcgaugcaauccgaccuggugcuggggcgucggcacuggcuguaccugcugcggucuggauguaaaagacuuuuucaccgauuacauguuggugaaauggaaagucgaguacauaaagaccgaagccauugucuguguggaacuaaccucacaggaacgacaaugcagcuugaucgaagcgggcacacgauuuaaccuuggucccgucaccaucacccucuccgagccccgaaacgugcaacaaagacugccacccgaaauagucacucuccaccccaaaaucgaagaaggcuucuuugaccucaugcacguccagaaaauacucuccgcauccaccgucuguaaacuacaauccugcacccacggagucccuggagacuuccaaauauaccacgucgggaaucuccuccgaggggauaaagugaacggacacagcauccacaaaauagaaccccacuucaacaccagcuggaugagcugggacggaugcgaucucgacuacuucugcaacaugggugacuggccauccugcacauacacaggagucacacaacacaaccgcgccgcauucauaaacaugcucaacaucgagacagacuauacaaaaacuuuucacuuccacuccaaacgagucacagcccacggagacacaccccaauuggaccucaaagcccgaccagcauacggugccggagaggucaccguccucgucgaagucgccgaccuugagcuccacaccaaaaaccucgaagucuccggccuaaaaauagccucacucacaugcagcggaugcuaugcauguucuuccggcaucucaugcaagguccgcauccacgucaacgaacccgacgaguucacaguccacguccgaucaagcgacccggacguaguagcagccggcuccucgcuuauggcacgaaaaauagaguucggcgcggacucaaccuuuaaagcauuuucgagcaugcccaaagacucacugugcuucuacaucguagaaaaggauuacugcucgucuugcacagacgacgacacccaaaaaugcgugaacaccaagcucgaccacccccaauccauccucaucgaacacaaagggacaaucauaggaaaacaaaacgauaccugcuccaccaaaacuucgugcuggcuggaaagcguaaaaggcuucuucuacgggcugaaaaacaugcuauccggcauauuuggcaacguauuccucgggaucuuccuauuccuagcacccuucguccuacucaucuucuuuuucuucuucggcuggcgacuacuauucugccucaaaugcugcagacgaacaagaggguuacugaaauacaaacaccuaaaagacgaagaagaagcgggguacaagaaaaucaucgagcgccugaacggcaagaaaggcaaaucccaacucuucgacggagaaagacuggcagaccgcaaaauagccgagcuguucucaaccaaaauccacauugga

SEQ ID NO: 15490 - RNA, 2916 nt, Artificial Sequence
  derived and/or modified CDS sequence (opt11) from CCHFV(8402, Artificial)__AB069674.1__Gn-4aa-Gc
agcgaagaaucaggagacgacuguauuucacgcacgcaacuccucagaacugaaacagccgaaauucacaacgacaauuacggagggccaggcgacaagaucacaaucugcaacgguuccacggucgucgaccaacgucucggcucugaacuagguugcuacacaauaaaucguguaaaauccuucaaacucugcgagaacucagccaccgggaaauccugcgaaaucgacucaacgccaguuaaaugccgccaaggcuucugcuuaaaaauaacccaggagggccgaggacacgucaaacugaguagaggcagcgaagucguacucgacgcaugcgacucaucgugcgaaaucaugaucccgaaagguacgggagacauucucguggacugcuccggaggacagcaacacuuccuaaaggacaaucuuauagaccucggaugccccaacaucccccuucucggaaaaauggccauauacaucugucgcauguccaaccaccccaaaacaacgauggcguuccuuuucugguuuucauucggauacgucgucacaugcauacuuugcaaaguaaucuucuaccuccuuaucgucguaggaacucucggaaagaaguucaaacaguaccgagagcugaagccacaaaccugcaccaucugcgaaacuacgcccgucaacgcuaucgacgcagagaugcacgaccucaacugcaguuacaacaucugccccuacugcgcaucacgccucaccuccgauggacucgcccgucacguaaugcaaugcccaaaacggaaagaaaagauagaagaaacagaacucuaccucaaccucgaacggaucccgugggucgucagaaaacuacuccagguaucugaguccacaggcgucgcccucaaacgauccucauggcucguuguccuacucguacuacugaccgucuccuugagccccguccaauccgcacccaucggucgcaaaccccucuuuuccgacagcaucguaaaaggcaugaaaaaccuuuugaacucaaccagucuugagacaucccuauccaucgaggcacccuggggagcaaucaacguccaaucaaccuucaaacccaccgucuccgcugccaacaucgcacucagcugguccuccguugaacaccgggggaacaaaauacucgucuccggacgauccgaaagcaucaugaagcuggaagaacguacaggcauuuccugggaccuaggcgucgaggacgccucggaaucaaaacuacuaacaguguccguaauggaccucagccaaauguacucaccaguauucgaguaccucuccggcgaccggcaagucgaggaauggcccaaggcaaccugcacuggggacugccccgagcgcugcgggugcacauccuccacaugucuucacaaggaauggccccacucccguaacuggcggugcaacccaaccuggugcuggggcgucggcacaggcuguaccugcugcggacucgaugucaaagaucuuuuuaccgacuacauguucauaaaauggaaggucgaguacauaaagaccgaagccaucguaugcgucgaacuuacaucccaagaacgccaaugcacccucaucgaggcaggaacacgcuucaaccuaggccccguaaccauaacgcuaucagaaccgcgcaacauccaacaaaagcuaccgccagaaaucgucacccuacacccccgaauugaagaaggcuucuucgaccucaugcacguccaaaaaguacuauccgccucuacugucugcaaauuacaauccugcacacacgguguccccggcgaucuccagguauaccacauaggaaaccuacucaaaggggacaaggucaacggacaccuaauacacaaaaucgaaccccauuucaacaccucuuggaugucaugggacggcugcgaccucgacuacuacugcaacaugggugacuggccaucaugcaccuacacgggcguaacccaacacaaccacgccgcguucgucaauauguuaaauaucgaaacagacuacacuaaaaacuuccacuuccacaguaaacgggucaccgcccacggggauacuccccaacuugaccucaaagcgagaccgaccuacggcgccggcgaaauaacaguccugguagagguagccgacauggaacuacacacaaagaaaaucgagaucuccggccucaaauuugccucccugaccugcaccggcugcuacgccugcucguccggcaucuccugcaaagucaggauccacgucgacgaacccgacgagcugacaguucacgugaaauccgaagaucccgauaucguugccgccucauccucccuaauggcucggaaacucgaguucggaaccgauucaaccuuuaaggccuucucggccaugccuaagacaucgcucugcuucuacaucguagaacgggaauacugcaaaagcugcuccaaggaagacacacaaaaaugcgugaacaccaagcucgaacaaccccaaucaauccuaauagaacacaaaggcacaauaauaggcaagcaauccaauaccugcacugccaaagcguccugcuggcucgaaucagugaaauccuucuucuacggacucaaaaacaugcuaagcggcauuuucggaaacgucuucaucggcguauuccucuucuuugcacccuucauccuccuuauucuauucuuuauguucggcuggagaauccucuucugcuucaaaugcuguagacgcacccgaggacucuuuaaauaccgccaccuuaaagacgacgaagaaaccggauaccgaaagaucaucgagcgccucaacaacaagaaaggcaaaaacaagcuccucgacggagaacgccuggcagaccgcaaaauugccgaacucuucuccaccaaaacccacauuggu

SEQ ID NO: 15491 - RNA, 2916 nt, Artificial Sequence
  derived and/or modified CDS sequence (opt11) from CCHFV(88166, Artificial)__AB069675.1__Gn-4aa-Gc
uccgaggaaagcggcgacgacugcauuagccgaacccaacugcuacgaaccgagacagcagaaauacacuccgacaacuacggcggcccaggagacaagaucacaaucugcaacggauccaccguugucgaccagcgccuuggcucagaacuaggcuguuacacaauaaacagaguaaagagcuuuaagcucugcgaaaacagcgccacagggaaguccugcgagauugacuccacacccgucaaaugccgacagggauucugccucaaaauaacccaagagggccgaggccacguaaagcuaagccggggcagugaaguagugcucgacgcgugugacuccucgugcgaaauaaugaucccuaaaggcacgggugacauacucgucgacugcagcggcggccagcaacacuuucucaaagacaaccucaucgaccucggcugcccaaacaucccgcuccucggaaaaauggcgauauacauaugcagaaugucaaaccaccccaaaaccaccaugggguuccuuuucugguucucguucggcuacguagucacaugcauccuaugcaaagugauauucuaucugcuaaucgucguaggcacacuaggcaaaaaguuuaagcaauaccgggagcuaaagccacaaaccugcaccaucugcgaaaccacuccagugaacgcuauagacgccgaaaugcaugaccucaacugcagcuacaacaucugccccuacugugcaucccgccuuaccucagacggccucgcccgccacgucaugcagugccccaaaagaaaagagaaaaucgaagaaacagaacuauaccucaaccucgaacggaucccuugggucguccggaaacuccuacaaguaucagaaucgaccggagucgccuuaaaacgcucgagcuggcucgucguccuacucgugcuacuaacaguaucccuguccccaguucaauccgccccaaucggacggaaaccccucuucuccgacuccaucgucaaaggaaugaaaaaucuucucaacuccaccucccuugaaaccagccucuccaucgaagcuccuuggggagcgauuaacguccaguccaccuucaaaccuaccauguccgcugcaaauauugcccucucauggaguucuguugaacaccgcggcaacaaaauccucgugucaggacgcuccgaauccaucaugaaacucgaagaacgcacagguaucucauggaacuuaggcguggaggacgccuccgaaagcaaacuccuaaccguaucagugauggaccuaucgcaaauguacucaccugucuuugaguaccuuucaggcgacagacaaguagaggaauggcccaaagcgacuugcacaggagauugccccgaacgcugcggcuguaccucuuccacuugccugcacaaggaauggccacacucacggaacuggcgaugcaauccaacguggugcuggggcgugggcacaggcuguaccugcugcggcuuagaugucaaagaccuauucaccgacuacauguucaucaaauggaaggucgaauacaucaaaacggaagcaaucguauguguggaacucacuucgcaagaacgccaaugcacgcuuauagaagcgggcacccgauucaaucucggcccggucacaaucacccucucugagccccgcaauauccaacaaaaacuacccccagaaaucguaacucuucacccaagaauagaagaaggauucuucgaccuaaugcacguccaaaagguacuauccgcuagcacugucugcaaacuacaaucaugcacacauggcguccccggcgaccuucaagucuaccacauaggcaaccuccuaaaaggagacaaaguuaacggacaccuaauucacaagauagaaccccacuuuaacaccucauggauguccugggacgggugcgaccuagacuacuacugcaacaugggagacuggcccucuugcacauacacaggcgugacacaacacaaccacgcagcauucgucaacaugcuaaacauagagaccgacuacaccaaaaacuuccacuuccauuccaaacgagucaccgcacacggagauaccccacaacucgaccuaaaagcacgacccaccuacggcgccggugagaucaccguacugguggaaguagccgacauggagcuacacacgaagaaaaucgagauauccggacuaaaauucgccucacuaaccugcacgggcugcuacgcuugcucaagcgggauauccugcaaaguccgcauacacgucgacgaaccugacgagcucacuguacacgucaaauccgaagacccugaccucgucgccgccuccuccagccugauggcacgcaaauuggaauuuggcaccgacagcaccuucaaagccuuuucggccaugccuaaaacaucccucugcuucuacaucguggaacgcgaauacugcaaaucauguagcaaagaggacacacagaaauguguuaacaccaaacuagaacagccccaaucaauccuuaucgaacacaagggaaccaucaucggcaaacaaaacaauaccugcaccgccaaggccuccugcuggcuugaaagcguaaaaucuuucuucuacggucucaaaaacaugcucagcggaauuuucggcaacguauucaucggagucuucuuauucuucgccccuuuuauucuccucauccuauucuucauguucgguuggcgcauacucuucugcuuuaaaugcugccgcagaacgagaggccucuucaaauaucgccaccucaaagacgacgaagagacaggauaucguaaaaucaucgaacgccuuaacaacaagaaaggcaaaaacaaacuccuggacggcgagcgacuagccgacaggaaaauagcagaacuauucagcacaaaaacucacaucggu

SEQ ID NO: 15492 - RNA, 2916 nt, Artificial Sequence
  derived and/or modified CDS sequence (opt11) from CCHFV(BA88166, Artificial)__AF338470.1__Gn-4aa-Gc
uccgaggaguccggagacgacugcauaagccgcacacaacucuuacguaccgaaaccgccgaaauucauuccgacaacuacggcggccccggagacaagaucaccaucugcaacggauccacagucgucgaccaacggcuaggcuccgaacugggaugcuacaccauaaaccgagucaaaucauucaaacucugcgaaaacucagcgacggggaaguccugcgagaucgacagcacaccgguaaaaugccggcagggcuuuugccucaaaauaacacaggagggacgcggccacguuaaacucagcaggggcucagaagucguacuagacgccugcgacagcagcugcgaaaucaugauacccaaaggaaccggggacauacucguugacugcagcggcggacaacaacacuuccuaaaagacaauuugaucgaccuaggcugcccaaacaucccgcuacucggaaaaauggcaauauacauaugccgcaugucaaaccacccaaagacgacaaugggcuuccucuuuugguucuccuucggcuacgucgucaccuguauacucugcaaagggaucuucuaccugcucaucguagucggaacacucgguaaaaaguucaaacaguaccgcgaacucaaaccacagacaugcaccaucugcgaaacuaccccagucaacgcaaucgacgccgagaugcaugaccuaaacugcuccuacaauaucugccccuauugcgccucacgauugacaagugacggccuugcacgacacgucaugcaaugcccaaagcgaaaagagaaaaucgaagaaacagaauuguaccuaaaccucgaacgcauaccaugggucguccguaaacuacuucaggucuccgaaagcacaggagucgcgcuaaaacgauccagcuggcuagucguacuccuaguacuccucaccguaagccugagcccaguccagagugccccgaucggccguaagccacuauaccuggacuccaucguuaaaggcaugaaaaaccuuuuaaacuccacaucacucgaaacaucccucucuaucgaagcacccuggggcgccauuaacgugcaaucaaccuucaaaccgaccauguccgccgcaaacaucgcacucuccuggucaagcguagaacaccgcggcaacaaaaucuuaguaucuggcagauccgaaucaaucaugaaacuggaagaacgaaccggcauaaguuggaaccucggaguugaggacgcaagcgagagcaaacuccuuacagucuccgucauggaccuaucucagauguauuccccgguuuucgaguaccucuccggcgaucggcaagucgaagaauggccaaaagccaccuguacgggcgacugcccagagcgaugcgggugcaccuccucgaccugccuccacaaagaauggccccauagccgcaacuggcgaugcaaccccacauggugcuggggcgucggcacuggaugcacaugcuguggccucgacgucaaagaucucuucacggacuacauguucaucaaauggaaagucgaauacauaaagacagaagcaauaguaugcguagagcuaaccucacaagagagacagugcacucucaucgaggccggcacccguuucaacuuaggccccguaaucaucacccuuuccgaaccgcgcaacauucaacaaaagcucccgccugaaaucgucacccuccaccccagaauagaggaaggcuucuucgaccucaugcacguucaaaaaguacucucagcauccaccgucugcaagcuccaaaguugcacacauggcgugcccggagaccuccaaguguaccacauaggcaaccuacuaaaaggagacaaaguaaacggccaccuaauccacaagaucgaaccccacuucaacacuucuuggaugagcugggacggaugcgaccucgacuacuacugcaacaugggcgacuggcccucguguacauacacgggcgucacacaacacaaucacgccgcuuuuguaaacaugcugaacaucgaaaccgacuacaccaagaacuuccacuuccacuccaaaagaguuaccgcccacggagacacuccccaacucgaccucaaagcacgcccgaccuacggagcgggcgaaaucaccgugcucgucgaagucgcagacauggaauugcacacgaagaaaaucgagaucagcggccucaaauucgcaucacuaaccugcacaggcuguuacgcaugcuccagcggaaucagcugcaaagucagaauccacgucgaugagcccgacgaacucacgguacacgucaaaucagaagaccccgacauaguagccgcaucguccucuuuaauggcucgaaaacuagaguucggaacagacuccaccuuuaaagccuucucagcaaugccgaaaaccagccucugcuuuuacaucgucgaacgagaauacugcaaauccugcuccaaggaagauacgcaaaaaugcgucaacacuaaacucgaacagccccagagcaucuuaaucgaacacaaaggcacaauaauuggcaaacaaaacaauaccugcaccgcuaaggccuccugcuggcucgagagcgugaaauccuucuucuacggacucaaaaauaugcuuuccggcaucuucggcaacgucuucaucggaguuuuccuguucuuugcucccuucauacuucucauacuauucuucauguuuggcuggcgcauccucuucugcuucaaauguugccggcgcacgcgcggccucuucaaauacagacaccuaaaggacgacgaagaaacaggcuaccgaaagauaauugaacgccuuaacaacaaaaagggcaaaaauaaacuacuagacggagaacgacuggccgaucgcaagaucgcagaacucuucucaacuaaaacccauaucggc

SEQ ID NO: 15493 - RNA, 2916 nt, Artificial Sequence
  derived and/or modified CDS sequence (opt11) from CCHFV(BA66019, Artificial)__AF350448.1__Gn-4aa-Gc
agcgaggaguccggcgaugacugcaucagccgaacccagcugcuccggaccgagacggccgaggugcacggggacaacuacggcgggcccggagacaagaucaccaucugcaacggguccaccaucgucgaccagaggcugggcuccgagcugggcugcuacaccaucaaccgggugaaguccuucaaacucugcgagaacagcgggacgggcaaguccuguaaaaucgauaaacacccgguaaagugccgccagggguucugucugaagaucacccaggagggccgggggcacgucaagcugagccgcggcucggagguggugcucgacgccugcgacagcuccugcgaaaucaugauacccaagggcacaggggacauccuggucgacugcagcggcgggcagcagcacuuccugaaggauaaccucguggaccugggcugccccaacaucccccugcucggcaagauggcgauauacaucugccggauguccaaccacccgaagaccacgauggccuuccuguucugguucagcuucggguacgucaucacgugcaucuucugcaagaucaucuucuaccugcucaucgucguggguacccuggggaagaaguucaagcaauaccgcgagcugaagccccagaccugcaccaucugcgagaccacccccaccaacgccaucgacgccgaaaugcacgaccucaagugcuccuacaacaucugccccuacugcgcaagccggcuuacguccgacggccuggcgcgccacgucacccagugcccgaagcggaaggagaagguggaggagaccgagcucuaccugaaccuggagcgcauccccuggaucgugcggaagcuccuccaggugagcgagucgaccggggucgccuuaaagcgaagcagcuggcuaaucgugcugcuggugcuccugacugucuccuuaucccccgugcaauccgcccccaucggccggaagccccucuucagcgacuccaucgugaagggcaugaagaaccugcuuaacagcaccucccucgaaaccagccuguccaucgaggcccccuggggcgcgaucaacguccagagcaccuucaagcccacgguguccaccgcgaacaucgcccugagcugguccagcguggagcaucgcgggaacaagauccucgucuccgggcggagcgaguccaucaugaagcuggaggagagaaccggcaucagcugggaccucgggguggaggacgccuccgagagcaagcuccugaccgucagcgugauggaccucucccagauguacagcccgguguucgaguaccucuccggcgaccggcagguagaggaguggccgaaagccacuugcacgggcgacugccccgaccgcugcgggugcaccagcuccacgugccugcacaaggaguggccccacagccggaacuggcgcugcaaccccaccuggugcuggggcguggggaccggcugcacuuguugcgggcuggacgugaaggaccucuucaccgacuacauguucgucaaguggaagguggaguacauaaagaccgaggcgauugugugcgucgagcugaacucccaagagcgccagugcagccuaaucgaggccggcacccgguuuaaccugggcccggugacuaucacccucuccgaaccccgcaacauccagcagaaguugccgcccgagaucaucacccugcacccgcggaucgaggaaggguucuucgaccucaugcaugugcagaagguccugagcgccuccacgguguguaaacuucagagcugcacccacggcgugcccggggaccuccagaucuaccacaucggaaacuuacugaagggcgaccgcgucaacgggcaccucauccacaagaucgagccccacuucaacaccuccuggaugagcugggacggcugcgaccuggacuauuacugcaacaugggggacuggcccuccugcaccuacacgggcgugacccagcacaaccacgccgccuucgugaaccugcucaacaucgagacugauuacaccaagaacuuccacuuccacagcaagcgggucacggcucacggggacaccccgcagcuggauuuaaaggcccgccccaccuacggcgcuggcgagauuaccgugcucguggaggucgccgacauggagcugcacacgaagaagaucgccaucuccgggcugaaguucgcgucucugaccugcaccggcugcuacgcuugcagcuccgggaucagcugcaaggugcggauccacguggacgagcccgacgagcugaccguccacgugaagucggaagaccccgacaucguggccgccagcuccagccugauggcccgcaagcucgaguuuggaacggacuccaccuucaaggcguucagcgccaugcccaagaccucccucugcuucuacaucgucgagcgggaguacugcgagagcugcuccaaggaggacacccagaaaugcgugaacacgaagcuggagcagccccagagcauccucaucgagcacaaggggaccauaaucggcaagcagaacgacacauguaccgccaaggccuccugcuggcuggaaagcgugaagucauucuucuacgggcugaagaacaugcucagcgggaucuucggcaacgucuucaucggaaucuuccuguuccuggcgcccuuuauccuccugauccuguucuucauguucggcuggcgcauccuuuucugcuucaaguguugccggcgcacccgggggcuguucaaguaccgcuaccugaaggacgaugaggaguccggguacagacgcaucauagaaaggcucaauaacaaaaagggcaagaacaaauugcuggacggugagcgccucgccgaccgaagaaucgccgagcuguucagcaccaagacccacaucggu

SEQ ID NO: 15494 - RNA, 2916 nt, Artificial Sequence
  derived and/or modified CDS sequence (opt11) from CCHFV(BA8402, Artificial)__AF350449.1__Gn-4aa-Gc
ucagaagaauccggcgaugacugcaucagcagaacccagcuucugcguacagaaaccgccgaaauucacaacgacaacuacggcgggccaggcgauaaaaucacuauaugcaacgguagcacuguuguggaccaaagacuaggauccgaacucggcugcuacaccaucaacagagucaacuccuucaaccuaugcgaaaacaccgccacaggcaaaucgugcgaaaucgacagcaccccagucaaaugcagacaagguuucugccugaagauaacucaagaaggccgaggccaugucaaacuaucaagaggauccgaagucguacuggaugccugcgaaagcagcugcgaaauuaugauccccaaagggacuggagacauccucguagacuguagcggcggacaacagcacuuucugaaagacaaccugaucgaccuaggaugccccaacauccccuuauuaggcaaaauggccauauacaucugccguaugucaaaccacccaaaaaccaccauggcauuucuguucugguucuccuucggcuacgucguaaccugcauacucugcaagguaaucuucuaccuacucauagucgugggaacgcuaggaaagaaauucaaacaauaccgcgaacucaaaccccaaaccugcacuauaugcgaaaccacccccgucaacgcaauagacgcggaaaugcacgaccucaacugcaguuacaacauaugccccuacugcgcaucccgccccacgagcgacgggcucgcgagacacguaaugcaaugccccaaacgaaaagagaaaauagaagaaaccgcccucuaccuaaaccuagaacgcauaccaugggucgucagaaaacuacuccaagucucggaaucaaccggugucgcccugaaaagauccagcuggcuugucgugcuccucguccuacugaccgucucguuaucgcccguacaauccgcuccaaucggccgaaaaccccuuuucuccgacucaauagugaagggcaugaaaaaccuccucaacucaacaagccucgaaaccucccuaucaaucgaggccccauggggagccaucaacguacaauccaccuucaaacccaccguguccgcggcaaacaucgcccuuucauggucgucagucgaacaccgagggaacaaaauccuagucucaggccgcagcgaaucaauaaugaaacuagaagaaagaacgggcauaucuugggaccucggcgucgaggaugccucagaauccaaacuccucacaguaucagucauggaccuaagccaaauguacuccccggucuucgaguaccuaagcggcgaccgucaaguagaagaguggcccaaagccaccuguacgggagacugucccgaaagaugcggcuguaccuccucaaccugucuacacaaagaauggccccacucccgaaacuggcgcugcaaccccacauggugcuggggaguuggcaccgguuguaccugcugcggacuagauguuaaagaccucuucacggacuauauguucauuaaauggaaggucgaguacaucaaaaccgaagcaauaguaugcguagagcugaccagccaagaacgucagugcacacucaucgaagccggcacgcgcuucaaccucggacccguuacaaucacgcucuccgaaccccgcaacauccaacaaaaacucccucccgaaaucguaacccugcacccccgcaucgaagaaggauuuuucgaccucaugcacguccaaaaagucuuguccgccagcaccgucugcaagcugcaaucaugcacacauggcguccccggagaucuccaagucuaucacaucggcaaccuucugaagggagacaaggucaacggccaccucauccauaaaaucgagccccacuuuaauacauccuggaugucaugggacgggugcgaccuacacuacuacugcaacaugggagauuggccuaguugcaccuauacgggugucacucaacacaaccacgccgccuucgucaacaugcuaaacaucgaaaccgacuauacgaaaaacuuccacuuccacuccaaacgcguuacagcgcacggcgacacaccccaacucgaccucaaagcccgcccgacguacggcgccggcgagaucaccguccuggucgaaguugccgacauggaacuccacaccaaaaagaucgaaaucucaggccugaaauucgcaagucuaacaugcaccggcugcuacgcaugcucaagcggcaucucaugcaaaguccgcauccacgucgacgaacccgacgaacucaccguccacgugaaaucagaagacccggacaucguagcagcaucgagcucacucauggcccgaaaauuagaauuuggcaccgacuccaccuucaaagccuucuccgccaugcccaaaaccagccuuugcuucuauaucguagagagagaauacugcgaauccugcagcaaggaagacacccagaaaugcgucaacaccaaacucgaacaaccgcaaagcauccucauugagcacaaaggcacuaucaucggcaaacaaucgaauaccugcacggcaaaagcaucuugcuggcucgaaagcgucaaauccuucuuuuacggccucaaaaacaugcuauccgguauuuuuggaaacguguuuaucggaguauuccuauucuucgcccccuucauacuccuaauccucuucuucauguucggcuggcgcauccucuucugcuucaaaugcugccgacgcacccgaggacucuucaaauaccgccaccuaaaagacgacgaagaaaccggcuaccggaagauaaucgagcgccuaaacaacaagaaaggcaaaaauaaacugcuggacggcgaaagacucgccgaccgcaaaaucgccgaacucuucuccacgaagacccacaucggc

SEQ ID NO: 15495 - RNA, 2916 nt, Artificial Sequence
  derived and/or modified CDS sequence (opt11) from CCHFV(Matin, Artificial)__AF467769.2__Gn-4aa-Gc
ucagaagaauccggcgaugauugcauauccagaacccaacuccuacggacagaaacggcagaaauccacuccgacuccuauggcggccccggcgauaagaucaccauaugcaacgggucaacagucgucgaccaaagacucggcagcgaauuagguuguuacacaauaaaccgaguaaaaucuuucaaacucugcgaaaauucugcaaccggcaagucuugcgaaauagacuccacccccguaaaaugucgccaaggguucuguuuaaaaauaacccaagaaggacgggggcacgugaagcucucccgcggcucagaaguaguccucgacgccugcgauagcuccugcgaaauuaugaucccuaaaggcacaggcgacaucuuaguagacugcucaggcggccagcaacacuuccucaaagauaaccuuaucgaccuagggugcccuaacaucccauugcucggaaaaauggcaauauauauaugccgcauguccaaccaccccaagaccaccaugguguuccuguucugguucucuuucggcuauguaaucacgugcauacuaugcaaaguaauauucuaccuucucaucguaguaggcacccuaggaaagaaauuuaaacaauacagggagcuaaaaccacagacgugcaccaucugcgagaccacaccaguaaacgcaauugacgcagagaugcacgaccuuaacugcagcuacaacaucugcccauacugcgccucccgacugaccucagauggacucgcgcgacacgucaugcaaugcccaaagcgcaaggaaaagaucgaagaaaccgagcuuuaccuaaaccucgaacggauacccugggucguccguaaacuacuccaaguguccgaaucaacuggagucgcgcucaaacgaagcucguggcucgucguacuuuuagugcuucuuaccgucucgcuaagcccgguccaguccgccccaauaggacgcaaaccccuauuccucgacucgaucauaaagggaaugaaaaaccuccucaacuccacaucucucgagaccucccucucaauugaagcccccuggggagcuauaaacguacaauccacauucaaacccacaaugagcgccgccaacauagcgcucuccuggucaaguguagagcaccgcggcaacaaaauacugguguccggacggagcgaaucgaucaugaaacucgaagaacgcaccggcauaucaugggaccuuggcguagaagacgcgagcgaauccaaacugcuuacggucagcgucauggaccuuucccaaauguacagccccgucuucgaauacuuauccggagaccgacaaguggaagaauggcccaaagccacuugcaccggcgacugcccugagcgcugcggcugcacauccucuaccugccuccacaaagaauggccacacagcagaaacuggcgcuguaaccccacauggugcuggggagucggcacaggcuguacauguugcggacucgacgucaaagaccuauucaccgacuacauguucgucaaauggaagguagaauacaucaaaaccgaagugaucgucugcgucgaacuaacaucucaagagcgccaaugcucucucauugaagcagggacacgguucaaccuaggaccagugaccauaacucuaucagaaccccgcaacauccaacagaaacugccuccagaaaucgugacucuccacccaagaaucgaagagggcuucuucgacuuaaugcacguccaaaaaguccucagugcauccaccguuugcaaacuccaauccugcacccacggugugcccggcgaccuccaaguguaccacaucggcaacuuacuaaaaggcgacaaagucaacggccaccuaauccacaaaaucgaaccccacuucaacacuuccuggaugucgugggacggcugugaucucgacuacuacugcaacaugggugacuggccaucgugcucuuacaccggcgucacccaacauaaccacgcagcauucguuaacaugcuauccaucgaaacggacuacacuaaaaacuuccacuuccacuccaaacgcgucacagcccacggagacacaccacaacuggaccucaaagcccgccccaccuacggagcaggcgaaauuacuguccucgucgaagucgcagacauggaacugcacacgaagaaaauagaaauaagcggccugaaauucgccucguuaaccugcaccggcuguuacgcauguagcagcggaaucucgugcaaaguaagaauccacgucgacgaaccggacgaacuaaccguacacgucaaaagugaggauccagacaucguagcagcuagcagcagucucauggcucgaaaacuggaguucggaaccgauucgacguucaaagccuucuccgccaugccaaaaaccagccuaugcuucuacauaguagaacgcgaauacugcaaaaguugcucaaaagaggacacccagaagugcgugaacacaaagcucgaacagccccaaucuaucuuaauagaacacaaaggcacgaucaucggcaaacaaaacgacacaugcacggcgaaggccucaugcuggcucgaaagcgucaaauccuucuucuacggccuuaaaaacaugcuaagcggcauauucggcaacguuuucaucggcauauuccuauuccuugcuccauucgcccuacucauccuauucuucauguucgguuggagaauccucuucugcuuuaaauguugccgacgaacaagagggcuuuucaaauaccgacaccugaaggacgacgaagaaacaggguaccgcaagauaauagaacgccucaacaacaagaaagggaaaaacaaacuccucgacggcgaacgccucgccgaccggaaaaucgccgaacucuucucgacuaaaacucacguggga

SEQ ID NO: 15496 - RNA, 2916 nt, Artificial Sequence
  derived and/or modified CDS sequence (opt11) from CCHFV(Baghdad 12, Artificial)__AJ538197.2__Gn-4aa-Gc
agcgaagaaucaggagaugacugcauuucccgcacaagacuccuccgcaccgaaaccgccgaaauacacggagacuccuacggcggccccggugauaaaauaacaaucugcaacggaagcacaauaguagaccagcgacuaggcagcgaaauggguugcuacaccaucaaccguguaaaaucauucaaacucugcgaaaacuccgccaccggcaaaaguugcaaaaucgacuccauccccgucaaaugccgacagggcuacugccucaaaauaacccaagaaggccguggucacguaaaacuaucgcgaggaagcgaaguaguccucgacgcaugugauagcagcugcgaagucaugauaccaaagggcaccggcgacauucuagucgacugcucaggcggucagcaacacuuccuaaaagacaaccugauagaccuaggaugcccaaacauccccuuacuagguaaaauggcaaucuauaucugccgcauguccaaccaccccaaaaccacuauggccuuucuguuuugguucagcuucggcuacgucaucacguguauacucugcaaggcaaucuucuaccucuuaaucauaguaggcacgcucgggaagagauucaaacaauacagagaacucaaaccacaaaccugcacaauaugcgaaacaacacccguaaacgcuauagacgcggaaaugcacgaccucaauugcucauacaacauuugccccuacugcgccucucgccucacguccgacggucuagcacgacacgucacacaaugccccaaacgcaaggaaaaagucgaggaaaccgaacuauaccucaaccuagaacggauccccugggucguaagaaaacuccuccaagucuccgaaagcaccggaguagcacucaagcgauccuccuggcuaaucguacuccucguccuccuagcggucuccucgucccccguccaauccgccccaauaggccgaaaaccccuuuuccuagacucaauaguuaaaggaaccaaaaaccuacuuaacuccacaagccucgaaaccagccuaucaaucgaggcacccuggggugccaucaacguccaauccacauauaaaccaacggucagcacggccaacaucgcacucucguggagcuccguagaacaccgggggaacaaaauccuagucucgggccgaagcgaaucaauaaugaaacucgaggaacggacagggauauccugggaccuaggaguugaagacgcaucugaauccaaacuccuaacggugucagugauggaccucagccaaauguacucucccgucuucgaauaccuaucgggagaucgacaagucgaagaauggccuaaagccacuugcacuggcgauugccccgagcgcugcggaugcacaaccuccacaugccuucacaaagaauggccccacucucgcaacuggcgcuguaaccccaccuggugcuggggagucggcaccggcuguacuugcugcggauuagacgucaaagaccucuucacggacuacauguucgucaaauggaaaguagaauacauaaagacggacgccauagucugugucgaacuuaccucgcaagagcgccaaugcagccucaucgaagcgggaacucgauucaaccucggaagcgucaccaucacacucuccgaaccccgcaacauccaacaaaaacuacccccugagauuaucacccuccaccccagaaucgaagagggauucuucgaccuaaugcacguccaaaaaguacucuccgccucaacagucugcaaauuacaaagcugcacacacgggguacccggcgaucuccaggucuaccacauaggaaaccuccucaaaggcgacaaagucaacggccaccucauccacaagauagaaccccacuucaacacuagcuggaugaguugggacgguugcgaccuugacuacuacugcaacaugggagacuggccaucaugcaccuacaccggcgucacacagcacaaccaugcaaguuuuguuaaucuccucaacaucgaaacggacuauacgaaauccuuccacuuccacuccaagcgcgucaccgcgcacggggacaccccgcaacuagaccuaaaagucagacccaccuacggagcgggagaaaucaccguacugguggaggucgccgacauggaacuccacacaaagaagauagaaauuuccggccucaaauucgccucuuuaacaugcacaggaugcuacgcaugcagcagcggcauauccuguaaaguccgcauccacgucgaugaacccgacgagcucaccguccacgucaagagcgacgacccggacgucgucgcagccucaagcuccuuaauggcccgcaaacucgaguucggcacggacucaacauucaaggccuucucagccaugccaaaaaccucacuauguuucuacaucgucgaacgcgaauacuguaaaaguugcuccaaagaagacacacaaaagugcgucaacaccaaacuagaacaaccccaaucaauacuaaucgagcacaaaggcaccaucaucggcaaacagaacaauaccugcaccgccaaaaccucaugcuggcuagaaucugucaagagcuuuuucuacggccucaaaaacaugcucucaggaaucuuuggaaacuucuucaugggcauauuccucuuccucgcacccuucauacuccucauccucuucuucauguucggauggcgaauccuauucugcuucaaaugcugccgacgcacacgcggccuauucaaauaccgccaccuaaaagaugacgaagagaccggcuaccgaagaaucauugagcgacugaacaacaagaaaggcaaaaacaaacuccuagacggagaacgccuagcagaccgcagaaucgccgaacucuucuccaccaaaacccacaucgga

SEQ ID NO: 15497 - RNA, 2916 nt, Artificial Sequence
  derived and/or modified CDS sequence (opt11) from CCHFV(VLG/TI29414, Artificial)__AY179961.1__Gn-4aa-Gc
ucagaggaaccaggagacgacugcaucucccgaacccagcuccuacgcgccgaacccgcagagauccacgacgacaacuacggcggccccggcgacaaaaucacaaucugcaauggaucaaccaucgucgaccaacggcucgguuccgaacucggcugcuacaccaucaaccgaguaaaaucauucaaacuuugugaaaacuccgcaaccggcaagacgugcgaaauagacuccacucccgugaaaugccgccagggauucugccuuaaaauaacccaggaaggacggggccaugucaaacuuucacgaggcuccgaagucguccucgacgccugcgauucaucuugcgaaguaaugauaccaaaaggcaccggggacauccuaguugacuguuccggcggccaacaacacuuccuuaaagacaaccucauagaccuaggaugcccacauaucccacuacuagggaaaauggcgaucuauauaugccgaauguccaaccauccgcgcaccaccauggccuuccuguucugguucucguucggcuacgucaucacaugcauauucugcaaagcccuauucuacucccuaauuaucauuggaacacucggcaaaaagaucaagcaauaucgagagcucaagccccagacauguaccaucugcgagaccgcucccgucaaugccaucgaugcagaaaugcaugaccucaacugcuccuacaacauaugcccguacugcgcuuccagacuaacauccgacggacucgcccgccacgucccccaaugccccaagcggaaagaaaaaguugaagaaaccgaacuauaccucaaccucgagagaaucccguggaauguacgaaaacuccuucaggucucagaaagcaccggagucgcccuaaaacguuccagcuggcucauuguccuccugguccuccuaacagugucccugucgcccguccaaucagcgccaguggggcgcaaaccacuauuccucgacuccauaguuaaaggcaugaagaaccuccuaaacuccacaaaccucgaaaccucgcucuccauagaagccccguggggcgcgaucaacguccaaucuacauucaagccaacagucagcaccgccaacaucgcacuaucuuggucaagcgucgaacacagaggaaacaagauccucgugaccggccgcagcgaauccaucaugaagcuagaagaacggacaggaguuagcugggaccucggcgucgaagacgcauccgagagcaaacucuuaaccgugagcauaauggaccuuucgcaaauguacucccccguauucgaauaccugagcggcgaucgacaaguagaagaauggccaaaggcuaccugcacuggugacugccccgaaagaugcggcugcacaagcucaaccugcuuacacaaagaauggccacauagccggaacuggcgaugcaauccaaccuggugcugggaaguaggcacaggcuguaccugcugcgguuggaaugucaaagaccucuucaccgaccacauguucguaaaauggaaggucgaauauauaaaaaccgaagccauaguuugugucgaacucaccagccaagagcgacaguguagccugauagaagcaggaacgcgcuuuaaccugggcccuguaacaaucacacuaucggaaccgcgcaauauccaacaaaaacuacccccagaaaucauuacccugcaccccaaaguugaagaaggcuuuuucgaucucaugcacguacagaaaguucuguccgccucaaccguaugcaaacuacaaucaugcacucacggaauacccggcgaccuacagguauaccacaucggcaaccuacucaaaggcgacagaguaaacggacaccuaauacauaaaauagagccacauuucaacaccucguggaugagcugggacgggugcgaccucgacuacuacugcaacaugggcgacuggcccuccugcacauacaccggcaugacccaacacaaucacgcagccuucguuaaucuccugaacauagaaaccgacuacacaaaaaccuuccacuuccauucgaaaagagucacugcucauggcgacacaccccagcuggaccucaaggcccgcccgaccuacggcgcgggagagaucacgguacugguagagguugccgacauggaacuccacacgaaaaaggucgaaauaucaggacucaaguuugccucccuagccugcaccggcugcuacgcaugcuccuccggcaucuccugcaaaguacgaauacacgucgacgaacccgacgaacuaacaguccacguaaaauccaacgaccccgacgugauugccgccuccacaucccucauggcccgcaaacuggaguucggcacagacuccacguucaaagcguucagcgcaaugcccaaaacaucccucugcuucuacauagccgaacgagaauacugcaaauccugcagcgaagaagacacucagaaaugcguugacacaaaacuggaacaaccccaaucgauccucaucgaacacaagggaacgaucaucggaaaacaaaaugacacauguacagcaaaagccucaugcuggcucgagucaguaaaaucauucuuuuacggccucaaaaacaugcucggcuccgucuucggcaauuucuucaucgguauacuacucuuccuggcccccuucguccuacucguccuauucuucauguucggcuggaaaaucuuauuuugcuucaaguguugccgacgcacacgcggccuacuaaaauaccgccuacucaaggacgaugaggaaacaggauaccgccgcauaaucgagcgacuaaacaacaagaaaggaaagaaccgacuccucgacggagaacgacuagcagacagaaaaauagccgaacucuucuccacaaaaacacacaucgga

SEQ ID NO: 15498 - RNA, 2916 nt, Artificial Sequence
  derived and/or modified CDS sequence (opt11) from CCHFV(TADJ/HU8966, Artificial)__AY179962.1__Gn-4aa-Gc
ucagaggagagcggagaugacugcaucucccgaacccaacuccuccgcacagaaacagcugagauccacggcgacgacuacggaggcccaggagacaaaauuaccauuugcaacggcucaacuaucguggaccaacgacucggcucugaacuuggaugcuacaccaucaaucgaguuaaauccuucaaacugugcgaaaacucggccacgggcaaaaauugcgaaaucgacucaguccccgucaaaugccggcagggauacugccuaaaaaucacacaagaagggagaggacaugucaaacuaucacgcggcuccgaaguuguccucgacgcaugcgacucgucuugcgaggucaugauccccaagggcaccggcgacauauccguagacugcuccggcggccaacagcauuuccuaaaggacaaccucaucgaccucggcugcccaaaaaucccacuccuaggaaaaauggccaucuauaucugccggaugagcaaccaccccaaaaccacaauggcguuccuuuucugguucuccuucgguuauguaauaacaagaauccucugcaaagccauuuucuaccuacucaucaucgucggcacccucgguaaacguuucaaacaauacagggaacucaaaccccagacuugcacgaucugcgaaacuacacccgccaacgcaauagacgccgaaaugcaugaccuaaacugcuccuacaacauaugccccuauugcgccagccgcuugacguccgacggacucgcacggcacguaacccaaugccccaaacgcaaagaacguguugaagaaaccgagcuauaccucaaucuggagcgaauccccuggauaguaagaaaacugcuccaagucagcgaauccaccggaguggcacuaaaacgaucguccuggcucaucguccuucuaguccuauucacagucucacuaucccccgugcaaagcgcaccgauaggacgccgaccucuauuccuagacuccauagucaaaggcaugaaaaacccucucaauagcaccucgcuagaaaccucccuuuccauagaggcacccuggggagcgaucaacguucaaagcaccuacaagccaaccgucuccacagcgaacaucgcucucuccuggucaucaauagaacacagaggaaauaacauccucgucucaggcagauccgaauccauaaugaaauuagaagaaaggaccggcaucagcggugaccuaggcgucgaagacgccuccgaauccaaacuccucacuguaaguguaauggaccucucccagauguacucgccaguguucgaguaccuauccggcgaccgacaaguagaggaauggcccaaagcaaccugcaccggcgacugcccugaacgaugcgguugcaccagcucaacaugcuuacacaaagaauggccccacucaagaaauuggcgauguaacccgacauggugcuggggcgucggaaccggcuguaccugcugcggacucgauguaaaggaccucuucaucgacuacauguuuguaaaauggaaaguugacuacauaaaaaccgaagccauugucugcguagaacucacgucucaagaaagacaauguagccucgucgaagccgggacccgauucaaccuagguccggucaccauaacccucuccgaaccccggaacauacagcaaaaacuuccucccgaaauaauaacauuacacccccgcaucgaagaagguuucuucgaccucaugcacgugcaaaagguccuguccgcuucaacaguuugcaagcuccaaucuugcacccacgggguacccggagaucuccaaguauaucacauaggcaauuuacucaagggcgacaaggaaaacggccaccucauacacaagaucgaaccccacuucaacaccaguuggaugagcugggacggcugcgaccuugacuacuacugcaauaugggcgacuggcccagcuguacauacacaggcgucacucaacauaaccacgcuucguucgucaaucuccugaacaucgaaaccgacuacaccaaauccuuccacuuccacuccaaacgcguaacugcacacggagacaccccacagcuugaccuuaaggcccgccccaccuacggugcaggcgaaaucaccguccucguggaagucgccgacauggagcuccacaccaagaaaauagaaauaaccggacugaaauucgccucacugacaugcaccggaugcuacgccugcucguccggcauaucuugcaaaguccgcauacacgucgacgaacccgacgaacuuaccguccacguuaaauccgaugaccccgacgucgucgcggccucuagcucucucauggcucggaaacucgaguucggaaccgacuccacauucaaagccuucagugcaaugccaaaaacaucccuauguuucuacauuguagagcgugaauaccgaaaaucuugcucuaaagaagacacccaaaaaugcgucaacaccaaacuagaacagccacaaucuauccucaucgaacacaaaggcacaaucaucgguaaacaaaacaauacaugcaccgcaaaggccuccugcuggcuagaaucagucaagucguucuucuacggucuaaagaacaugcucuccggaauauucggcaacguguucguaggaaucuuccucuuucucgcacccuuuauccuccugauccuauucuucauguucggguggaggauacucagcugcuucaaaugcugccgacgaacccguggucuccuuaagcaccgacaccucaaagacgacgaagaaacaggcuaccgucgaaucauugaacgccuuaacaacaagaagggcaaaaacaagcugcucgacggugaaagacucgcugaccggcgaauagcagaacucuucucuaccaagacacacaucggc

SEQ ID NO: 15499 - RNA, 2916 nt, Artificial Sequence
  derived and/or modified CDS sequence (opt11) from CCHFV(Hodzha, Artificial)__AY223476.1__Gn-4aa-Gc
ucagaagaaucuggcgacgacugcauaucccggacccagcuccuccgcacggagacagcagaaauacacggcgaugacuacggaggcccaggcgacaagauaacaaucugcaacggcagcacaauagucgaccaacggcuaggaucagagcuaggcugcuacacgaucaacagagucaaaaguuuuaagcuauguaaaaauagcgccacgggaaaaagcugcgaaaucgacaguacccccguaaaaugccgccaaggcuauugccucaaaaucacccaagagggccgcgggcacgucaaacuaucgcggggcagugaagucguccuagacgccugcgacagcuccugcgaagugaugauaccaaaaggaaccggcgacauauuagucgacugcucgggcggccagcaacacuuccuaaaagacaaccucaucgauuuaggaugcccaagaaucccucugcugggcaaaauggcaauauauauaugccgcaugagcaaccaccccaaaaccacaauggcauuccuauucugguucagcuucggguacgucauaacaugcauccucugcaaagcaauauucuaccuacuuaucaucgucggaacccuuggcaaaagauuuaaacaauaccgagaguuaaaaccacaaaccugcaccauaugcgaaaccaccccagcgaacgcaaucgaugccgaaaugcacgaccugaacugcuccuacaacauaugccccuacugcgcuucucgccucacuagcgacggucuggcccgccacguaacacaaugccccaagcgaaaagaaaaagucgaagaaacagaacucuaccucaaccucgaaagaauccccuggaucguccgaaaacuccugcaggucucagaaucaaccggggucgcgcucaaacgcucaucauggcucauaguccuacuugugcuuuucgcaguuucccuaucucccguucaaagcgcucccaucggccgccgcccgcuguuucuagacucaaucguuaaaggcaccaaaaaccuccuaaacuccacaucauuggaaacuagccuaucgaucgaagcccccuggggcgcgaucaacguccaguccaccuacaagccaacagugucgaccgccaacauugcccucagcuggucguccgucgaacaccgcggcaacaagauccuaguauccggccgcagcgaauccaucaugaaacucgaagaacgcacaggaauaucaugggaccucggaguagaggacgcaucggaaaguaaacuccuaacagucagcgucauggaccuaucacaaauguacucccccguguucgaauaccucuccggugaccgccaagucgaagaauggcccaaagccacuugcaccggagacugccccgaacgcugcgguugcacaucaaguaccugccuccacaaggaauggccccauucccgaaacuggaggugcaacccaaccuggugcuggggaguaggcaccggcugcacaugcugcggccuagacguuaaggaccuauucacggauuacauguuugucaaauggaaagucgauuacauuaaaaccgaggcuaucgucugcgucgaacuuaccucccaagaacgacagugcucgcuaguagaagcaggcacucgcuucaaccuugguccugucacaauaacucuuucagaaccccggaacauccagcaaaaacucccacccgagaucaucacuuuacauccccgaaucgaagaaggcuucuucgaccuaaugcacguacaaaaagugcucucugccuccacggucugcaaauuacaaucaugcacacacggcguacccggcgaccuccagguauaccacaucggaaaccuccugaagggagacaaagucaacggacaccucauccacaaaaucgaaccccacuucaacacauccuggauguccugggacggcugcgaccuugacuauuacugcaauaugggggauuggcccucgugcacauacaccgguguaacccaacacaaccacgcaucauucgucaaccuccuaaauauagaaaccgacuacaccaaaucauuccacuuccacuccaaacgcgucaccgcucacggugauacgccccaacucgacuuaaaagcccgaccaaccuacggagccggagagaucacagugcucguagagguagccgacauggaacuacacaccaaaaagauugagaucacaggucugaaauucgccucgcuaaccugcaccggauguuacgcuugcucaagcggaauaucaugcaagguccgcauccacguggacgagcccgacgaacucacaguacacgucaagagcgacgacccugacguuguggccgccuccucaagccucauggcacgcaagcuggaguucggcacagacucaaccuucaaagcguucagcgcuaugcccaaaacaucacuaugcuucuacaucguagaacgcgaauacugcaaauccugcagcaaagaagacacccaaaaaugcguaaacacgaagcuagaacaaccccaaucgauccuaaucgaacggaaaggaaccaucauaggaaaacaaaacaacacuugcacagccaaagcaucgugcuggcucgaaagcgucaaauccuucuucuacggccucaaaaacaugcucucaggaaucuuugggaacgucuucguggggaucuuccucuuccuagcaccauucauccuuuuaauucucuuuuucauguucggauggcggauacucuuuugcuucaaaugcugucgccgaaccagagggcuauucaaauacaaacaccuaaaagacgacgaagaaaccggcuaccgccgcaucaucgaacgacuaaacaacaagaaaggcaaaaacaaacuucuagacggagagcgccucgccgaccgacgcauagccgaacucuucagcaccaaaacacacauaggc

SEQ ID NO: 15500 - RNA, 2916 nt, Artificial Sequence
  derived and/or modified CDS sequence (opt11) from CCHFV(Kosovo/9553/2001, Artificial)__AY675511.1__Gn-4aa-Gc
agcgaggaacccggcgacgacugcaucucccgcacucaacuccuacggaccgagacugccgaaauccacgacgacaacuacgggggcccgggggauaagaucaccauuugcaacggcagcaccaucguggaccagcgccugggguccgagcugggcugcuacacuaucaaccgggucaagagcuucaaguugugcgagaacuccgccacgggcaagaccugcgagaucgacagcacccccguaaagugccgccagggauucugccugaagauaacccaggaaggccgcgggcacgugaagcugucccgcggcuccgaggucgugcucgacgcgugugacuccagcugcgaagugaugauacccaaggggacgggagacauccuagucgacugcuccggugggcagcagcauuuccucaaggacaaccucauagaucugggcugcccgcacaucccccugcucgguaaaauggccaucuauauagcccgaaugagcaaccacccaaagaccaccauggccuuccuguucugguucucgcugggcuacgugaucacgugcauccucugcaaggcccuguucuacucucugaucaucaucggcacccucgguaagaagaucaagcaguaccgcgagcugaaaccccagaccugcaccaucugcgagaccgcgcccgugaacgccaucgacgccgagaugcacgaccugaacugcuccuacaauaucugcccguacugcgccagccggcucacuagcgacggcuuggcgcgccacgucaagcaguguccuaagcggaaggaaaagguggaggagaccgaacuguaccucaaccuagagcgcauacccugggucguucggaagcugcuccaggugagcgagagcaccgggguggcccugaagcgcagcagcuggcugauuguccuccuggugcugcucaccgugucuuugagccccguccaauccgccccggugggccggaagccccuguuccucgacagcaucgugaaggggaugaagaaccugcugaacuccacgagccuugagaccucucuuagcaucgaggcccccuggggcgccaucaacguccaguccaccuucaagcccaccgugagcacggcgaacaucgcccuguccuggagcucgguggaacaccgcggcaacaagauccucgucaccgggcgcagcgagaguaucaugaaacuggaggagcgcaccggcgugaguugggaucuaggggucgaggaugcguccgagucaaagcuccugaccgugucaaucauggaccugagccagauguacucaccgguuuucgaguaccucuccggcgaccgccaggucgaggaguggcccaaggcuacgugcaccggggacugccccgagagaugcggcugcaccagcucuacgugccugcacaaggaguggccccauagccggaacuggcgcugcaacccgaccugguguuggggcguggggaccggcuguaccugcugcgguguggacgucaaggaccuguucaccgaccacauguucgugaaguggaagguggaguacaucaagacugaggccauugucugcguggagcugaccucccaggagcgccagugcagccucaucgaagcgggcacccgguuuaaccuggggcccgugaccauuacccuguccgaaccccgcaacauccagcagaagcugccgccggagauaaucacgcuccaccccaagaucgaagagggcuucuucgaccugaugcacguccagaaggugcucagcgcguccacgguguguaaauugcagagcugcacacacggcauccccggggaccugcaggucuaccacaucggcaaccuccugaagggggaccgcgugaacggccaucugauccacaagaucgagccccacuucaacacauccuggaugagcugggacggcugcgaccucgacuacuacugcaacaugggggauuggccauccugcacguacaccggugugacccagcauaaccaugccgccuucguaaaccugcugaacaucgagaccgacuauacgaagaccuuccacuuccauagcaagcgagugaccgcccacggggacacgccucagcucgaccugaaagcgagacccaccuacggcgccggggagaucaccguccugguugaaguggccgacauggaguuacacaccaagaagguggagaucuccggccugaaguucgccagccuggccugcaccgguugcuaugcuugcagcagcgggauaagcuguaaaguacgcauccacguggacgagccggacgagcucacgguacacgucaaaucuagcgaccccgacguaguggccgccuccaccagccugauggcccggaaguuagaguucggcacugacuccaccuucaaggcguuuagcgccaugcccaagacgucccucugcuucuacaucgucgagaaggaguacugcaaaagcugcuccgaggacgacaccaagaagugcguggacaccaagcuggagcagccccagagcauccuaaucgagcaccgcgggacaaucaucggcaagccgaacgacacgugcccggccaagaccuccugcuggcuagaaucagugaaguccuucuucuacgggcugaagaacaugcugggcuccguauucggcaauuucuucaucggaauccuccuguuccuggcucccuuuuuccucuggauguugucguucauguucggcuggaagauucuguucugcuucaagugcugucggcgcacccggggccucuuuaaguaccgccaccugaaagacgacgaggagaccggguaccggcgcaucauugagcgacugaacaacaagaagggaaagaaccgucuccuggacggagagcggcuggccgaccgcaagaucgccgagcuguuuagcacgaagacccauaucggc

SEQ ID NO: 15501 - RNA, 2916 nt, Artificial Sequence
  derived and/or modified CDS sequence (opt11) from CCHFV(SPU41/84, Artificial)__AY900142.1__Gn-4aa-Gc
uccgaagaauccuccgacgacugcaucagccggacacaacucuuacgcacugaaacugccgaaauccacggggacaauuacgggggcccaggagacaagaucaccaucugcaacggaucaacugucgucgaccaacgccuuggaucagaacucggcugcuauaccauaaaucgcguuaaaacguucaagcugugcgaaaacucagccacuggcaaauccugcgaaaucgacagcgucccugucaaaugccgccaagguuacugccucaagaucacccaagaaggccgaggccaugucaaacugucccggggcuccgagguuguccucgacgccugcgacacauccugcgaagucaugaucccuaaaggcacaggggauauccuaguagacuguucagggggccagcaacacuuccugaaagauaaccuaaucgaccucgggugcccgaaaaucccacuucucggaaaaauggccauauauauuugucggauguccaaccacccaaaaaccacaauggcauuccucuucugguuuuccuucggcuaugucauaacaugcauaaucugcaaagucaucuucuaccugcuaaucaucgucggaacacuaggcaaacgauucaaacaauaccgcgaacugaaaccccaaaccugcaccaucugcgagacaacacccgugaacgccauugacgccgaaaugcacgaccucaacugcagcuacaacauuugccccuacugcgccucacgccuaacauccgacgggcuugcccgccacgucacacaaugcccgaaaagaaaagaaaagguagaagaaacggaacuauaccuuaaccuagagaggauccccuggguaguaagaaaacuacuccaggucagcgaaagcacaggcgucgcccuuaaacgcuccucguggcucgugguccuccugguccuacuaaccguaucccuaagccccguccaaucagccccaauuucccgccgcccccucuuccucgacagcaucgucaaaggcaugaaaaaccuccuuaauucuaccucccucgaaaccucccucucaauagaagcacccuggggagcaauaaacguccaaagcaccuauaaaccaaccgugaguaccgccaacaucgcgcucuccugguccagcgucgagcaucgcggcaacaaaauccuugucuccggacggagcgaguccauaaugaaacucgaagaaaggaccggcaucucuugggaucucggcguggaagacgcaagcgaguccaaacugcugacaguguccguaauggaccucucacaaauguacucacccguguucgaauaccuaagcggcgaccggcaaguggaagaauggccgaaagcaaccugcaccggggacugcccagagcgaugcggcugcacaagcuccacaugccuccacaaagaauggccacacucgcgcaacuggcgaugcaacccaaccuggugcuggggcgucgggacaggcuguaccugcugcggacucgacguaaaagaccuguuuaccgacuacauguucgucaaauggaaagucgaguauaucaagaccgaagccauagugugcgucgaauugaccucacaagaacgccaaugcucguuaaucgaagccgguacccgauucaaccucggacccgucacuauaacccuuucagaaccacgcaacauccaacaaaaacucccacccgaaauuaucacacuacacccccgcaucgaagagggcuucuucgaccucaugcaugugcaaaagguacuaucagcgucaacugucugcaaauugcaaagcugcacgcacgggguaccaggcgaucuucaagucuaccacaucggcaaccuccucaagggcgacaaggugaauggccaucuaguucacaaaaucgagccacacuucaacacuuccuggauguccugggacggaugugaucucgacuacuacugcaacaugggcgacuggcccucgugcacauauacaggcguaacccaacacaaccacgccagcuucguaaauaugcuaaacaucgaaacugauuauacgaagaacuuccacuuccacucaaaacgaguuacagcgcacggugauaccccacaacucgaccugaaagcacgacccacuuauggagcgggagaaaucacgguacucguggaggucgccgacauggaacuacacaccaagaaaaucgaaauaucgggacuuaaauucaccucccuaaccugcacgggcugcuacgcuugcucguccgggaucucgugcaaaguccguauccacgucgacgaaccagacgaacuaacaguccacgucaaaagcgaagacccagacgugguugcagcauccagcucccucauggcucgaaaacucgaguucggcaccgacucgaccuucaaagccuucucagccaugccaaaaaccucgcucugcuucuacaucguugaacgcgaauacugcaaauccugcucagaggaagacacccagaaaugcgugaacacaaaacucgagcagccccaaucuauccucauagaacguaaaggcacaaucaucggaaaacaaaacaacacaugcaaagccaaagcuggaugcuggcucgaauccguaaaauccuuuuucuacgggcuaaagaauaugcugucuggaauauucggcaaugucuucaucggcauauuccucuucuuagccccuuucauacuccugauccuauucuucauguuuggcuggcgcauccucuucugcuucaaauguugucgccggacccgcgggcuguucaaauaccgccaccucaaggacgacgaagaaacaggcuacaggaaaauaaucgaacgacucaauaacaagaaaggcaaaaacaaacuacuagacggagaacggcuagccgacagacggauagcagaacucuuuagcaccaaaacccacauaggg

SEQ ID NO: 15502 - RNA, 2916 nt, Artificial Sequence
  derived and/or modified CDS sequence (opt11) from CCHFV(UG3010, Artificial)__AY900143.1__Gn-4aa-Gc
gcagaagggguaagcaacgacugcguauccagaacacaacuaauaaagacagaagucgccgagauccacgaagacagcuacggcggccccggagagaaaaucacaaucugcaacggauccaccaucguagaccaacgccuaggcuccgaacucgggugcuacaccaucaaccgaguuaaaaccuacaaacugugcgaaaacuccgcaaccgaaaaaggaugugaaaucgacaguguaccagugaaaugcaaacaggguuucugccuaaaagucacacaggaaggacgcggacacguaaagcucagccgcggaacggaaaucguacucgacgucugcgacaccagcugcgaacucaugauccccaaaggcaccggagauauccucguugacugcucaggcggacagcaacacuuccuucaggacaaccucauugaccucgggugcccgaacgucccccuacugggcaaaauggccaucuacauaugccgaaugagcaaccacccaaagacaacaauggccuuccucuucugguucagcuucggauacguuaucacgugcauagucugcaaaguucuauucuaccuccuuauugucauaggcacccucuccaaaaagcugaaacaguacagagaacucaaaccacaaaccugcauagucugugaaagcacaccagucaacgcgauagacgcggaaaugcacgaacucaauuguaacuauaacaucuguccauauugcgcuagccgacuuaccagcgacgggcucguccgucacgugaaccagugcccgaagcgaaaagaaaaggucgaagaaacagagcuauaccuaaaccuggaacgcauccccuggcuagucaggcgccuacuccaagucagcgagagcaccggaauggcacucaaacgcagcugcuggaugacuacccuccucauccuucucgucguuucacugucgccaguacaguccgccccagugggccgcaaaccccucuaccuagacagcauagcaaaaggaaugaaaagccuccuaaacaguaccaaccuagaaaccagccucuccaucgaagccccauggggagcuauaaacguccaaagcaccuucaaaccaacgguguccgcugccaacauagcauuaagcugguccucaguggagcacagagggaacaaaauccuggucuccggccggucagagucgaucaugaaacucgaagaacgaaccggcauaucauggucccuaggaguagaggacgcaagugagagcaaaacccuaacagugagcguaauggaccugucgcaaauguacucucccguuuucgaguacuuguccggcgaucgccaggucgaagaguggcccaaagcaaccugcacaggggacugccaagagcgaugcggcuguacauccuccacaugccuacauaaagaauggccccacagccgaaauuggcguugcaaccccacauggugcuggggcguagguacaggaugcacgugcugcggccuagacgucagagaccucuucaccgacuacaugauggucaaauggaaagucgaauacgucaaaacugaagcaauaaugugcguagaacucacgucccaagaacgacaauguucucuaauagaagcagggacccgauucaaccuaggacccguaaccauaacccuauccgagccccgcaacauccaacaacgacuaccaagcgaaaucgucacgcuccaccccaagauagaagaaggauucuucgaccuaaugcauguucagaagguccugagcgccuccacaguuugcaaacugcaaagcugcacccacggcgugcccggcgaucuccaggucuaccacgucggaaacuuacuuaaaggcgacaagguuaaugggcacagcauccauaaaaucgaaucccacuucaacacuucguggauguccugggacggcugcgaccuggacuacuucugcaacaugggagacuggcccagcugcaccuacaccggcguuacacaacacaaccgcgccgcguucauaaacaugcuuaacaucgaaaccgacuacacgaaaacauuccacuuucacucuaaacgagugacggcccacggagauacgccccaacucgaccuaaaagcccgccccaccuacggagccggcgaaguaaccguccuagucgaagucgccgaccuggaacuucacaccaaaaagaucgaagucucgggccucaaauucgcuucccucacgugcuccggcugcuacgccugcucaagcggaaucucaugcaaggugcgaauccacguaaacgagcccgacgaauuuacuguccacgucaaauccucagaccccgacguugucgcagcaggcagcucccucauggccagaaaaaucgaguucggugcagacagcaccuucaaagccuucuccagcaugcccaagaacucacucugcuucuacaucgucgaacgagacuacugcagcagcuguaccaacgaugacacccaaaaaugcgucgacacaaagcuagaacacccccaaagcauacucauugaacacaaggggaccaucauaggcaaacaaaacgauacaugcucaacaaaaacauccugcugguuagagucggucaaguccuuuuucuacggccugaagaauaugcugggcggaaucuucgggaacgucuuccucggaauauuccuauuucucgcacccuucgcgcuccuaaucuucuucuucuucuucggauggagacuacucuucugccucaaaugcugccgacguaccaggggacuacugaaauauaaacaacucaaagacgaagaagaagccggcuacaagaaaauaauagagcgacugaaugacaaaaagggcaaaagccgccuauucgacggcgaacgacuggcggacagaaaaaucgcagaauuauuuagcacaaaaacccacauagga

SEQ ID NO: 15503 - RNA, 2916 nt, Artificial Sequence
  derived and/or modified CDS sequence (opt11) from CCHFV(Hy13, Artificial)__AY900145.1__Gn-4aa-Gc
ucggaagaaaguggggacgacugcaucagccggacccaacugucgcgcacggaaacagcagagauccacagcgacaacuacggaggcccaggcgacaagauaacgaucugcaacggaagcacgaucguagaccaacggcuaggguccgaacuugggugcuacacaauaaaccgcgugaaauccuucaaacucugcgaaaacagcgccacgggcaaaaguugcgaaaucgacucaaccccaaucaaaugccgacaaggcuuuugccucaaaauuacccaagaaggaagaggccaugucaaacuaaguagggggucggaagucgugcuagacgcaugcgacucauccugcgagauaaugauaccaaaaggcaccggcgacauccuagucgacugcucuggcggacaacagcacuuucugaaagauaaccuaauagaccucggcugucccaacauaccacuccucggaaaaauggccauauauaucugccggauguccaaccaccccaaaaccacgauggcauuccucuucugguucuccuuuggcuacgugaucacgugcauucucugcaaggugaucuucuaccuacugauaguagucggaacucucggaaagaaauucaaacaauaccgcgaacucaagccccagacaugcaccaucugcgaaaccacgccgguuaacgcgaucgacgccgaaaugcacgacuuaaacugcuccuacaacaucugcccguacugugccucacgccugacgucggacggccuagcgcgacacgucaugcaaugcccaaaacgcaaagaaaaagucgaagaaacagaacucuaccugaaccuggaacggaucccauggguaguacgaaaacuccuccaagucucggaaagcacuggcguugcucucaaacgcucauccuggcucgucguccuacucguacuacugacagucagccugagcccgguccaaucagcccccauaggccgaaaaccccuauucuccgacuccaucguaaagggcaugaagaaccuccucaacaguacaucccucgagacaucgcuauccauagaagcucccuggggagcuauaaacguucaaagcaccuucaaaccuacaguaagcgcggccaauauagcgcucucauggucaucagucgagcaccgagguaacaaaaucuuaguguccggaagauccgagagcauuaugaaauuagaggagcgaaccgggaucuccugggaccucggcguagaggacgcaucggaaucuaaacuacucacagucucaaucauggaucucucucaaauguauagcccgguauucgaauaccucucgggcgaucggcaaguugaagaauggccgaaagcaaccugcacuggagacugccccgagaggugcggcugcacguccagcacgugccuccacaaagaauggccccacucgcggaauuggagaugcaacccgaccuggugcuggggagucggcaccggcugcaccuguugcggccucgacguuaaggaccuguucacggaccacauguuugucaaauggaaagucgaauauauaaaaaccgaagccaucgucugcguagaacucaccucgcaggaacgccaaugcucgcucaucgaagccggcacaagauucaaccugggcccaguaacuaucacucucucagaaccgcgaaacauccaacaaaagcugcccccagagaucgucacacuacauccaagaaucgaagaggguuucuucgaccucaugcaugucaaaaagguccuaagcgccagcaccgucugcaaacuccaaucaugcacccacggaguccccggcgaccuacaagucuaucacauaggcaaccuacuaaaaggggacaaagucaacggacaccuaauccacaagaucgaaccacacuucaacacauccuggaugagcugggacgggugcgaccucgacuacuacugcaacaugggagacuggcccuccugcucguacacgggaguaacccagcacaaccacgcagcauucguaaacaugcucaacauagaaaccgacuauaccaaaauauuccacuuccacucaaaacgcgucacagcccauggcgacacaccccaacucgaccucaaagcgcgcccuacguacggcgcgggagagaucacaguccucgucgagguagccgacauggaguuacacacaaagaaaauagaaaucaguggccuaaaauucgcgucccuaaccugcacgggaugcuacgcaugcucgucagguauauccugcaaaguacggauucacguugacgaaccagacgaacucaccguucacgucaaaagcgaggacccagacaucgucgccgcaucaucaucucucauggcaaggaaguuagaguucggaacugacagcaccuucaaagccuucagugccaugccuaaaaccucgcucugcuuuuacaucguagaaagagaauacugcaaaagcugcagcaaggaagacacacaaaaaugcguaaacaccaagcucgaacaaccacaaucuauuuuaaucgaacacaaaggaacaauaauaggaaagcaaaacgauaccugcacaucaaaagccggaugcuggcuggaaagcgucaaguccuucuucuacgggcucaaaaacaugcucucaggaaucuucggaaacgucuuuauuggcauauuccuauuccucgcuccauuuauacuacuaauacucuucuucauguucggcuggaggauucucuucugcuucaaaugcugccgaagaacacgcggacucuucaaauaccgccaccugaaggacgacgaagaaaccggguacagaaaaaucaucgaacgccucaacaacaaaaaggggaaaaacaagcuccuagacggcgagcgccuagccgaccgaaaaauagccgagcuguucagcacaaaaacucacauaggc

SEQ ID NO: 15504 - RNA, 2916 nt, Artificial Sequence
  derived and/or modified CDS sequence (opt11) from CCHFV(Semunya, Artificial)__DQ094832.1__Gn-4aa-Gc
gccgagggcgugagcaacgacugcgucuccagaacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucguccuggacgucugcgacaccagcugcgaguugaugauccccaaggggaccggcgacauccugguggacugcuccggcgggcagcagcacuuccugcaggacaaccucaucgaccugggcugcccgaacgugccccugcucggcaagauggccaucuacaucugccggaugaguaaccacccgaagaccaccauggccuuccuguucugguucuccuucggcuacgucaucacgugcguggugugcaagguccuguucuaccuccugauagugaucggcacccuggggaagaagcucaagcaguaucgcgagcugaagccgcagaccugcaucgugugcgagagcauccccgucaacgccaucgacgccgagaugcacgaacugaacugcaacuacaacaucugccccuauugcgcgucccggcucaccagcgacggccuggugcgccacgugacccagugcccgaagcggaaggagaaggucgaagagacggagcuguaccucaaccuggagcgcauccccuggcuggugcggcgccuccuccagguguccgagagcaccgggauggcucugaagcgguccugcuggaugaccacccuccugauacugcucgucgugagccugucccccguccagagcgcccccgugggccgcaagccgcuguuccucgacagcaucgccaaagggaagaagucccugcugaacagcacgaaccucgagaccucucugaguaucgaggcgcccuggggcgccaucaacgugcaguccaccuucaagcccaccgucagcgccgccaacaucgcccucuccuggagcagcguagagcaccggggcaacaagauccucgugagcgggcgcuccgagagcaucaugaagcuggaggagcggacgggcaucuccuggagccugggggucgaggacgcguccgagagcaaaacccuuaccguguccgugauggacuugagccagauguacucccccgucuucgaguaccugucgggcgaccgccagguggaggaguggccgaaggcgaccugcacgggagacugccccgagcggugcggcugcaccagcagcacgugccuccacaaggaguggccccacucccgcaacuggcggugcaaccccaccuggugcuggggcguggggaccggcugcacgugcugcgggcuggacguccgcgaccuguucaccgacuacaugauggugaaguggaagguggaguacgucaagaccgaggccaucauguguguggagcugaccucccaggagcgccagugcagccucaucgaggccgguacccguuucaaccuggggccggugaccaucacccuguccgagccccgcaauguccagcagcggcuccccagcgagaucgugacccugcaccccaagaucgaggagggcuucuucgaccugaugcacgugcagaagguccucuucugcaaguacucccuccaggccacgagcugcacccacggcgugccgggggaccuccagguguaccacgucggcaaccugcugaagggggacaaggugaacggccacuccauccacaagaucgagagccacuucaacaccuccuggaugagcugggacggcugcgaccuggacuacuucugcaauaugggugacuggcccuccugcaccuacacgggcgugacccaacacaaccgcgccgccuucgucaacaugcucaacaucgagaccgacuacaccaagacguuccacuuccacagcaagcgggugaccgcccacggggacacgccccagcuggaccugaaggcccgccccaccuacggcgccggggagguaacgguccucguggagguggcggaccuggaacugcacaccaagaagaucgaggucuccggccucaaguucgccagccugaccugcuccggcugcuaugccugcagcagcgggaucuccugcaaggugcggauccacgugaacgagccggacgaguucaccgugcacgucaagagcaacgaccccgacgugguggccgccggcuccagccugauggcgcgcaagaucgaguucggggccgacuccacguucaaagccuucagcuccaugccaaagaacagccucugcuucuacaucguggaacgggacuacugcuccagcugcaccgacgacgacacccagaagugcgugaacaucaagcuggagcacccgcaguccauccugaucgagcacaagggcaccaucaucgggaagcagaacgacacgugccccacaaagaccagcugcugguuagaguccgucaagagcuucuucuacggccugaagaacaugcugggcgggaucuucggcaacguguuccucgggaucuuccuguuccuggcccccuucgcacuccugauccuguucuucuucuucggcuggcgcuuacuguucugccugaaauguugccggcgcacccgggggcuccugaaguacaagcagcugaaggacgaggaggaggccggcuacaagaagaucaucgagcgccucaacgacaagaagggcaagucccggcuguucgacggggagcgccuggcagaccggaagaucgccaagcuguucagcacgaagacccacaucggc

SEQ ID NO: 15505 - RNA, 2916 nt, Artificial Sequence
  derived and/or modified CDS sequence (opt11) from CCHFV(SPU128/81/7, Artificial)__DQ157174.1__Gn-4aa-Gc
ucagaggaaccaucggacgacugcaucucccgcacacaacuccuccgcacugaaaccgccgaaauacauggcgauaacuacggcggcccaggagacaaaaucacgaucugcaacggaucuaccauuguugaucaacgccucggcuccgaacucggcuguuacaccaucaaccgcgucaaauccuucaaacucugcgagaacucagccacuggaaaaucgugcgaaauagaaagcgugccagucaaaugcagacaaggcuacugccugcgcaucacacaagaaggacgcgggcacguaaaacuuagccgggggagcgaagucguccucgacgcaugcgacacuuccugugagaucaugauaccuaaaggaacuggcgacauccucguggacugcucaggcggccaacaacacuuccuaaaagacaaccucauugaucuaggaugucccaaaauaccacuacuagguaaaauggcaauauauauaugccggauguccaaccacccuaaaaccaccauggccuuccucuucugguucagcuucggcuacgugaucacgugcauccucugcaaagcaauauucuaccugcuaauaaucauaggcacacuaggcaaaagguuuaagcaguaucgcgaguuaaaaccgcaaaccugcaccauaugcgaaacaacgcccguaaacgcgaucgacgccgaaaugcacgaccuuaacugcagcuacaacaucugcccauauugcgccagccgccucacaucagacggccuggcgcgacacgucacgcaaugccccaaaagaaaagaaaagguagaagaaaccgaacuguacuuaaaccuugaacgaauaccgugggucgugagaaaacuccuccaaguaucagagaguaccggcgucgcccuaaagagaucaucauggcucauaguucuccuuguguuauucaccgucagccucuccccaguacagagcgcaccgauaggaaggaaaccgcucuuucucgacagcauagucaaaggcaugaaaaaccuccuuaacuccacuucccuugagaccucccuaagcauagaagcgcccuggggcgccaucaacgugcaaucaacauacaaacccacagucucgacagccaacaucgcacucucguggucaagcgucgagcaccgaggcaacaaaauacucgucagcggacgauccgaaucaauaaugaagcuagaagaaagaaccggcaucucgugggaucucggcgucgaggaugccuccgaauccaaacugcuaaccguaagcgugauggaccuaucacaaauguacucccccguauucgaauaccucuccggagaucgccaagucgaagaguggccuaaggcaacgugcacuggagacugccccgaacgcuguggcugcacgagcucaacaugccuucacaaagaauggccccacagccgaaacuggcgcugcaauccaaccuggugcuggggcgugggcacaggcuguaccugcugcggccucgacguaaaggaucuguucaccgacuacauguucguaaaauggaagguagaguacauaaagacagaagccaucgucugcguggaacugacaagucaagagcgucaaugcucccuuauugaggcaggcacacgcuucaaccucggacccgucacaauaacacucuccgaaccucgaaacauacaacaaaagcucccacccgagaucaucacccugcacccgagaauagaagagggcuucuucgaccuaaugcacguccaaaagguacuauccgccagcaccguaugcaaacuucaaucaugcacccacggcguccccggagaccugcaggucuaccacauaggcaaccuucucaaaggagacaaaguaaauggacaucuaauacacaaaauagaaccacacuucaauacgucguggaugagcugggacgggugcgaccuugacuacuacugcaacaugggcgacuggccauccugcacguacaccggcgucacacagcacaaccacgccuccuuugucaaccuucucaacauagagacagauuacaccaaaaacuuccauuuucacuccaaacgcgucaccgcccacggagacacaccacaacuagaccuaaaagcacgacccaccuacggcgcaggagaaaucaccguacucguagaaguggcagacauggaacuccacacgaagaaaaucgagaucucaggacucaaauuugccucacuaaccugcacaggaugcuacgcaugcagcucaggaauaucaugcaaagugaggauacacgucgacgaaccggacgagcuuacaguccacgucaagagcgacgauccagacgucguagcagcauccuccucccuaauggccagaaaacucgaguucggaacugacagcaccuucaaggcauucagcgcuaugccaaaaaccucccucugcuucuauaucgucgaacgugaacacugcaaaucuugcagcgaagaagacaccaagaaaugcgucaauaccaaacucgaacaaccacaauccauacucaucgagcacaagggcacaauaauaggcaagcaaaacagcacaugcacagcaaaagcauccuguuggcuagaguccguaaaaucauucuuuuacggccuaaagaacaugcucucaggcaucuucggcaacguuuucaucggaauauuuuuauuccuaggccccuucauccuacuaauccuuuucuucauguucggcuggagaauccucuucugcuucaaauguugccgacgcacccgcggccugcugaaauaccgccaccucaaagaagacgaagaaacaggguaccggcgcauaauugaacgacuaaacaacaaaaaggggaagaacaaacuacucgacggcgaaagacucgcugacagacgaaucgccgagcuuuucagcaccaaaacacacauuggc

SEQ ID NO: 15506 - RNA, 2916 nt, Artificial Sequence
  derived and/or modified CDS sequence (opt11) from CCHFV(ROS/HUVLV-100, Artificial)__DQ206448.1__Gn-4aa-Gc
ucugaagaaccuggcgacgauugcaucaguagaacccaacuccuccgcaccgaaacggcagaaauccacgacgacaacuacggcggcccuggggacaaaauuacgaucugcaacggcagcacaaucgucgaccaacgccucggcucagaacucggaugcuacacgauaaaccgagucaaaucauucaaacuaugcgaaaacuccgcgaccggcaaaacuugcgaaauagauuccaccccaguaaaaugccgacagggauucugucuaaaaaucacgcaagagggaagaggccacguaaaacuaucacgcggaagcgaagucguccuagacgcaugcgacagcagcugcgaagucaugaucccgaaggguacgggcgacauccuagucgacugcagcggaggucaacagcacuuccucaaggacaaccuaaucgaccuaggcugcccgcacaucccccuccuagguaaaauggcaaucuacauaugccgaaugucgaaccauccacgcaccacgauggccuuccucuucugguucucauucggguacguaaucacaugcaucuucugcaaagcacuauucuacuccuugaucauuauaggaacccuaggaaagaaaauuaaacaguacagggaacugaaaccucaaaccugcaccauaugcgaaaccgcaccugugaacgccauagacgccgaaaugcacgaucucaacugcucauacaacaucugccccuacugcgccagccggcuaaccuccgacggccucgcccgacacgucccacaaugcccgaaacguaaagaaaaaguagaagaaaccgaacucuaccuaaacuuagaacgcauccccuggaucguccgaaaacuacuccaagugagcgaaagcacuggaguggcccucaaacguucaagcuggcucauaguccuccuaguccucuugaccgucucgcugucccccguccagucagcacccguaggccgcaagccucuauuccucgacagcauugucaaaggcaugaagaaccuccucaacucgaccagccucgaaaccucgcucuccauagaagcccccuggggagccaucaacguacagucaaccuucaaaccgaccgucuccaccgccaacaucgcccucucguggagcucuguggaacaccgcggcaacaagauccucgucaccggccgcagcgagagcauaaugaagcucgaagaacgcaccggaguguccugggaccuaggcgucgaagacgccucagaaaguaaacuccucaccguuaguaucauggaucucagccaaauguauagcccaguauuugaguaccuaagcggcgaccggcaggucgaggaguggccgaaagcaaccugcaccggcgacugcccagagcgguguggauguacauccucaacgugccuccacaaagaguggccccacucucgcaacuggcgauguaaucccaccuggugcuggggcgucggaaccggaugcacaugcugcggagucgacgucaaggaccucuucaccgaccacauguucgucaaguggaaagucgaauacaucaaaaccgaagccauuguaugcguugaacuaacaucccaggaaagacagugcucccuaauagaggccggcacccgcuucaaccucggcccgguaacgauaacacucagcgaaccccgcaacauccaacagaaacuaccaccugaaauaaucacacuccacccgaaaguagaagaaggguucuucgaccuuaugcacguccaaaaaguccuauccgcgaguaccgucugcaaacuacaaucuugcacacacggaauccccggcgaccuacaagucuaucacaucggcaaccugcuuaagggggaccgcgucaacggccacuuaauccacaaaauagaaccccacuucaauacuagcuggauguccugggacggcugcgaccuagacuacuacugcaacaugggggacuggccaagcugcaccuauaccggugucacccaacacaaccacgccgcuuucgucaaucuccugaacaucgaaaccgacuacacaaagaccuuccacuuccacagcaaacgagucaccgcccacggagacacaccccaacuagaccucaaagccagacccaccuacggcgccggcgaaaucacgguccucguagaagucgcagacauggaacuacauaccaaaaagguagagaucucaggccuaaaguucgcaucccuagccuguacuggcugcuacgcauguucuuccggcauaucuugcaaaguacgcauucaugucgacgaacccgacgagcuaacaguccacguaaaaagcagcgacccugacgucgucgccgccagcaccuccuuaauggcccguaaacuagaguucggaaccgacagcacauuuaaagcguuuucggccaugcccaaaaccucccuaugcuucuacaucguggaacgcgaauacugcaaauccugcuccgaagaagacacacaaaaaugcgucgacaccaaacucgaacaaccccaauccauccuaaucgaacacaaaggcaccaucaucggaaagcaaaacgacacaugcacagccaaagcaucgugcugguuagaaagcgucaaauccuucuucuacggccucaaaaacaugcuaggauccgucuucggaaacuucuuuaucggcauccuccucuuccuggcccccuucguccuccucguucuuuucuucauguucgguuggaaaauccuauucugcuucaaauguugccgccgaacccgagggcugcuaaaauauagacuacuaaaagaugacgaagagaccggauaccggagaauaauagaacgcuuaaacaacaaaaaggggaaaaaccgacuucuugacggcgagcgacuagcggaccgcaagauugccgaacuauucucgacgaagacacacauagga

SEQ ID NO: 15507 - RNA, 2916 nt, Artificial Sequence
  derived and/or modified CDS sequence (opt11) from CCHFV(AP92, Artificial)__DQ211625.1__Gn-4aa-Gc
ucagagggcggagauggcggcugcaucucccgaacccaacucauaaaaacagagacggccgaaguccacggcgacgacuacgggggacccggcgagaaaaucaccaucugcaacggguccaccaucgucgaccaacggcucggcuccgaacuaggcugcuacaccauaaaccgcaucaaaucauucaaacucugcgagaacucagcccaagguaaaaacugcgaaauagacuccgcacccguccaaugccgccagggcuacugccucaaaauaucccaagagggcaggggacacgucaaacucucccgaggcagcgaaaucguauuagacguuugcgacacauccugcgagauuaugauccccaaaggcacuggggacauacucguagauugcucaggaggacagcagcacuuucuacaauccaaccucguugaccuaggcugccccaacaucccgcugcucgggaaaauggcuaucuacaucugccgaauguccaaccauccaaagaccacgauggccuuucuauucugguucuccuuuggcuaugucauaaccugcauccucugcaagacacucuucuacauacucaucauuaucggcacacuugguaaaaagcucaagcaauaccgcgagcuaaaaccccagaccugcaccauaugcgagagcgucccggucaacgccaucgacgcagaaaugcacgaccuaaacugcucauacaacauaugccccuacugcgcaucacgccucacuucagaaggacucacgcgacacgucaaucagugccccaaacguaaggaaaaaguugaggaaaccgaacuguauuugaaccucgagcgcauacccuggaucguccgcaagcuacuccaagucucugaauccacaggaguugcacugaagcgcucauccuggaugauaguccuccuaauccuucuuaucgucuccaugucgccgguccaaagcgcccccaucucaaggaaaccccucuuccucgacucaaucgcgaaaggcgucaaaaaucuguuaaacagcaccagccucgaaacaucacucucaaucgaggcgcccuggggcgccaucaacgcacagucgaccuacaaaccaacugccagcucugccaacaucgcccucaccugguccucgguggagcaccgcggaaacaaaauccucgucucaggacgaucagaguccaucaugaaacucgaggaacguacagggaucaguuggaacuuaggcguugaggacgccuccgaaucccggacacuaaccaucucgguaauggaccuuucucaaauguauucgccagucuucgaauaccucagcggagaccgacaagucgaagaauggcccaaagcuacaugcacggggaauugcccggagcgaugcggaugcaccagcucaaccugccucuacaaagaauggccacacucucgcaacuggcgauguaauccaaccuggugcuggggcgucggaacaggcugcacuuguugcggacucgacgucaaagaacucuucaccgaucacaugcucguuaaguggaagguggaguacaucaaaaccgaagcaauagucugcgucgaacucacgucccaggaacgacagugcucccuaauugaagccggcacgcgcuucucccucggcccagucacgaucacccuuuccgaacccaggaacauccagcagaaacugccaccagaauuaauaacccuacacccuaaaaucgaagacgguuacuucgaccuaaugcacguacagaaaguaaugagcgcuuccaccguaugcaaacuacaaagcugcacccacggcguaccaggcgaccuccaaaucuaccaugucggcaaccuccuaaaaggggaccgagugaacggacaccugauacacaaggucgaaccccaccucaacaccucguggauguccugggacggcugugaucuagacuacuuuugcaacaugggcgacuggccaucgugcacguauaccggaguaacccagcacaaccacgcggcuuucgccaaccuucucaacauagaaacagacuacacaaagaccuuccauuuccauucaaaaagagucaccgcacacggcgacacuccccaacuggaccuuaaagcgcguccgcgcuacggcgccggagaaaucaccguccuagucgaaguagccgacauggaacuucacaccaaaaagguagaagucaccggccuaaaauuugcauccuuaaccugcucaggaugcuacgcgugcuccuccggaaucuccugcaaaguccgaauccacguagacgaacccgacgagcucacaguccacgucaaaucguccgaccccgacaucgucgcggcuuccucaagccuaauggcuagaaaaauagaguucggagucgacaguaccuuuaaagcauucucaaguaugcccaaagacucacucuguuucuacaucguagaacgcgacuacugcaacagcuguaaaaacgaagaaacccagaggugcgucaacgccaaacucgaacaaccacaauccauacucauagaacacacaggcacaauaauaggcaaacaaaacgacacuugcggaucgcgcaccagcugcuggcuagacagcuucaaaaguuucuucuacggccucaaauccaugcuguccggcauauuuggcaaugucuuccucggaaucuuccuguuccuagccccuuuugcacuccuccucuucuucuucuucuucggauggcgcauccuauucuguuucaaaugcugcagaagaacucgcggcuuauucaaauaccgacacauuaaagacgacgaggaagucggguacaagaaaaucauagaacgccucaacaacaagaaaggcaaacacaggcuccucgacggggaacgccuugccgacaggaaaaucgccgaacuguucagcacgaaaacccacaucggc

SEQ ID NO: 15508 - RNA, 2916 nt, Artificial Sequence
  derived and/or modified CDS sequence (opt11) from CCHFV(ArD8194, Artificial)__DQ211626.1__Gn-4aa-Gc
gccgaaggcggcuccaacgacugcguauccagaacacagcuagucaaaacagagguggcagagauacacgaagacuccuauggggguccaggcgagaaaauaacgaucugcaacggauccaccauagucgaccaaaggcucggaucggaauuaggcugcuacacaaucaaccggguccgaacauacaaacucugcgaaaacucggccacugaaaaauccugcgagaucgacucagucccagucaaaugcaaacaaggcuucugccucaaaaucacccaagaaggucgaggacacgucaagcucucucgcggcacugaaaucguccuggacgucugcgacaccuccugcgaauuaaugaucccaaaaggcaccggugacauccuuguugacugcagcggcggacaacagcacuuccugcaagacaaccucaucgaccuaggaugcccuaacauaccccuccuaggacgcacagccaucuacguaugccgaaugucaaaccaccccaaaacaaccauggcguuccucuucugguuuuccuucggauacguaaucacauguguugucuguaaaguccuguucuaccugcuaauugucaucggaaccuuaggcaagcgucucaagcaauaucgagagcugaaaccccaaacauguauagucugcgaauccauaccaguuaacgcgauagacgccgaaaugcacgaccuaaacugcaacuauaacaucugccccuacugcgcauccagacucacaagcgacggacucgugcgccacguaacccaaugcccaaaacgaaaggaaaaagucgaagaaaccgagcuauaccuaaaccucgagcguauccccuggcuuguccgcaaacuacugcaggucucagaguccaccggcgucgcccuaaaacgcucaugcuggaugaucacacuacuaauccuccugacagucuccauguccccuguacagucagcacccgucggacgaaaaccccucuuccucgacagaaucgccaagggcaugaaaucccuguuaaacucaaccucccucgaaacaucacuuagcaucgaagccccauggggagccauaaacguucaauccaccuucaagcccaccgucuccgcagcuaacauagcacucagcuggagcuccgucgaacacaaaggcaacaagauccuagucuccggacgaucagaaagcaucaugaagcucgaggaacgcaccgggauauccuggugccucggcgucgaggacgccagcgaguccaaaacgcuaaccguaagcgucauggaccucucucaaauguacucacccgucuucgaauaccucucaggugaccgccaagucgaagaguggccaaaagcaaccugcaccggggacugcccagagcggugcgggugcacauccucuaccugcuuacacaaggaguggccccacagccgaaacuggcgcugcaacccaaccugguguuggggcguaggcacaggauguaccugcugcggccuagacgucaaagaccucuucacggacuacaugcuagucaaauggaagguugaauacauuaagaccgaggcaaucaucugcgucgaacugaccucucaggaacgccaaugcucccuaaucgaagccggaaccagauuuaaccuuggacccguuaccaucacccucucagaaccccgcaacguacaacaacgacucccucccgaaauaaucacguuacaucccaaaauugaagaaggcuuuuucgaccucaugcacguccaaaaaguaaugucggccagcacaguaugcaaauuacaaagcugcacccacggcguccccggcgaccuccaaguauaucacguaggaaaccucuuaaagggcgauaagguaaaugggcacuccauccacaaaauagaaucccaccucaauacuucuuggaugucaugggacgggugcgauuuagacuacuucugcaacaugggcgacuggcccuccuguacuuacacaggcguaacacagcauaaccacgcggccuucaucaacaugcuaaauauagaaaccgacuacaccaaaaccuuccacuuucacucaaaacgggucaccgcccacggcgauacgccgcaauuagaccucaaagcccgcccagccuacggggcaggcgaaaucacgguccucgucgaaguagccgaccucgaacuccacacaaagaaaauagaaguauccggccucaaguucgccucacuuuccugcucuggcugcuacgccugcucgagcggaauauccugcaaaguccgcauccacguuaacgaacccgacgaauuuacaguacaugucaaaaguaacgacccagacgucgucgccgcaggcuccagccuaauggcaagaaagaucgaguccggcgcagacagcacuuucaaagccuuuuccagcaugcccaaaaacucccuaugcuucuacauagucgaacgggacuacugcucgagcuguaccgaugacgauacccagaaaugcguugacaucaaauuagaacacccgcaaucgauccuaaucgaacacaaaggcaccaucaucggcaaacaaaacgacacaugucccaccaaaaccagcugcuggcucgaaucaauaaaaucguucuuuuacggauugaaaaacaugcuaagcggaaucuucggaaacgucuuccuaggaaugcuacucuuccucgcccccuucauacuacucauucuuuucuucuucuuuggauggcgccuacucuucugccuaaaaugcugccgccggacccggaaacuccuaaaauauaaacaccuacgcgacgaggaagaaucaggauauaagaagaucauagaacgauuaaacgacaagaaaggaaaaucacgccucuucgacggagaacgacucgccgaccgaaaaaucgccgaacucuucucgacaaagacccacaucggc

SEQ ID NO: 15509 - RNA, 2916 nt, Artificial Sequence
  derived and/or modified CDS sequence (opt11) from CCHFV(ArD15786, Artificial)__DQ211627.1__Gn-4aa-Gc
gcggaaggcggcucuaacgacugcguuagccgcacacagcucgucaaaacagagguaaccgaaauccacgaagacagcuacggagggccaggcgagaaaaucaccaucugcaacggcagcacaaucguagaccaacgacugggcagcgaacucggaugcuacaccaucaacagagugagaacguacaaacuuugcgaaaacuccgccacggagaaaagcugcgaaaucgacagcgucccagucaaaugcaaacaaggauuuugccugaaaaucacccaggaagggagaggucacguaaagcuaagccgaggcacagaaauaguacucgacgugugcgacaccucuugcgaacucaugauccccaaagguacaggcgacauacucguagacugcagcggcggccagcaacacuuccuucaagacaaccuaaucgaccuaggcugcccaaacauaccacuccucggccaaacggccaucuacgucugucggaugucaaaccacccaaaaacaacgauggcguuucuauucugguucucauucggauacgucauaaccugcguugucugcaaaguucucuuuuaccuacucaucgucaucgguacccuaggcaagcgccugaaacaauaccgagagcucaaaccgcagacaugcauagugugcgagucaaucccuguaaacgcaaucgacgccgaaaugcacgaccucaacugcaacuacaacauaugcccauacugcgcaagcagacucaccuccgacggccuaguccgacaugucacccagugccccaaacgcaaagaaaaaguagaagaaaccgaacucuaccuaaaccuagaacgcauacccuggcucgucagaaaacuccuacaagucucugaaucgaccggagucgcacucaagagaucaugcuggauaauuacacuccucauccuccuaacugucuccaugaguccuguccagucagcccccguaggaagaaaaccccuaagccucgacaguauagcaaagggaaugaagucgcuccucaauucgacuucucuagaaaccucccucucgaucgaagcccccuggggcgcaaucaauguccaaucaaccuucaaacccaccauauccgcagccaacauugcccucuccuggagcuccguggaacauaaaggcaacaaaaucuuaguaucgggccgcagcgagagcauaaugaagcucgaagaacgcacgggcaucucguggugccuaggugucgaagacgcuagcgaaucuaaaacacucacuguguccgugauggaccucucccaaauguacucccccgucuucgaauaccugucaggagacaggcaaguagaagaauggccaaaagcaaccugcacaggcgauugccccgaacgcugcggaugcaccuccuccacaugccuacacaaagaauggccccacucccgaaacuggcgcuguaacccaaccuggugcuggggcguagguacaggcugcacuuguugcggacucgacgucaaagaccuguucacggacuauaugcucgucaaauggaaagucgaguacaucaaaacggaagccaucaucugcgucgaacuaaccagccaagaacgccaauguucacucaucgaagcaggcacacgguucaaccucggcccagucacgaucacccuuagcgaaccccgcaauguccaacaacggcucccucccgaaauaauaacacuccacccgaaaauagaggaaggauucuucgaccucaugcacguacagaaggucauguccgccucgacagucugcaagcugcaauccugcacccacggcguccccggcgaccuccagguauaccacgucggaaaccugcuaaaaggcgacaaagucaacggccacucaauccacaaaaucgaaucucaucucaacaccucauggaugagcugggacgggugugaccuagacuacuuuugcaacaugggggauuggcccagcugcaccuacaccggcguaacgcaacacaaccgagccgcauucaucaacaugcuaaacauugaaacagacuacacaaagacguuccacuuccacagcaaacgcgucaccgcgcacggagauacuccccaacuggaucugaaagccaggccaaccuacggagccggugagauuacuguccucgucgaagucgccgaccuugaacuacacacgaaaaagauagaggugucgggccuaaaauucgcaucgcuaacgugcagcggcugcuacgccuguuccagcggaaucuccugcaagguccggauucacgucaacgaaccagacgaguucacaguccacgucaaguccaacgacccagaugucguagccgccggcucaucucuaauggcgagaaaaaucgaaucaggcgcagacucaacauucaaagccuucuccucaaugcccaaaaacucacuguguuucuacauagucgagcgagacuacugcucuagcugcacggaugacgacacucaaaaaugcgucgacaucaaacucgaacacccccaauccauccucaucgaacauaaaggcaccauaauaggcaagcaaaaugacacgugcccaaccaaaaccuccugcuggcuagaguccaucaaauccuucuucuacgggcucaagaacaugcugucaggaauauucggaaacauuuuccucggaaugcugcuuuucuuagcaccauuuguccuauuaauuuuguuuuucuucuucggcuggcgccuacuauucugccuaaaaugcugcaggcgcacacgaaaacuacuaaaguacaagcaccuccgugacgaggaagaaagcggcuacaagaaaauaauagaaaggcucaacgacaagaaaggaaaaucaagacucuucgacggcgaacgucuugcagacagaaaaaucgccgaacucuucuccacaaaaacgcacguaggc

SEQ ID NO: 15510 - RNA, 2916 nt, Artificial Sequence
  derived and/or modified CDS sequence (opt11) from CCHFV(ArD39554, Artificial)__DQ211628.1__Gn-4aa-Gc
uccgaguccaacaacaacgacugcguuucccgaacacagcucauaaaaacugagaacgccgaaauccacggcgacgacuacggcggccccggagaaaagauaacaauuugcaacggaagcaccaucgucgaacagcgucuuggaucggaacucggaugcuauaccaucaacaggauuaaaucauuuaaacuaugugagaacuccgcaagcggcaaaggaugcgaaaucgacagcacgcccguaaaaugcaaacaaggauuuugccucaaaaucacccaagaggggcgcggccacgucaaacucagccgaggcuccgaaauaauccucgauguaugugacuccucuugugaaaugaugaucccaaaagggagcggcgacauccucgucgacugcagcggcggucagcaacacuuccuccaagacaaccuaguagaccucggaugccccaacgucccgcuccucgguaaaauggcaaucuacaucugucgcaugagcaaccaccccaagacaaccauggcguuccuauucugguucuccuucggcuacgucauaaccugcaucuucugcaaaguuauauucuacgucuuaaucaucauaggcacccuaggcaagcggauaaaacaauaccgcgagcucaagccacaaacuuguaccauuugcgaagcaacccccgucaacgcaaucgacgcagagaugcacgaccuaaacugcaguuacaacaucugccccuacugcgccucccgucuaacaucagaaggccucguccgccacgucacucaaugcccaaagcgcaaagagaaaauagaagaaacagaacucuaccucaaccuagaacggaucccgugguucguaaggaaacuacuccaaguaucagaaagcaccggagucgcgcucaaacgcuccucauggcuagugacucucuuaguacuccuaaccgucucccugagcccuguccagagcgcacccauaggccgcaaaccacucuuucuugauagcacagccaaauccaugaaaucgcuccucaacucaacuucacuagaaacaucgcucucuauagaagcaccauggggcgcuauaaacguacaaagcacguucaaacccacggcgucaaccgcaaacaucgcgcucucguggucaucaguagaacaccguggcaauaagauacuggucacaggacggagcgaaaguaucaugaagcuagaggaacguaccggaauauccuggaaucucggggucgaggacgccuccgagucaaaaacacucaccguaucugucauggaucuaucucagauguacucaacugucuucgaguaccuguccggcgaccgccaaguagaagaguggcccaaagccacaugcaccggagacugccccgaacgaugcggcugcaccuccagcacgugccugcacaaggccuggccucacuccagaaacuggagaugcaacccgaccuggugcugggguguggggacaggcuguaccugcugcggacuagacgucaagaaccuguucacggacuacaugcuuaucaaguggaaagucgaguuuauaaagacagaagcuaucgucugcgucgagcucaccucgcaggagcgccaaugcucacuuaucgaagcaggcacacgcuucaaccuaggccccguuacaaucacacuauccgagccacgcaacauccaacaaaaacucccgccugagcucgucacacuacacccaagaguagaagagggguucuuugaccuaaugcacguucagaaaguccucagcgcgagcacagucugcaaacuccaaucaugcacgcacggcguaccaggugaccuccaaguauaucacguaggcaaccuccuaaagggagauaaaaucaacggaaacuccuuccacaagaucgaaccaaacuuaaacacgucuuggaugagcugggacggaugugaccuagacuacuacugcaauaugggcgacuggccaucgugcacauacacaggagucacccaacacaaccacgcagcauucgucaaccuccugaacaucgaaaccgacuacaccaaaaacuuccacuuccacagcaaaagaguaacagcccacggugagaccccgcaacuggaucuuaaagcccgcccaaaauacggcgccggcgaagucacgguccucgucgaaguugcugacauggaacuccacaccaagaaaaucgagaucucaggacugaaauuugcaucacugacuugcacaggaugcuacgccugcucuagcggcaucuccugcaaaguccgccuccacguagacgagcccgacgagcugacuguacacguaaaauccgacgacccagacguaguagcggccucuaguucgcucauggcgcggaaaauagaguucggaaccgacucaacauucaaagcauucuccaguaugcccaaagacaaacucuguuucuacauaguagaacgggacuacugcuccuccugcagcaaagaagacacacagaaauguguaaacgccaaacuugaacagccacaaucgauccuaaucgaacacaaaggcacaauaaucggcaaacaaaacgacacgugcaccgucaaagcaucaugcuggcucgaaagcgucaaaucguucuucuacggccucaaaaacauguuaggaggcaucuuuggcaacgucaucuuaggcauuauaauguuccuagcucccuucgcgcuccuacuacuguucuuccucuucggcuggcgaauacucuucugccuacguugcugccggcgcacccgugggcucuuuaaauacaaacacaucaaagacgacgaagagucuggauacaaacgcauuauagagcgacucaauaacaagaaaggcaaaaacaaacucuucgauggagaacgucuugcggacaagaaaauagcagaacucuucuccaccaagacacacaucggc

SEQ ID NO: 15511 - RNA, 2916 nt, Artificial Sequence
  derived and/or modified CDS sequence (opt11) from CCHFV(C-68031, Artificial)__DQ211629.1__Gn-4aa-Gc
uccgaagaauccggggacgacugcaucagucggacacaacuaucccgcaccgaaacagccgagauccauagcgacaacuaugguggccccggagacaaaaucaccaucuguaacggcagcacuaucguagaccaacgccucggcuccgaacucggcugcuacaccauuaaccgcgucaagagcuucaaacucugcgaaaacucagcuacugggaaaagcugcgaaaucgacucaacccccauaaaaugccgacaaggcuucugccuaaaaaucacacaagaagguagaggccacgucaaacuaucucgcggcucggaagucguccuagacgcaugcgauuccuccugcgagaucaugauaccgaaaggcaccggugacauccucgucgacugcagcggcggccaacaacauuuccucaaagacaaccuuaucgaccucgggugcccgaacauaccccugcucggcaaaauggccaucuauauaugcaggauguccaaccauccaaaaacuacaauggcauuccuguucugguucagcuucggcuacgugaucacaugcauacuuugcaaagugauauucuauuugcucaucgucguaggaacgcucggcaaaaaguucaagcaauaccgcgagcucaaaccgcaaacgugcaccaucugcgagaccacaccagugaacgccaucgaugccgagaugcacgacuuaaacugcucuuacaacauaugcccguacugcgcaucgcgccuaaccuccgacggacucgcccgccacgucaugcaaugcccaaaacgcaaagaaaaagucgaagaaacugaacuauaccucaaccucgaaagaaucccauggguagucaggaaacuccuccaagucuccgaguccacagguguugcuuuaaagcgcuccucauggcuagucguccuccuaguccuauugacagucucccucucccccguccagagcgcccccauaggacgaaaaccccucuucuccgacucaauagucaaaggaaugaaaaaccuccuaaauagcacaucccucgaaacaucacuaucaaucgaagccccuuggggcgcaauuaacguacaaucaaccuucaaacccacaguaagcgccgccaacauugcucuuuccuggucguccgucgagcaccgcggaaacaaaauucucgucuccggaaggagugagucaauaaugaaacucgaagagagaacagguaucucaugggaccucggggucgaggacgcaagcgaguccaaacuccuuaccgugagcaucauggaccucucccaaauguacagccccguauucgaauaccucucaggcgacagacaaguugaagaauggccgaaagcuacaugcacgggagauugcccggaacgcugcggcugcaccagcagcacgugccuacacaaggaauggccacacagucggaacuggagaugcaacccgaccuggugcuggggcguuggaaccggauguaccugcugcggcuuagauguaaaagaccuguucacugacuauauguucgucaaauggaaagucgaauacaucaaaaccgaagcaaucguaugcguagagcucacaucccaagagcgucagugcucacucaucgaagcaggcacacgguucaaccuaggcccggucaccaucacccuauccgaaccacgcaauauucaacagaagcucccacccgaaaucguaacccuccacccucguaucgaggaaggcuucuucgaccucaugcacgucaaaaagguacucagcgccuccacgguaugcaaacuccaaucuugcacccacggaguccccggagaccuacaaguguaucacauuggaaaccuccucaaaggggacaaaguuaacggacacuuaauacacaagauugagccacacuucaacacuagcuggaugucaugggacgggugcgaucucgacuacuacugcaacaugggcgacuggccaucaugcuccuacacgggcguaacccagcacaaccacgcagcauucgucaacaugcucaacaucgaaacggacuauacaaagauauuccacuuccacucgaaaagggucacagcccacggcgacaccccgcagcuagaccuuaaagcgcggccaacguacggcgcgggagagauaaccguccucguugaagucgcagacauggaacuacacacaaagaaaaucgaaaucuccggccuaaaauucgccucgcucacaugcaccggcugcuacgcuugcucuagcggcauaucaugcaaaguccgcauccacguagaugaacccgacgagcuaaccguacacguaaaguccgaagacccagacaucgucgcagcgagcagcucccucauggcccgaaaacuugaguucggcacagacucuacauucaaggcuuucuccgcaaugccgaaaaccagccuaugcuucuacaucgucgaacgcgaauacugcaaaagcuguuccaaagaagacacccagaaaugcgucaacaccaaacucgaacaaccacaaagcauacuaaucgaacacaaaggcaccaucaucggcaagcaaaacgacacgugcacaagcaaggccggcugcuggcuggaaagcgucaaauccuucuuuuacggacuuaaaaacaugcuaucaggaaucuucgggaauguauucauaggcaucuuccuauuccuagcacccuucauccuccuaauccuguucuucauguucggauggcgaauccuauucugcuucaaaugcugccgacgcacccgaggucucuuuaaguaccgacaccucaaagacgacgaggagacaggauaucgaaaaaucaucgagcgucuaaacaauaaaaagggcaaaaacaagcuccuagacggugaacgucucgccgauaggaagauagcagagcuauucuccaccaaaacacacaucgga

SEQ ID NO: 15512 - RNA, 2916 nt, Artificial Sequence
  derived and/or modified CDS sequence (opt11) from CCHFV(Drosdov, Artificial)__DQ211630.1__Gn-4aa-Gc
uccgaagaaccaggggacgacugcauaagcaggacacaacuccucaaaacagagacggccgagauacacgacgacaacuacggaggacccggagacaagauuacaaucuguaauggcucuaccauaguagaccagaggcuuggauccgaacucgggugcuacaccauuaaccgcguaaaaucauucaaacuuugugaaaacuccgcaacaggaaaaaccugcgagaucgacagcacaccagucaagugccgacaaggcuucugccugaaaaucacacaagaaggccgugggcacgucaaacugagccggggcucggaaguaguccuagaugcaugcgacuccucaugcgaaguaaugaucccaaagggcaccggagauauccuaguagacugcagcggcggccaacaacacuuccuaaaagacaacuugaucgaccuuggaugcccucacaucccccuacucggcaaaauggccaucuacaucugucguauguccaaccacccacgcacaacgauggcguuccucuucugguucagcuuugguuacgugaucacgugcaucuucugcaaagcucuauucuacucgcugaucauaaucgggacacuuggaaagaaaaucaaacaauaccgcgaacuaaaaccacaaaccuguaccaucugcgaaaccgcgcccguaaaugcaaucgacgcggaaaugcacgaccuuaaaugcuccuacaauauaugccccuacugcgcaucgcgccuaacuuccgacggucucgcccgccacguaacacaaugcccaaagagaaaagagaaagucgaagaaaccgaacuuuaccucaaccuagaacguauaccauggauaguccgcaaacugcuacaagucucggaaucgaccggaguggcacucaaacgcuccuccugguugauagugcuccuagugcuccucacagugagccucucaccaguacaaagcgccccggucggacgaaaaccccuauuccuugacucuacaguaaaaggcaugaagaaccugcucaacucaaccucccuagaaaccucccuaucaauagaagcacccuggggcgcaaucaacguacaguccaccuucaagcccacagugucaacagcaaacauagcccuauccuggucgucaguugaacaccgcgguaacaaaauucuagucaccggccgcagcgaauccauaaugaaacuggaagaacgaacaggaguaucgugggauuuaggaguagaggacgcaagcgaauccaaacuccuaaccgucagcauaauggaccucucacaaauguacuccccgguguuugaguaccucucaggagaccgccaaguagaagaauggccgaaggcgaccugcacaggggacuguccagaacguuguggcugcaccagcagcacuugccuccauaaggaguggccacacucacgaaacuggcgauguaauccuaccuggugcuggggaguaggcaccggcugcacaugcugcgggguagacguaaaggaccucuucaccgaccacauguuugugaaauggaaggucgaauacaugaaaaccgaagccaucgugugcgucgagcucaccagccaagagcgucaaugcucacucaucgaagccgguacacgcuucaaccuaggcccaguaaccaucacccuaagcgaaccccgcaacauccagcagaaacucccgcccgagauuaucacacugcaucccaagaucgaggaaggauucuuugaccucaugcacguacaaaaaguccuuucugccagcaccguuugcaaauugcaauccugcacacacggaauccccggagaccuucaaauauaccacaucgggaaccuacucaagggagaccgcgucaacggccaccuaauacacaaaaucgaaccccacuucaacacaucauggaugagcugggacggcugcgaccucgacuacuacugcaacaugggaaacuggcccuccugcaccuacaccggcguuacacaacacaaccacgccgccuucguuaaccuauuaaacauagaaacagacuacacaaaaaccuuccacuuccacuccaaacgcguuacagcccacggcgacacuccucaacuagaccucaaagcacgacccacauacggcgcaggcgaaaucaccguccuagucgaaguugccgacauggagcuccacacaaagaaggucgaaaucagcggccugaaauucgcaucgcucguaugcaccggcugcuacgcgugcuccagcgguaucucaugcaaagucaggauccacgucgacgaacccgacgaacucacaguccacgucaaguccucugaccccgacguuguagcagcaucaacgagcuuaauggccaggaaacuugaguuuggaacagauagcaucuucaaggcauucagcgcaaugcccaaaacaucacuguguuucuacaucgucgaacgcgaguacugcaaaucgugcucagaagacgacacaaagaagugcgucgacaccaaacucgaacaaccgcaaucaauacuaaucgaacacaaagguacuaucaucggcaaacagaacgauaccugcacagccaaagcauccugcuggcuggaauccgucaagucauucuucuauggccuuaagaacaugcucgguucgguguuuggcaacuucuucgugggaauacuucucuucuuggcuccauucguacuccucguccuauuuuucauguucggauggaaaauccuauucugcuucaaaugcugccgccgcacacgcggccucuucaaguaccgacaccuaaaggacgacgaggaaacaggguacagacgcauaaucgaacgccuaaacuccaaaaagggcaaaaacagacuacuugacggagaaagacucgccgaccgcaaaauagcagaacucuucucaacaaaaacacacaucggc

SEQ ID NO: 15513 - RNA, 2916 nt, Artificial Sequence
  derived and/or modified CDS sequence (opt11) from CCHFV(Kashmanov, Artificial)__DQ211631.1__Gn-4aa-Gc
ucagaggaacccggcgacgacugcaucucacgaacccaacugcuccgaacagaaacagcugagauucacgacgacaacuacggcggccccggugacaaaauaacaaucugcaacggcagcaccauaguugaccagcgccuaggcuccgagcuaggcugcuacaccauaaaccgugucaaaaguuucaaacuaugcgaaaacuccgcuaccgguaaaaccugugaaaucgacuccacacccguaaaaugccgacaaggcuucugccucaaaauuacgcaagaaggcaggggccacgucaagcugagccgcggcuccgaaguaguauuagacgcuugcgacucaagcugcgaaguaaugauacccaagggaaccggagacauccucgucgacugcuccggcggucagcaacauuuccucaaagacaaucucauagaccuaggcugcccacauauaccacugcuuggaaaaauggccaucuacauaugccguaugagcaaucacccucgcaccaccauggcguuccuauucugguucucauucggcuacgucaucaccuguauuuucugcaaagcccuauucuacucacugauuaucaucggcacccuaggcaagaaaaucaaacaauaccgagaacucaaaccccaaaccugcacaauaugcgaaaccgcacccgucaacgcuauugacgccgaaaugcacgaccucaauugcuccuacaacaucugccccuauugcgccucccgccucacuucggauggccucgcacgccacgucccccaaugcccaaaacgaaaagaaaaggucgaagaaaccgaacucuaccucaaccuagagcgaauccccuggauugucagaaaacuccuucaaguaucggaaagcacaggcgucgcccuaaaacgcuccucauggcuaaucguccuccucguacuccuuacugucucccucucuccaguccaaucggcaccgguaggccguaaaccacuauuccuagacuccauagucaaaggcaugaaaaacagccucaacucaacaagccuagaaaccucucucucaaucgaagccccauggggcgccaucaacguccaaucaaccuucaaaccaaccgucucgacagcaaacauugcccucucuugguccucagucgaacaccgcggaaacaaaauccuagucacagggcgcagcgaauccaucaugaaacucgaagaacgaaccggaguauccugggaccucggagucgaagacgcaagcgaguccaaacuccugacagugaguaucauggaucucagccaaauguacucacccguuuucgaguaccuaucaggcgaccgccaggucgaagaauggcccaaggcaaccugcaccggugauugcccugagcgaugcggcugcacaagcucuaccugccuccauaaggaauggccacacagccguaauuggagaugcaaccccaccugguguugggguguaggaacaggaugcacaugcugcggcguagacgugaaagaucuuuucaccgaccacauguucgucaaauggaaagucgaauauaucaagaccgaagccaucgucugcgucgaacucacaucccaagaaagacagugcucacucaucgaggcaggcacccgcuucaaccuaggcccagucacgaucacgcuuagcgaacccagaaacauacaacagaaacucccaccugagaucaucacacuccauccgaaagucgaagaaggcuucuucgaccuaaugcacguucaaaaaguacuauccgccuccacggucugcaaacuccaaagcuguacccacggcauccccggcgaucuucaagucuaucauauaggcaaucuucucaaaggggaccggaucaacggacaccucauucauaagaucgaaccccacuucaacacuuccuggaugucaugggacggcugcgacuuagacuacuacuguaacaugggcgacuggcccucaugcacguacacgggggugacccaacacaaccacgcggccuucguaaaccuccucaacaucgagacugacuacaccaaaaccuuccacuuccacucgaaacgugucacagcucacggagacacaccccaacuggaccuuaaagcccgaccgaccuauggggccggagaaauaaccguacugguagagguugccgacauggaacuacacaccaagaaaguagaaaucucuggacugaaauucgccucccucgcaugcaccggcugcuacgcgugcucguccggcauaucaugcaaaguacgcauccacguggacgagccggacgaacucacaguucacguaaaaagcuccgacccagacgucguggccgcaaguaccuccuuaauggccagaaaacuugaguucggcacagacuccaccuucaaagcauucuccgcaaugccaaaaacaagccucugcuucuacauaguagaacgggaauauugcaaaagcugcagcgaagaagacacccaaaaaugugucgacacaaaacucgaacagccccaaucgauacucauagaacauaagggcaccauaaucgguaagcagaacgauacuugcaccgcaaaggccagcugcuggcucgaaaguguaaagagcuucuucuacggccucaaaaacaugcucgguuccgucuucggaaacuucuucaucggcauccuccucuuccuagcuccauucguccuccucguucuauucuucauguucggauggaaaauucucuucuguuucaaaugcugccgccgcacccggggccugcugaaauaccgacaccucaaagacgacgaagagacagguuaccgccgcaucauagaacgccuaaacaacaagaaaggcaaaaaccgccuccuagacggcgaacgcuuagccgacagaaaaauugcagaacucuucagcaccaaaacacacauuggc

SEQ ID NO: 15514 - RNA, 2916 nt, Artificial Sequence
  derived and/or modified CDS sequence (opt11) from CCHFV(Oman, Artificial)__DQ211632.1__Gn-4aa-Gc
uccgaagaaagcggggaagacugcaucucccggacccaacuccuccgaaccgaaaccgccgaaauucacggcgacaauuacggcgggccaggcgacaagaucacaaucugcaacggcagcacaaucguugaccagcgauuaggcucggaacuaggaugcuauacaaucaaccgaguaaaaucauuuaaacucugcgaaaacuccgcaaccgguaaaucgugcgagauagacaacacccccgugaaaugcaaacaaggauuuugccuaaaaauaacccaagaaggccggggacacgucaaacucucccgagacagcgaagucguccuggacgccugcgacucuucgugcgagauuaugaucccaaaaggaacaggugauauacucguagacuguuccgggggccaacaacacuuccuuaaagacaaccucaucgaccuaggcugcccgaacaucccccuacuugguaaaauggcgauauacaucugucgcauguccaaccacccaaagaccaccauggcguucuuauucugguucucauucggcuacguaaucacaugcauccuguguaaaguuauauucuaccucuuaaucgucguaggcaccuugggcaaaaaguucaaacaauacagagaacucaaaccccaaaccugcaccaucugcgaaaccacgccugugaacgccaucgacgccgagaugcaugaccuaaacugcuccuacaacaucugccccuacugcgcaagccgacugaccagcgacggucucgcaaggcacguaaugcaauguccgaaacggaaggagaaaauugaagaaacagaacucuaucuuaaccuugaacgaaucccauggguagugcgaaaacuucuacaagucuccgaaaguacaggggucgcucuuaaaagaucuucguggcuuaucguccuacucgugcuccuaacuguaucccuaucaccuguacaguccgcacccauuggccgcaagccccucuuccuagacuccaucgccaaaggcaugaaaaaucuccuaaacuccacaucgcucgaaaccucgcucucaaucgaagcacccuggggagcaaucaacguacaaaguaccuucaaaccaacggucuccaccgcgaacaucgcacuuuccuggucgucaguugaacaccgaggaaacaaaauccuugucucuggaagaagcgaguccauaaugaaacuggaagaacggacuggaaucagcugggaccugggcgucgaagacgccagcgaaucgaaacuccucaccgucucagucauggaccuuucacaaauguacucaccaguguucgaguaccuguccggagaccgccaaguugaggaguggcccaaagcgacaugcaccggagacugcccagaaagaugcggaugcaccuccagcacaugccuacacaaggaauggccacauagucgcaacuggcgaugcaauccgaccuggugcuggggagucggaacaggauguaccugcugcggccucgacgucaaagaccuauucacggacuacauguucgucaaauggaaaguugaauacauaaaaaccgaagccaucgucugcguugaacuaaccucacaagaacgccaaugcucacuuaucgaagccggaacccgcuucaaucuaggaccagucacaaucacgcugucugaaccccgcaacauacaacaaaagcuacccccugaaaucgucacgcuccacccgcgaauagaggaaggcuucuuugaccuaaugcacguacagaaggucuuaucugccagcaccgucugcaagcugcaauccugcacacacggcgucccaggagaccuccaagucuaccacauaggcaaccuacuaaaaggcgauaaggucaacgggcaccucauccacaaggucgagccccacuucaauaccagcuggaugucaugggacggaugcgaccucgacuacuacugcaauaugggagacuggcccuccugcacauacacgggagucacccaacacaaccacgccgccuucguaaacuuacuaaacaucgaaacagacuauacuaaaaauuuccacuuccacuccaaacgcgucacggcccacggugauacaccacaacucgaccucaaagcacggccuaauuacggggcuggcgaaguuacaguccucguagaaguagccgacauggaauugcacaccaaaaagauagaaaucuccggacucaaauuugcuucgcuaacaugcacaggaugcuacgccugcuccuccggaauauccugcaaaguacgcauacacgucgaugaacccgacgaacucaccguccacguaaaauccgaagacccggacaucguagccgcaucauccucccucauggccagaaaacuagaguucggcacagacucaacauucaaagccuucucggccaugcccaaaaccucgcucugcuucuauaucguagaaagagaauacuguaagucauguuccaaagaggacacccagaagugcgucaacgcgaaacucgagcgcccccaaucaauccuaaucgaacacaaaggcacaaucauaggaaagcaaaacgauaccugcacagccaaggcuucgugcuggcuagaaagugucaaauccuucuucuacggccucaaaaacauguuaucaggcaucuucggcaacguguucaucggcauauuccuauuccuugcccccuucauacuccugauacuauuuuucauguucggauggcgcauacucuucugcuucaaaugcugccggcgcacccgcggccucuucaaguaccgacaccucaaggacgacgaagaaacgggauaucggaaaauaauagagcgacucaacaacaagaaaggcaaaaacaaacuccucgacggagagcgccucgccgaccgaaaaauugccgaacucuucuccaccaagacccacauagga

SEQ ID NO: 15515 - RNA, 2916 nt, Artificial Sequence
  derived and/or modified CDS sequence (opt11) from CCHFV(SPU97/85, Artificial)__DQ211633.1__Gn-4aa-Gc
agcgaagagucagacggagacugcaucagccgcacccaacuuuugcgcaccgaaaccgcagaaauccauagugacaacuacggagggccaggcgacaaaauaacaaucuguaacggauccacgaucguggaccaacgccuaggauccgaacugggcugcuacacuaucaaccgcgucaaauccuucaaacuaugcgaaaacagcgcgacuggcaaaagcugcgagauagacuccaccccggucaaaugccgacaaggcuucugccuuaaaaucacccaagaaggaaggggacacgucaaacugucccguggcucagagaucguccuagacgccugcgacucaucaugugaaauaaugauccccaaagguacaggagacauacucgucgauugcuccggaggccaacaacacuuccucaaagacaaccucauagaccuuggaugccccaacauaccccuccucgggcgcauggcaaucuacaucugcaggauguccaaccacccaaaaaccacgauggcauuccuauuuugguucagcuucggcuacguaauaaccugcaucuuaugcaaaguaauauuuuaccuccuuauaguagccggcacggucggcaaaaaguucaaacaguaucgggaacuccgaccgcaaaccugcacaaucugcgagacaacgccaguaaacgcaauagaugcagaaaugcacgaucugaacugcuccuacaauaucugccccuacugcgcaucacgccugacauccgacgggcuagcucgacacguaaugcaaugcccaaaacgaaaagagaaaaucgaagaaaccgaauuauaucucaaccucgaacgcauaccauggguaguucgaaaacuccuccaagucuccgaauccaccgguguagcccuaaaacgauccucguggcuaaccgugcuccucguacuccucaucgugucacuuucccccguccaaucggcuccuaucggccggaaaccccuauuccucgacaguauaguaaaaggcaagaaaaaccucuuaaacagcacuucacucgaaaccucacuauccauagaagcccccuggggcgccaucaacguucaauccacguucaaacccaccgucagugcagcgaacauagcccuaucgugguccuccguagaacaccggggcaacaaaauacucgucuccggacgcagcgaauccaucaugaaacuggaagaaagaaccgggaucuccugggaccucggcgucgaagaugccucagaauccaaacugcucacaguaucggucauggaccucucgcaaauguauaguccggucuucgaauacuuauccggcgaccgacaagucgaagaauggccgaaagcuacauguaccggagacugcccagaacggugcggaugcaccucgucgaccugccuacacaaagaauggccccacucacgcaacuggcgcugcaaucccaccuggugcuggggcguaggcacgggauguaccugcugcgguuuagacguaaaagaccucuucaccgacuacauguucgucaaauggaaagucgaauauaucaaaacggaagccaucgucugcgucgaacucacgucacaggagcgccaaugcucucucaucgaagccgggacacgcuucaaccugggcccgguaacaauaacccuuuccgagccgcgaaauauccagcaaaaacucccuccugaaaucaucacacuacacccgcgcauagaagagggcuucuucgaccuaaugcacguccagaaaguacucuccgccuccaccgucugcaaacuacagucgugcacccacggcgucccgggcgaccuccaagucuaccauaucggcaaccuacucaaaggcgacaaagucaacggucaucucauccacaaaaucgaaccccacuucaacaccucauggaugucuugggacggcugcgaucucgacuacuacugcaacaugggugacuggccuaguugcacguauacgggaguaacccaacacaaccaugcagccuucguaaaccuccucaacauagaaacagacuacacaaagaacuuccacuuccacuccaaacgggucaccgcccauggcgacacaccccaacuagaccucaaagcccgccccaccuauggcgcuggagaaguaaccguccuugucgaagucgcugacauggaacuacacacaaagaaaauagaaaucucaggccugaaauucgccucacucuccugcacgggaugcuacgccuguuccagcggcaucagcuguaaagugcguauccacguagacgaacccgacgagcuuaccguacacgucaaauccgaagaccccgacauagucgccgcugggucaucgcucauggcccggaaacucgaauuuggcgcagacuccaccuucaaagcauuuucagcgaugccaaaaaccucacucugcuucuacauuguagaacgagaauacugcaaaucuugcucccgagaagacacgcaaaaaugcguaaacacuaaguuagaacgcccgcaaucgauccucauagaacacaaaggaacgauuauaggaaagcaaaacgacacgugcaccgcaaaggccucuugcuggcucgaauccgucaaaaguuucuucuacggacucaaaucuaugcucuccgggaucuuuggcaauguauucaucggcauauuccucuucaucgcaccauucguccuccuaauccucuucuucauguucggcuggcguauccucuucugcuucaaaugcugccgccgaacccgcggacuguucaaauaccgacaccuaaaagacgacgaggagaccggauaccgaaaaaucaucgaaagacuaaacaacaagaaagggaaaaacaaacuucucgacggggagcgucuagcagaccgcaaaauagcugaacucuuuucaaccaaaagccacaucgga

SEQ ID NO: 15516 - RNA, 2916 nt, Artificial Sequence
  derived and/or modified CDS sequence (opt11) from CCHFV(SPU103/87, Artificial)__DQ211634.1__Gn-4aa-Gc
ucagaagaauccucagacgacugcauaucucgcacccaacuccuccguacagaaaccgcagagauacacggugacaacuacggcggacccggcgauaaaauaacgaucugcaacggcagcaccauugucgaccaacgucuggguucagaacucggaugcuacacaaucaaucgagucaaaaccuuuaagcucugcgaaaacucagcaaccggcaagucuugcgaaaucgacuccgucccagucaaaugccgccagggcuacugccuaaaaaucacccaggaaggcagggggcacgucaaacucagccgcggcagcgaggucgugcuggaugccugcgacacauccugcgaaguaaugauaccgaaaggaacgggagacauacucguugacugcucugggggccagcaacauuuccuaaaagacaaucucauagaccucggcugcccgaaaaucccucuccucgggaagauggccaucuacauaugccgcaugucuaaccaccccaaaaccacaauggcauuccuauucugguucagcuucggcuauguaauuacgugcguccucugcaaagccaucuucuaccuacuaaucaucguaggcacacuaggaaaaagacuuaagcaauaccgagaacuaaaaccacaaacauguaccaucugcgagaccacaccaguaaacgccaucgacgccgaaaugcaugaccucaacugcucauacaacauaugcccguacugugccucucgccugacauccgacggacucgcccgacacguaacccaaugccccaaacgcaaggaaaagguugaagaaacagaacuuuaccucaaccuagaaagaauccccugggugguccgccgccuacuacaggucuccgaauccaccggcgucgcgcugaaacgcucauccuggcuaauaguacugcuggugcuauucacgguaagccucucccccguccaauccgcgcccauaucacgacgcccccucuuucuagacaauaucguaaagggcaugaaaaaucuacucaacucaacaucccucgagaccucacuauccaucgaggcuccauggggagccauaaacguccaaucgacauauaaaccgacaguaagcacugcaaacauugcccuuuccuggagcuccguggagcaccgaggcaacaaaauacucgucucaggcagauccgagagcaucaugaaauuagaagaacggaccgggauaagcugggaccucggggucgaagacgcaucggaauccaaacuacuaaccgugucuguaauggaccuaucgcaaauguacucuccuguauucgaauaccucagcggagaccgacaaguagaagaauggccaaaagccacguguacaggggacugcccugagcgaugcggcugcacaucuucaaccugccuccacaaggaauggccccacucccgaaacuggcgcugcaacccaacuuggugcuggggcguaggaaccgguuguaccugcugcggucuagacguaaaagaccuauucacggacuauauguucguuaaauggaaaaucgaguacaucaaaaccgaagccauaguaugcguagagcucaccucccaagaacgacaaugcagccucaucgaagcugggacccguuucaaccugggcccaguuaccaucacccuaucagaaccccggaacauccagcaaaagcucccaagcgagaucaucacccuccacccccgaauagaagaaggcuucuucgaccucaugcacguccaaaaaguacucagcgcaagcacagucugcaaacuccaauccugcacacacggcguccccggcgaccuacaagucuaucacauaggcaaccuccucaagggugacaaggucaacgggcaccuaguccacaaaaucgagccacacuuuaauacgucauggaugucaugggacggaugcgacuuagacuacuacugcaacaugggggacuggcccucaugcacguacacaggcgucacacagcacaaucaugccagcuucguaaaccuucuuaacaucgagacggacuauaccaaaaacuuccacuuccacucuaaaagaguaacagcccacggagacaccccacagcuagaucucaaagcccgccccacauauggagcaggcgaaaucacaguccucgucgaagucgcagacauggaacuccacaccaaaaagauagaaaucagcggacucaaauucaccucgcucacgugcaccggcugcuacgccugcuccagcggcaucucgugcaaggugcgaauacacguggacgaaccggacgaacucacuguacacguaaagagcgacgaccccgacgugguagccgcauccagcagccuaauggcgagaaaacuagaguucggcacggacagcacuuucaaagcauucucagccaugccaaaaacaucccucugcuucuacauuguagaaagggaauacugcaaaucauguagcgaagaagacacacagaaaugcguaaacaccaaacuagaacaaccccaauccauacucaucgaacacaaaggcacuauuauaggaaaacagaauaauaccugcaaagcccgagccggaugcuggcuagagagcguaaaaucguucuuuuacggacucaaaaacaugcuuucgggcaucuucggcaacgucuucaucggaauauuccuauuccucgcccccuucauccuccucauccucuucuucauguucggauggcguauacuauucugcuucaaaugcugccgccgaacucgaggacuauucaaguaccgccaccugaaagacgacgaagaaaccggguaucgcaaaaucauagaacgacuaaacaacaaaaagggaaagaacaagcuccucgacggagagcggcuagcggacagacguauagccgagcuauucucgaccaagacacacaucggc

SEQ ID NO: 15517 - RNA, 2916 nt, Artificial Sequence
  derived and/or modified CDS sequence (opt11) from CCHFV(SPU415/85, Artificial)__DQ211635.1__Gn-4aa-Gc
agcgaggaguccgacggcgacugcaucagccgcacccagcugcuccggaccgagacgaccgagauccacuccgacaacuacgggggccccggggacaagaucaccaucugcaacggcagcaccaucguagaccagcgccugggguccgagcugggcugcuacacgaucaaccgggucaagagcuucaagcucugcgagaacuccgccaccggcaagucuugcgagaucgacuccaccccgguaaagugccgccagggguucugccugaagaucacccaggagggccgggggcacgugaagcugagccgcggcuccgagaucguccucgacgccugcgacucuaacugugagaucaugauccccaaggggacaggcgacaucuuaguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguuuugguucuccuucggcuacgugauaaccugcauccuuugcaaggucaucuucuaccuccugaucguggccggcacgguggggaagaaguucaagcaguaccgcgagcugcggccccagaccuguaccaucugcgagaccauccccgucaacgccaucgacgccgagaugcacgaccucaacugcagcuacaacaucugucccuacugcgcgucccgccugacgagcgacggccuggcccggcacgugaugcagugcccgaagcgcaaggagaagguugaggagaccgagcucuaccugaaccuggagcggauccccugggucgugcgcaagcucuuacaaguguccgagagcacuggagucgcccugaagcggagcuccuggcucaccgugcugcuggugcuccugaucgucucucugucccccgugcagagcgcccccaucggccgcaagccacuuuuccuggacuccaucgucaaggggaugaagaaccugcucaacagcacgucccuggaaaccagccuguccaucgaggcgcccuggggcgccaucaacguccaaagcaccuucaagcccaccguguccgccgccaacaucgcccucagcugguccagcguggagcaccggggcaacaagauccuggucuccgggcgcagcgaguccaucaugaagcuggaggagcggacgggcaucagcugggaccucgggguggaggacgcguccgagagcaagcugcugacggucagcgugauggaccucucccagauguacagccccguguucgaauaccuguccggcgaccgucaggucgaggaguggccgaaggcgaccugcaccggggacugccccgagcggugcgggugcacgagcuccaccugucugcauaaggaguggccccacagccgcaacuggcgcugcaaccccaccuggugcuggggcguggggaccggcugcacgugcugcgggcucgacgugaaggauuuguucaccgacuacauguucgucaaguggaagguggaguacaucaagaccgaggccaucgugugcgucgagcugaccucccaggagcggcagugcagccugaucgaggccggcacgcgauucaaccucgggccggugaccaucacccuguccgagccccggaacauccagcagaagcugccgcccgagaucaucacccuccacccccgcaucgaggagggcuucuucgaccugaugcacgugcagcggguccugagcgccuccaccgugugcaagcuccagagcugcacgcacggcguucccggggaccugcaggucuaccacaucggcaaccugcucaagggggacaaggugaacggccaccugauccacaagaucgagccccacuucaauaccucguggaugagcugggacggcugcgaccuggacuauuacugcaacaugggggacuggcccuccugcaccuacaccggcgugacgcagcacaaccacgccgccuucgucaaccuccugaacaucgagaccgacuacaccaagaacuuccacuuccacucuaagcgcgugaccgcccacggggacacgccgcagcuggaccucaaggcccggcccaccuacggcgcaggggaggugaccguccugguggagguggcggacauggagcugcauaccaaaaagaucgagaucuccggccucaaauucgcaagccugacgugcaccggcugcuacgccugcagcuccgggaucagcugcaaggucaaaauucauguggacgagcccgacgagcugaccgugcacgucaaguccgaggacccggacaucguggccgccggcagcucccucauggcgcgcaagcuggaguucggggccgacucaaccuucaaggccuucuccgccaugcccaagacgagccugugcuucuacaucguggagcgggaguacugcaaguccugcagccgcgaggacacccggaagugcguuaacaccaagcucgaccgcccccaguccauccugaucgagcacaagggcaccaucaucgggaagcagaacaacacgugcaccgcgaaggccagcugcuggcucgaguccgucaagagcuucuucuacggccucaagaacaugcuguccggcaucuucgggaacguguucaucggcaucuuccuguucaucgcccccuucgugcuccugauccuguucuucauguucggguggcggauccucuucugcuucaagugcugccgccggacccgcggccuguucaaguaccggcaccugaaggacgacgaggagaccgguuaccgcaagaucaucgagcggcucaacaacaagaaaggcaagaacaagcugcuggacggcgagcgccucgccgaucguaagaucgccgagcuguucagcacgaagucccacaucggg

SEQ ID NO: 15518 - RNA, 2916 nt, Artificial Sequence
  derived and/or modified CDS sequence (opt11) from CCHFV(Turkey200310849, Artificial)__DQ211636.1__Gn-4aa-Gc
ucagaagaaccuggggacgauuguaucagccgcacgcaacugcuccgaacggaaaccgccgaaauacacgacgacaacuacggcggccccggcgacaagaucaccauaugcaacggcucaacgaucguggaucaacgccucggguccgaacuggguugcuacacaauaaaucgcguaaaguccuucaaacugugcgaaaacucagccaccggaaagacaugcgaagucgauucgaccccaguuaaaugccgucaaggcuucugccucaaaaucacccaagaagggcgcggccacgugaaacucaguagagguagcgaaguaguccucgaugcaugcgauucauccugugaaguuaugauccccaaaggcaccggggacauacucgucgacugcucaggaggccaacaacacuuccucaaagacaaccuaauagaccugggaugcccccacaucccucuccuuggcaagauggcuauauacauaugccguauguccaaccacccccgcacaaccauggccuuccucuucugguucuccuucggcuacguaauaaccugcaucucgugcaaggcccuauucuacucccucauaauuaucggcacccucgguaagaaaauaaaacaguaccgugaacuaaaaccccaaacuugcacgaucugcgaaaccgcacccgucaacgcaauagacgccgaaaugcacgaccuuaacugcuccuacaacaucugccccuacugcgcaagccgucuuacaagcgacggccuagcccggcacguaacacagugccccaaaagaaaagagaaagucgaagaaacagaacucuaccuaaaccuggagcgcauuccauggaucgugcgcaaacuccuccaagucuccgaaagcacgggggucgcccuaaaacguagcucuugguuaaucguacuccuaguccuccucacugucucccuaucccccguccaaagcgcgcccguuggcagaaaaccacucuuccuugacuccaucgucaaagggaugaaaaaccuacugaacuccacaucacuagaaaccucacucucuauagaggccccauggggcgccaucaacguacaaucgaccuucaaaccagccguauccaccgccaacaucgcccuuucauggucauccguggagcaccgaggaaacaagauccucguaaccgggcggagcgaaucaaucaugaaacuagaggagcgcaccggagucuccugggaccucgguguagaggacgcguccgaaucaaaacuccugacaguaaguauuauggaccuaagccagauguacagcccuguauucgaguaccuauccggagaccgacagguagaagaauggccaaaagcaacaugcaccggcgacugcccugagcgcugcggcugcacaucuucaaccugccuacauaaggaauggccacacagccgaaacuggagaugcaaccccaccuggugcuggggagugggaaccggguguaccugcugcggugucgaugucaaagaucuauuuaccgaccacauguucguaaaauggaagguggaguacauaaaaaccgaggcgauugugugcguagaacucaccucccaggaaagacagugcucccuaauugaagccgguacccgcuucaaccucggaccaguaacaauaacucucucagaacccaggaacauacaacaaaaacuaccacccgagaucauaacccuccaccccaaaauugaagaaggcuucuucgaccugaugcacguccaaaaaguguuaagcgcauccacaguaugcaaacuccagagcugcacccacgggauucccggcgaccuacaaguuuaccacaucggaaaccuacugaaaggggaccgagucaacggccaucuaauacacaaaauagaaucccacuucaacacuucguggaugucuugggacggaugcgaccucgacuacuacugcaacaugggagacuggccaagcugcaccuacacgggcgucacacaacacaaccacgccgccuucguuaaccuacugaacauagaaaccgacuacacaaaaacauuucacuuccacuccaaaagaguaaccgcccacggcgacacaccccaacucgaccucaaggcuagacccaccuacggggccggcgaaaucacaguccucgucgaagucgcagacauggaacuccacacgaagaaagucgaaauauccggacucaaauuugccucacuagcgugcacaggaugcuacgcaugcaguuccggaaucucuuguaaagucagaauacacgucgacgaacccgacgaacucaccguacacgucaaaucauccgacccagacguagucgccgcauccacuucacucauggcccgaaaacuagaguucggaacagacaguacguucaaagccuucuccgcaaugcccaaaacgucucuaugcuuuuauaucgucgaacgugaauacuguaaaucaugcucagaagacgacacccaaaagugcgucgacacaagacuugaacaaccacaauccauccucaucgagcacaaaggcacaauaaucggaaagcagaaugauaccugcaccgcaaaggccuccugcuggcuugaguccguaaaauccuucuuuuacggccuuaaaaacaugcuuggcagcgucuuugggaaccuauucaucgguauccuucuauuccucgcacccuucgugcugcucguccucuucuucauguucggauggaagauccucuucugcuucaaaugcugccgccgcacacgcggccucuucaaguaccgacaucucaaggacgacgaagaaaccggauaucgcagaaucaucgagcgacugaacagcaaaaagggcaaaaacagacuacuagacggagacagacucgcagaccgcaagauagcggaacucuucaguaccaaaacccacauagga

SEQ ID NO: 15519 - RNA, 2916 nt, Artificial Sequence
  derived and/or modified CDS sequence (opt11) from CCHFV(Iran-52, Artificial)__DQ446215.1__Gn-4aa-Gc
agugaggaguccggggacgacuguaucagccgcacccagcugcuacggaccgagacugccgagguccacggcgacaacuacggcgggcccggcgacaagaucaccaucugcaaugggucgaccgucguggaucagcgccugggcucagaacugggcugcuacaccaucaaccgggugagaucuuucaagcucugcgagaacagcgccacggggaaauccugcgagaucgacagcaucccggucaagugcaaacagggcuauugccugaaaaucacccaggagggacgggggcauguuaagcugucccgugggagcgaggugguccucgacgugugcgauuccagcugcgaggugaugauaccgaagggcaccggcgauauccuggucgacugcuccggcggccagcagcacuuccugaaggacaaccucguggaucuggggugccccaagauuccccugcucggcaaaauggccauuuacaucugccggaugagcaaccacccgaagaccacgauggccuuccuguucugguucuccuucggcuaugugaucacuuguaucuuaugcaaggccauauucuuccuccuaaucaucuucgggacccuuggcaagcgcuucaagcaguaccgcgagcucaagccccagaccugcaccaucugcgagaccaccccagucaacgccaucgacgcggagaugcacgaccugaauugcagcuacaacaucugccccuacugcgcgucccgccugaccucagaugggcucgcccggcacgucacgcaguguccgcgccggaaggagaagguggaagagaccgagcuauaccugaaccucgagcgcauccccugggucguucggaagcugcuccaggugagcgagagcaccggcacuguccugaagagaucuuccuggcugauugugcuguuagugcucuuuacggucagccugucccccgugcagagcgcccccaucgggagacgcccccucuuccucgacaguaucgugaagggaaugaagaaccugcucaacagcaccucccuggaaaccagccuguccaucgaggcccccuggggcgcaauuaacgugcagagcaccuacaagcccacgguguccaccgcgaacaucgcccucucgugguccaguguggagcaccggggcaacaaagugcuggugucgggccgcagcgagucuaucaugaagcuggaggagcggaccgguaucagcugggaccucggcgucgaggacgccuccgagagcaagcugcugaccgugucagugauggaccucucccagauguacagccccgucuucgaguaccugaguggggaccgccagguggaagaguggccgaaggccacgugcacgggagacugccccgagcgcugcggaugcaccucauccacgugccugcacaaggaauggccccacagccggaacuggcggugcaacccgacuuggugcuggggcguggggaccgggugcacgugcugcggccucgacgucaaggaccuguucaccgacuacauguucgugaaguggaaaguagaguacaucaagaccgaggcgaucgucugcguggagcugaccagucaggagcgucagugcucgcugauugaggccgggacccgcuucaaccucggcuccgugacgaucacccugagugagccgcggaacauccagcagaaacugccgcccgagaucaucacgcuccaccccaagaucgaagagggcuucuucgaccugaugcacguccagaaggugcuguccgccagcaccgugugcaagcuccaguccugcacgcacggggucccgggcgaccuccagguguaccacaucggcaaccugcugaagggcgaccgugugaacgggcaccugauccauaaaaucgagcagcacuucaacaccagcuggaugucaugggacgggugugaccuggauuacuacugcaacaugggcgauuggccaucaugcaccuauaccggcgucacccagcacaaccacgccuccuucgugaaccuccugaacaucgagaccgacuacacgaagaccuuucacuuccacagcaagcgggugaccgcccacggcgacacgccccagcuggaucucaaggcgcgccccacuuacggggcuggcgagauaaccguccugguggaggucgccgauauggagcugcauaccaagaagaucgagaucagcggccucaaguucgccgggcugacuugcacgggcugcuacgcuugcucaagcgggaucuccugcaagguccggauccacgucgaggagccugacgagcugaccgugcacgucaagagcgacgaccccgacgugguggcggcaucuagcucccucauggcccgaaaacuugaguucgguaccgacucgacauucaaggccuucuccgccaugcccaagacgagccugugcuuuuacaucgucgaacgggaguacugcaagagcugcagcaaggaggacacccaaaagugcgugaacaccaagcuggagcagccccagucuauccugaucgagcacaaggggaccaucaucggcaagcagaacaauacgugcaccgcgaaggccagcugcuggcuagaguccgucaagagcuucuucuacgggcucaagaauaugcucggcgggaucuucgggaacguguucauagggaucuucaccuuccuuacccccuucauccugcugauccuguucuuuauguucggguggcgcauacucuucugcuucaagugcugcaggcgcacgcgaggccuguucaaguaccgccaucugaaagacgacgaagagaccggauaccggaagaucaucgagcgccucaacaacaagaagggcaagaaccgucugcuggacggcgagcgccucgccgaccgcaagaucgccgagcuguucuccaccaagacccacaucggg

SEQ ID NO: 15520 - RNA, 2916 nt, Artificial Sequence
  derived and/or modified CDS sequence (opt11) from CCHFV(Iran-53, Artificial)__DQ446216.1__Gn-4aa-Gc
agcgaggaguccggcgacgacugcaucagccgcacccagcugcuacggaccgagaccgccgagguccacggggacaacuacggcggucccggcgacaagaucaccaucugcaacgggagcacugucguggaccagcgccucggcagcgaacugggcugcuacacuaucaaccgggugcgcuccuucaaacuuugugaaaauucugccacggggaaauccugugagaucgacagcauucccgucaagugcaagcagggcuacugcuuaaaaauaacccaggaagggcggggccacgugaaacuuucgcgcggaucagagguggugcucgauguaugcgacucaagcugcgagguuaugaucccuaagggcaccggugauauucuggucgauugcuccgggggccagcagcauuuccuuaaggacaaccucguggaccuagggugcccgaagaucccccuacucggaaagauggcgaucuauaucugccggaugagcaaccacccgaagacuacgauggccuuccucuucugguucuccuucggcuacgugaucacgugcauccuguguaaggccaucuucuuccuccucaucauauucgggacacuaggcaagcgcuucaagcaguaccgggagcucaagccccagaccuguaccauuugugagacuaccccggucaacgccauagaugccgagaugcacgaccugaacugcagcuauaacauaugccccuacugcgcgucccgccugaccagcgacgggcucgcccggcacguaacccagugcccccgcaggaaagagaagguugaggagaccgagcuguaccugaaccucgaaaggauccccuggguugugcgcaaguugcuccagguguccgagagcacaggcaccguccugaagaggagcuccugguugaucgugcugcucgugcuguucacggucucacucuccccaguucagagcgcacccaucgggcgacgcccacucuuccuggauuccauagugaagggaaugaagaaccugcucaauagcaccuccuuagagaccagccuguccauagaagcuccguggggagcgaucaacgugcagagcaccuacaaacccaccguguccacggccaacaucgccuugucauggagcucagucgaacaccgggggaauaaggugcuaguguccggccgcuccgagagcaucaugaagcuggaggagcggaccgggauaagcugggaccucggcguggaggacgccuccgagagcaagcuguugacugugagcgucauggaccucucccagauguacucgcccguuuucgaguaccuguccggggaccgccaaguggaggaguggccaaaggccacgugcaccggcgacugccccgagcgcugcggcuguaccagcuccacaugccugcacaaagaauggccccacagccggaacuggcgcugcaacccuaccuggugcuggggcguggguaccgggugcacgugcuguggccuugacgucaaagacuuguucaccgacuacauguucgucaaguggaagguagaguacaucaagaccgaggcaauagucugcgucgagcuuacgucucaggagcgccaaugcucacugaucgaggccgggacccgcuuuaauuuagguuccgugacaaucacgcugagcgagccgcggaacauccagcagaagcugccucccgagaucaucacgcuccaucccaagaucgaggaaggauucuucgacuuaaugcacguccagaagguccuguccgccagcaccgucugcaaacuccaguccugcacccacgggguaccuggugaccuccagguguaccacauugggaaccuucugaagggcgaccgcgugaauggccaccugauacacaagaucgagcagcacuucaacaccagcuggauguccugggacggcugcgaccuggacuauuauugcaacaugggcgacuggcccagcugcaccuauaccggggucacccagcacaaccacgccuccuuugugaaccuccugaacaucgaaaccgacuacacgaaaaccuuccacuuccacagcaagcgugugaccgcccacggcgacacgccucaauuggacuugaaagcccgccccaccuauggggccggcgaagucacagugcugguagaggucgcugacauggagcuccacacgaagaagauagagaucucuggccucaaauucgcgggucuuacgugcacuggcuguuaugccugcucuagcgggaucuccugcaagguacgcauccacguagacgagccggacgagcugaccguccacgucaagagcgaugaccccgaugugguggcggccuccagcucccucauggcccgcaagcuggaguucggcaccgacagcaccuuuaaggcuuuuuccgccaugcccaagacgagccugugcuuuuacauuguggaacgggaguacugcaaguccugcagcaaggaagacacacaaaaaugcgucaacacaaagcuagagcaaccgcaguccauccuaaucgaacauaaggggaccaucaucggcaagcagaacaauacuugcaccgcaaaggccuccugcuggcuggaguccgucaagagcuucuucuacggccucaagaauaugcucgggggcaucuucgggaauguguuuaucggcaucuucaccuuccugacccccuucauacuccugauucuguuuuucauguucggguggcgaauuuuauucugcuucaagugcugucgucgcacgcggggcuuguuuaaguaccgccaccugaaagacgacgaggagacaggcuaccguaagaucaucgagcgccucaacaacaagaagggcaaaaacagacugcuggacggcgagcgacucgcagaccgcaagaucgccgagcuauucucaaccaaaacccacauuggg

SEQ ID NO: 15521 - RNA, 2916 nt, Artificial Sequence
  derived and/or modified CDS sequence (opt11) from CCHFV(Kosova Hoti, Artificial)__EU037902.1__Gn-4aa-Gc
agcgaggaaccgggugacgacuguauaucccggacccaacuguugcggaccgagaccgccgagauucacgacgacaauuaugggggcccgggggacaagaucaccaucugcaacggcagcaccaucguggaccagcggcugggguccgaacugggaugcuacaccaucaaccgggucaagagcuucaaacucugcgagaacucugccacaggcaagaccugcgaaaucgacagcaccccggugaagugccgccaaggguucugccugaagauaacucagaagggccgcgggcaugugaaacugucccgcgggagcgaggucguucucgacgcgugcgacuccaauugcgaggugaugauccccaaaggaacaggcgacauccuggucgacuguucaggagggcagcagcacuucuugaaagacaaccucaucgaccuagggugcccgcacaucccguuacucggaaagauggccaucuauaucugucggauguccaaccaucccaagaccaccauggcauuccuguucugguucagcuuugguuacgugaucacgugcauuuucugcaaggcccuguuuuacucccucauuauaauuggaacccugggaaagaagaucaaacaauaccgcgagcugaaaccccagacgugcacuaucugcgaaaccgccccagucaacgcgauugacgcggagaugcacgaccuaaacugcagcuacaacauuugucccuacugcgccucccggcuaaccagcgauggccuggcacgccacgucaagcagugcccaaagagaaaagagaagguggaggaaaccgagcucuaccugaaucuagagcgcauacccugggugguccggaaauugcuccaggugucugagucgacaggaguggcucugaagcguucaagcuggcuuauaguccugcuggugcuccugaccgugagccuguccccugugcagucggcucccgucggccggaagccccucuuccuggacaguauuguuaagggcaugaaaaaccuacugaacucgacuucacuugagaccucccuguccauagaggcaccguggggcgccaucaacguccagagcaccuuuaagccuaccguuuccaccgcgaacaucgcacuuagcugguccagcguagaacaccgcgggaacaagauacuggucaccgggcgguccgagagcaucaugaaacuagaggaacgcaccggcauuuccugggaccuggggguagaggacgccucugaguccaaacugcugaccgucucgaucauggaccucucccagauguauucaccgguguucgaguaccugagcggcgaccgccaggucgaagaguggccuaaggcgaccugcaccggggacugcccccagcgguguggcugcaccuccucaacuugucugcacaaagaguggccccauucccggaacuggcgcugcaacccgaccuggugcuggggagucgggaccggcuguacgugcugcgggguggacguaaaggaccucuucacagaucauauguuugucaaauggaaaguggaguacaucaagacugaggccauagucugcgucgaacugacgucgcaggaacgacaguguagccucaucgaagccggcacaagguuuaaccuggggcccgugaccaucacacucagcgagccucgcaacauucagcaaaagcugcccccggaaaucaucacgcugcaccccaaaauugaggaaggcuucuucgacuugaugcacgugcagaagguucuguccgcgagcacaguuugcaagcugcaguccugcacccacggaauccccggagaccugcagguauaccacauaggaaaccugcuuaaaggggaccgcgucaauggccaccuuauccacaagaucgaaccccacuucaacaccucguggauguccugggacggcugcgaccuagacuacuauugcaauaugggcgacuggcccagcugcacauacaccggcgugacccagcauaaccacgccgccuucgugaaucuguuaaauaucgaaacugacuacaccaagaccuuccacuuccacuccaagcgcgucaccgcgcauggggacaccccucaguuagaucuaaaagccaggccgacuuacggcgccggcgagauuaccgucuuggucgagguugccgacauggaacugcacacuaagaaaguggagaucagcggacugaaguucgccucccucgccugcaccgguugcuacgccugcagcucagggaucagcuguaaggugcgcauccacgucgacgaaccggacgaacugacggugcaugugaaaagcucggaccccgacguuguggcagccgggaccucauugauggcgcguaagcuagaguucgggacggacucgaccuucaaggccuucagcgcgaugcccaaaacgucccugugcuucuauauaguggagaaggaguacugcaagagcugcuccgaggacgacaccaagaagugugucgacaccaaacuggagcagccccagaguauccucauugagcaccgcgggaccaucaucggaaaacagaacgacacaugcaccgccaaggccuccugcuggcuggagucugugaaaucauucuucuacggccucaaaaacauguugggcagcguguucgggaacuuuuucaucggcauccugcuuuuccucgcuccguucguccugcugguucuguucuuuauguucggguggaagauccuguuuugcuucaagugcugcaggcgcacgcgcggcuuguucaaguaccgccaccucaaggacgacgaagaaacgggcuaccgucgcaucaucgaaaggcuaaauaacaagaagggcaagaaccgccuccucgacggugagcggcuagccgaccgcaaaauagccgaacuguucuccacgaaaacccacaucggg

SEQ ID NO: 15522 - RNA, 2916 nt, Artificial Sequence
  derived and/or modified CDS sequence (opt11) from CCHFV(YL04057, Artificial)__FJ562094.1__Gn-4aa-Gc
gcugaaggaggaucgucagacugcaucucccgaacccagcuagugaaaaccgaaguggccgagauccacgaggacuccuacggcgggcccggggagaaaaucacgaucuguaauggcagcaccaucgucgaccaacggcucggucgcgaacuaggcuguuacacaauaaauagaguccgcucauacaaacuaugcgaaaacucugcuucuggaaaaagcugcgaaauagacuccauccccgucaagugcaaacaaggcuuuugccuuaaaaucacccaagaaggacgcggccacgucaaacucaguaggggaacagagauaguccucgaugucugcgacuccagcugcgaacucaugauacccaagggcaccggggacauccucguagacugcagcgguggccaacaacacuuccuccagaacaaucucaucgacuugggcugccccaacguaccccuccucggcaagauggcgaucuacgucugccguaugagcaaccaccccaaaacuacaauggccuuccuauucugguucucuuuuggcuaugucauaacaugcauagccugccgcguccucuuuuaccuccucaucgcuaucgguacaguaggaaagaaacucaaacaauacagagagcugaaaccccaaacgugcaucguaugcgaauccgucccagugaacgcgaucgacgccgaaaugcacgaacucaacugcagcuacaacaucugcccauacugcgcgucacgccucucgacagacggucugauccgccacguaacacagugucccaaacgacgagaaaaaguagaagaaaccgaacucuuccuaaaccuagaacgcauucccuggcucguccgaaaacuacuacaagucuccgagucgaccggaauggcgcuaaaacgauccugcuggaugauaacacugcuuauccuacuccucgucaguauaaguccgguccaguccgcccccguaggccgcaaaccacucuuccuagacagcaucgccaaaggaaagaaaucacuacuaaauagcaccucgcuagaaaccucgcuuucaaucgaggccccauggggagccauaaacguccaauccacauucaaaccaaccgucuccgccgccaacauugcacuauccugguccuccgucgagcaccgagggaacaaaauacuugucuccggaaggucugaauccaucaugaagcuggaagaacguaccggagucagcuggaaccuaggcgucgaagacgcgagcgaaucaaaaacccuaacagucucagucauggaccuaucacaaauguacucacccgucuucgaguaucucagcggcgaucgacaagucgaagaauggcccaaggcaacuugcaccggcgacugucccgaacgcugcgggugcacguccucuaccugccuucauaaggaauggccccacagccgaaauuggcggugcuccccaaccuggugcuggggagucggcaccggcugcacaugcugcggacucgacguaaaggacuucuucaccgacuacaugcucgucaaauggaaagucgaguacauaaagacggaggccaucgugugcgucgagcuaaccucccaagaacgacaaugcagcuuaauagaagccggaacaagauucaaccucggacccguaacuaucacacuauccgaaccgcgcaacguccagcagagacuacccccagaaaucguuacacuccacccaaaaaucgaagagggcuucuucgaccuuaugcacguccagaaaauacucuccgccuccaccguaugcaaacuucaauccugcacccacggaguucccggcgacuuccaagucuaccacgucggaaaccuccuuagaggggacaagguaaacggccacagcauccacaaaauagaaccccacuucaauacaucguggaugagcugggacggcugcgaccuagacuacuucugcaacaugggagacuggcccagcugcacauacacaggaguaacccaacacaaccgagccgcguucaucaacaugcuuaacaucgaaacugacuacaccaagacauuccacuuccacaguaaaagagugaccgcccacggagacacaccucaacuagaucuuaaagcccgcccggcguacggcgccggugaggucacaguccucguagaaguggcagaucucgagcuccacaccaaaaagcucgaaguauccggacuaaaaauugccucccuuacaugcucaggcugcuacgccugcucauccggaauaagcugcaaaguacgcauccacgucaacgaaccggacgaguucacaguacacgugcguucauccgacccagacgucguggcggccggcaguucccugauggccagaaaaauagaauuuggcgccgacucgacuuucaaagccuucagcuccaugccaaaagacucccuaugcuucuacauaguagaaaaggacuauugcuccuccugcaccgacgacgacacucaaaagugcgucaacacuaagcucgaccacccacaaucaauacuuaucgaacacaagggcacuaucaucggcaaacaaaacgacacaugcucaaccaaaaccuccugcuggcucgaauccgucaaaggguucuucuacggccuuaaaaacaugcuaagcggcaucuucggcaacgucuuccuaggcauacuccucuuccucgcccccuucguccuccucaucuucuucuuuuucuucggcuggcgccugcuuuucugccuaaaaugcugccgccgcacacgaggacuacucaaauacaagcacuuaaaggacgaagaagaagcuggcuauaaaaagauaauagaaagacuaaacgggaaaaagggcaagucgcaacucuuugauggcgaaagacuugccgaccgaaaaauagccgaacuguucucaacuaaaauacacauagga

SEQ ID NO: 15523 - RNA, 2916 nt, Artificial Sequence
  derived and/or modified CDS sequence (opt11) from CCHFV(V42/81, Artificial)__GU477490.1__Gn-4aa-Gc
ucgaaagagcccggagacgacuguaucagccgcacccaacuaaugcgcacagaaaccgcugaaauccacgacgacaacuauggagguccaggagacaaaauaacaaucugcaacggauccacaaucguggaccagcgacuuggcuccgaacuaggcugcuacaccaucaaccgcgucaaauccuucaaacugugcgaaaacuccgcaaccgguaaagcgugcgaaguugacagcacacccguaaaaugcaggcagggcuucugccucaaaaucacacaagaagggcgcggacacgucaaacucucaagaggcagcgaagucguacuugacgccugcgacucuuccugcgaagucaugauuccaaaaggaacaggagacauucugguagacugcucagggggccaacaacacuucuuaaaagacaaccuaauagaccuagaguguccgcacauaccguuacuaggcaaacucgcgaucuacauuugcagaaugagcaaucacccucgcacaaccauggccuuccucuucugguucggcuuuggauacgucaucacaugcauacucugcaaagcauuauuuuauucccucaucauaauaggaacgcucggcaaaaagaucaaacaauacagagagcucaaaccucagacuugcacaaucugcgaaacagcccccguaaacgccauagacgcggagaugcacgaccuaaacugcagcuacaauaucugcccuuacugcgccucgagacucaccucagacggccuagcgcgucacgucacgcaaugucccaaaagaaaagagaaagucgaagagaccgagcuauaccuaaaccucgagagaauacccuggaucguccgaaagcuccuacaagucucugaaucaaccggcguaguccucaagagauccucauggcugauaguccucuuagugcuccucacagugagccucucccccguccaaucagcuccggucggaagaaaaccacuguuccucgauagcauagucaaaggaaagaaaaaccuccuaaacuccacaucccuagagaccucccugagcauagaggcaccauggggagccauaaauauccaauccaccuucaaaccaaccgugucagcagcuaauaucgcccuaucaugguccuccguggaacaccgcggaaacaaaauccucgucuccggucgaagcgaaagcaucaugaagcuagaagaaaggacgggcguauccuggaaccuagguguggaagacgcaagcgaaucgaagcugcucaccguaaguauaauggaccucucacagauguacucacccgucuucgaauaccugucuggcgaccgacaggucgaagaauggccaaaagcaacguguaccggagacugccccgagcgcuguggcugcaccuccaguaccugccuccacaaagaauggccccacuccagaaacuggcgaugcaacccaaccuggugcuggggcgucggaaccggcugcacaugcugcggcguugacgucaaggaccuguucaucgaccacauguucgucaaauggaaaguggaauacauuaaaaccgaagcuaucgucugcgucgaacuaacaucacaagaacgacaaugcucacucauagaggccggcacccgcuucaaccugggcccagucacgauaacccucuccgaacccagaaacauccaacaaaaacuacccccagaaaucauaacccuccacccaaaaauagaagaaggcuucuucgaccuaaugcacguccaaaagguacucucggccucaaccgucugcaaacuacaauccugcacgcacggcauucccggagaccuacaaguuuaccacauaggaaaccuccucaaaggagacagagucaaugggcaucuaauccacaaaaucgagccccauuucaacacaagcuggaugucaugggacggcugcgaccuugacuacuacugcaacaugggcgacuggccaagcugcaccuacacuggagucacucaacacaaccacgccgccuucguaaaccuacucaauaucgaaaccgacuacacaaaaacauuccacuuccacuccaaaaggguaaccgcacacggcgaaacaccccaacucgaccugaaggcucgcccagcauauggcgcaggcgaaaucaccgugcucguagaaguagccgacauggaguuacacacgaagaaaguggaaaucucgggucugaaauucgcaucacuagccugcacaggcugcuacgcauguucuaguggcaucucaugcaaaguacgcauccacgucgaugaaccagacgaacuaaccguucacgucaaguccaacgacccagacgucguggccgcaucgaccucccugauggccaggaagcuggaauccggcacagacucuaccuucaaagccuucagcgccaugcccaaaaccucccucugcuucuacauaguugaacgagaauacugcaaauccugcucugaagaugacacccaaaaaugcgucgaaaccaaacuggagcaaccccagucuauccuaauagaacacaaaggaacuauaaucgggaagcagaacgauaccugcaccgccaaagcaucgugcuggcuugaaagcgucaagucauuuuucuacggacucaagaacaugcucggaucaguauucggcaacuucuucaucggcauacucuuguuccuggcacccuucguccuacucguccuauuuuucauguucggauggaaaauacuauucugcuucaaaugcugccgccgcacccgcggacucuucaaauaccgccaccuaaaagaggacgaagaaaccggcuaccgacgcaucaucgaaagacucaacuccaagaaaggcaaaaaccggcuacucgacggcgaacgacuagccgaccggaaaaucgcagaacucuucucaaccaaaacccauaucgga

SEQ ID NO: 15524 - RNA, 2916 nt, Artificial Sequence
  derived and/or modified CDS sequence (opt11) from CCHFV(79121M18, Artificial)__GU477493.1__Gn-4aa-Gc
gccgagggcggcucaagugacuguaucucccgaacccaacucgugaaaaccgaagucgcagagauacacgaagacucguacggcggccccggcgagaaaaucacgaucugcaauggcucaacuaucguagaucaaggccugggauccgaacucgguuguuacaccaucaaccgagugcgauccuacaaacucugcgaaaacucugccagcggcaaaucgugugaaauugauagcauuccggucaaaugcaaacagggcuuuugccuaaaaauaacccaagaaggacgaggccacguaaaacucagccguggcacagaaauaguccuugauguaugcgacagcuccugcgaguuaaugauccccaaagguacaggcgauauccucgucgacugcuccggcggccaacaacacuuccuacaaaacaaccugaucgaucuagggugcccgaacgucccacuucuggguaaaauggccaucuacgucugccgcaugagcaaucacccaaaaaccacaauggcguuccuauucugguucuccuucggguacgucauaacgugcauagccugccgcguacuguuuuaccuccuaaucgcaaucggcacaguaggaaagaaacucaaacaauaccgcgaacucaaaccccaaacuugcaucgugugcgaaagcguccccgugaacgcaaucgacgcugaaaugcacgaacucaacuguagcuacaacauauguccuuauugcgccucucgauugucuaccgacggccucauccgccacguaacacaguguccaaaacgccgagaaaagguagaggaaacagaacucuuucuaaaccucgagagaaucccauggcuaguccgaaaacuacuucaagucagcgaauccacagggauggcccucaaacgcuccugcuggaugauaacccuacuaauucuccuacucgucuccauaagccccguccaaagugcacccgucggccgcaaaccacuauuccuagacuccacagcuaaaggaaugaaaucgcuccucaauucuacaucacuagagacaucgcucucgaucgaagcgccauggggagccaucaacguacaauccacuuucaaacccaccguguccgcggcuaacaucgcccucucauggucguccguagaacaccgggggaacaagauccucguaucuggccgcucagaaucaaucaugaagcuggaagaacgcaccggagucuccuggaaccuuggagucgaagacgcuagugaaagcaagacacugacaguaagcgucauggaccucagucagauguacucucccgucuucgaguaccucucaggcgaucgacaagucgaagaauggccuaaagcgaccugcaccggcgacugccccgaacgauguggcugcaccucaagcacgugccuacauaaagaauggccccacagucgcaacuggcgaugcaacccuacuugguguuggggcgucggaacaggcuguaccugcugcgggcucgacgucaaagacuucuuuaccgacuacaugcuagucaaauggaaaguugaauacauaaagacugaagcaaucguaugcguagaacuaaccagccaagaaagacaaugcucauuaaucgaagcaggaacccgauuuaaccucggcccaguaacgauuacccuauccgaaccccggaacguucaacaacgcuuaccgccugaaauagugacacuucaccccaaaaucgaagaggguuucuucgaccucaugcacguccagaaaauucucagcgcuuccaccgucugcaaacuucaaucgugcacccacggcguacccggagacuuccaaaucuaucacguaggcaaccuccuucgcggagauaaagucaauggccacuccauucauaaaaucgagccccacuucaacacuucauggauguccugggauggaugcgaccucgacuacuucugcaacaugggcgacuggcccagcugcacguacacgggcguuacacaacacaaccgcgccgccuucaucaacaugcuuaacaucgaaaccgacuacaccaagacauuccacuuccacaguaaacggguaacggcccauggcgacaccccucaacucgaucuaaaagcacgccccgccuacggagccggcgaaguaaccgugcuggucgagguagccgaucucgaacugcacaccaagaaauuggaggucucgggacucaagaucgcaucauuaacaugcucuggaugcuacgcuugcucaagcggcaucucgugcaaagugcggauccacguuaacgaaccugacgaguucacgguucacguacgcagcucagaccccgacgucgucgccgccggaagcucacuuauggcgcgaaaaauagaguucggcgccgauucgaccuucaaagccuucagcagcaugccaaaagacucacucuguuuuuacauugucgaaaaagacuauugcagcucaugcacagacgacgacacacagaaaugcgucaacacaaaacucgaccauccacaaucaauccucaucgaacacaaaggcacuaucauaggcaaacagaacgauaccugcuccaccaaaacuuccugcuggcuagaauccgucaaaggauucuucuacggccucaaaaacaugcucucaggaaucuucggcaacgucuuccuuggcauuuuccuauuccucgcacccuucguacuccucaucuucuucuucuucuucggcuggcggcuccucuuuugccuuaaaugcugccgaagaacccgagggcucuugaaauauaagcaccucaaagacgaagaagaagcgggcuacaagaaaaucaucgaacgccugaacggcaagaaaggaaaaucccagcuauucgacggcgaacggcucgcggauaggaaaauagcagaacuguuuuccacuaaaauccacauaggu

SEQ ID NO: 15525 - RNA, 2916 nt, Artificial Sequence
  derived and/or modified CDS sequence (opt11) from CCHFV(Afg09-2990, Artificial)__HM452306.1__Gn-4aa-Gc
ucggaagaaagcggugacgacugcaucucucgaacacaacuacuacggaccgaaaccgccgagguccauggagacaacuacggcggccccggagacaaaauaacgaucugcaacggcucaaccgucgucgaccaacguuuagguucggagcucgguuguuauacaaucaaccgcguaagaucguucaaacucugcgaaaacagcgcaaccggcaaaucuugugaaauagacuccauaccagucaaaugcaaacaaggcuauugccucaaaaucacccaagaaggacgcggacaugucaagcuaagccgaggcagcgaagucgugcucgacguuugugacagcagcugugaaguaaugauccccaaaggcacaggcgacauccugguggacugcuccggaggacaacagcacuaccucaaggacaaccucguggaccugggaugcccaaaaaucccgcuacugggcaaaauggcgaucuacaucugccgcaugucaaaccaccccaaaacaaccauggccuuccuguucugguucuccuucggcuaugucauuaccugcauccucugcaaagccaucuucuuccugcucaucauuuucggcacccuaggaaaacgcuucaaacaguacagagaacucaaaccccagaccugcaccaucugcgaaaccacccccgucaaugccaucgacgccgaaaugcacgaccuaaacugcuccuacaacaucugccccuacugcgcauccagacuaacuagcgacggccucgcccgucacgucacgcaauguccuaggcggaaagaaaaaguagaggaaaccgagcucuaccuaaaccuagaacguaucccauggguaguacggaaacugcuccaggucagcgagagcacuggaaccguccuaaagcguuccuccuggcuuauuguccuccucguucucuucacagugucucucagcccugugcaauccgccccaauuggucgccgcccucucuuccuagacagcaucguuaaaggaaugaaaaaccuacucaacagcacaagccuagaaaccagccuuucgaucgaggcucccuggggcgcaauaaacguucaaucaaccuacaaacccacagucuccacagcgaacauagcccucucauggagcucagucgaacacagaggcaacaagguccucgugagcggccgcagcgaaaguauuaugaaacuagaggaacgaaccgguaucagcugggaccucggggucgaggacgccucagaaucgaaacuauuaaccgucagcguaauggaccucucccaaauguauucaccagucuuugaauaccucagcggugaccgccaagucgaagaauggccgaaagcuaccugcacaggugauugcccugaacgcugcggaugcaccuccucaaccugccuacacaaagaauggccacacucacguaacuggcgcugcaaccccacaugguguuggggagugggcaccggcuguacgugcugcgggcuugacgucaaagaccuauucacagacuacauguucgucaaauggaaaguagaguacaucaaaacagaagccauaguaugcguggaacuaaccagccaagaacgccaaugcucucuuaucgaggcaggaacccgcuucaaucuagguucaguuaccauaacccucagcgagccacgaaauauccaacaaaaacuuccgccagaaauaauaacgcuacaccccaaaauagaggaaggcuucuucgaccuuaugcacguccagaagguccucucagcaucgaccgucugcaaacuucaaucauguacccacggagucccaggagaccuccagguauaccacauuggaaaccuauugaaaggggaccgaguaaacggacaccucauacacaaaauugaacaacacuuuaacaccuccuggaugucaugggacgggugcgaccuagacuacuacuguaacaugggagacuggcccuccugcacguacaccggggucacccaacacaaccaugccuccuucguuaaccuccucaacaucgagaccgacuauaccaaaaccuuccacuuccacagcaaacggguaacugcccacggugauacgccccaacucgaccuaaaagcccgacccaccuacggcgccggcgaaaucacaguccucgucgaaguagccgacauggaacuccacacaaagaaaaucgaaaucaguggacugaaguucgccggacucacaugcaccgguugcuacgcauguucgaguggcauuaguuguaaagugcgaauccaugucgacgaacccgacgaacucaccguacacgucaaauccgacgaccccgacguaguagccgcaagcagcucgcugauggcacguaaacucgaguucggaaccgauagcaccuucaaagccuucucagcgaugcccaagacuucacucugcuucuauauaguagaacgggaauacugcaaaucgugcagcaaagaagacacccaaaagugcgucaacaccaaacuagaacaaccacaauccauccuaauugaacacaaaggcaccaucaucggaaaacagaacaacacaugcaccgccaaggcauccugcuggcucgaaucaguaaaauccuucuuuuacggccucaaaaacaugcucggaggaaucuucggaaauguguucaucggcaucuucaccuuucuuacacccuucauccuacucauacucuucuucauguucggcuggcgcauacuauucugcuucaaaugcugccgccgaacccgcggccuauucaaauaccgacaccucaaagacgacgaagaaaccggcuauagaaagaucaucgagcgcuuaaacaacaaaaagggaaagaauagacuacuagacggcgaacgacuagccgaccgaaaaauagcagaacuuuucagcacaaagacacacaucgga

SEQ ID NO: 15526 - RNA, 2916 nt, Artificial Sequence
  derived and/or modified CDS sequence (opt11) from CCHFV(Sudan Al-Fulah 3-2008, Artificial)__HQ378184.1__Gn-4aa-Gc
uccgaagaacccucggaugauugcauaagucgcacacagcuccugagaaccgaaacagcugaaauccacggggacaacuacgggggcccgggcgauaaaaucacgauaugcaacggcagcaccauugucgaccaaagacucgguuccgaacucggcugcuacacaaucaaccgggucaaaucuuucaaacuuugcgaaaacuccgcaaccggaaaguccugcguaauugacuccguaccuguaaaaugccgccaaggcuacugccucagaauuacgcaagagggacguggacacgucaaacuaucacgcggcuccgaagucguucuagacgcgugcgacaccagcugcgaaaucaugauccccaaaggaacaggcgacauccucgucgacugcagcggcggccaacaacauuuccuaaaagacaaccucgucgaccuaggcugcccgaaaauaccacuccucggcaaaauggccaucuauauaugucgcaugagcaaccacccaaaaacgacaauggcauuccucuucugguucuccuucggcuacguaaucacaugcauccucuguaaagccaucuuuuaccugcuaauaaucaucgggacccucggcaaaagauuccgccaauaccgugaacuaaaaccccaaaccugcacaaucugcgaaacaacuccgguaaacgccauagaugcagaaaugcacgaccucaacuguaguuacaacaucugcccuuacugcgcaucacgucugaccucugacggacuagcgcgccacgucacacagugcccaaagcggaaagaaaaagucgaagaaacagaacuguaccucaaccucgaacggaucccauggguaguccguaaacuacuacaagugucagaaucuaccggugucgcccuaaaacgcagcuccuggcuaauaguccuccuaguacucuucaccgucucccuguccccuguccaauccgccccaaucggacgacgcccccuguuccucgacagcaucgugaagggaaugaagaaccuccucaacucgaccucguuggaaaccagccucuccauagaagcacccuggggugcuaucaacgugcaauccaccuauaaacccaccgucuccacagcaaacaucgcgcuaagcuggucuucagucgaacaccggggaaacaaaauccuagugucuggccgcuccgaaucaaucaugaaacuggaggaacgaaccggcauuucgugggaccucggaguagaagacgcauccgaaucaaaacuacucacagucuccguaauggaccucucacaaauguacagucccgucuucgaguaccuuagcggagacagacaaguagaagaguggccaaaagcaacaugcacaggugacugcccagagcgcugcgguuguaccuccagcacaugccuccacaaggaauggccccacucccgcaacuggcgcugcaaucccaccuggugcuggggugucggaacaggcuguaccugcugcggccucgacgucaaagaccuauucacagacuacauguuugucaaguggaaaguggaauacauuaaaaccgaagcgaucguaugcguugaacucaccucacaagagcgucaaugcucccuuaucgaggcgggcacgcgauucaaccugggacccguuaccauaacccuguccgaaccccguaacauccaacaaaagcugcccccagaaaucaucacccuccacccccgcaucgaagaaggcuucuucgaccucaugcauguacaaaaaguacuaucagccucuacggucugcaaacuacaaucuugcacccacggaguaccaggcgaccuacaaguauaccacauaggcaaccuccucaagggcgacaaagucaauggacaucucauccauaagauagagccccacuucaacaccucguggauguccugggacggaugcgaccuagauuacuacugcaacaugggagacuggccaagcugcaccuacacgggagucacccagcacaaccaugccagcuucgucaaucuacugaacaucgaaacagauuacacgaaaaauuuccacuuucacagcaaacgcguaacagcccacggagacacaccccaacuagaccuaaaagcaaggccaaccuacggcgcaggagaaaucaccguccuaguagaagucgcggacauggaacuccacacaaagaaaaucgagaucucaggccucaaauucgccucccuaacgugcacaggcugcuacgccugcagcucggguaucucaugcaaaguccggauccacgucgaugaaccagacgagcuaacgguccacguaaaaagcgaugaucccgacgucguugcagccucaagcucccuaauggcgaggaaacucgaguucggcaccgacucgaccuucaaagcguucucagcaaugcccaaaaccucccucugcuucuacauagucgaaaaagaauacugcaagagcugcagcgaagaggacacuaagaaaugcgucaacaccaaacucgagcagccucaaagcauucuaauagagcacaaaggcacuaucauuggcaaacaaaacucaaccugcacugcaaaagucaguugcuggcucgaaagcgccaaaucauucuucuacggccugaaggacaugcucuccggcaucuucggcaacgucuucaucggcaucuuucucuuccuagcccccuucguccuacuuguucuguucuuuauguucggauggcgcauacuccugugcuuccguugcugccggcggacccgaggccucuuuaaauaccgucaccuaaaagacgacgaagaaaccggauaccgccgcaucaucgaacgccucaacaacaagaagggcaaaaacaaacuccuggacggagaacgccuggcugaccgaaaaauagccgaacucuucuccacuaaaacgcacauaggc

SEQ ID NO: 15527 - RNA, 2916 nt, Artificial Sequence
  derived and/or modified CDS sequence (opt11) from CCHFV(Sudan AB1-2009, Artificial)__HQ378187.1__Gn-4aa-Gc
uccgaagaaccaucagaugauugcaucagcagaacucagcuccuaagaacugaaaccgccgaaauccacggcgacaacuacggcggccccggggacaaaaucaccaucugcaacggauccacgaucguggaccagaggcugggcagugagcucggcugcuacacuauaaaccgcgucaaguccuucaaacucugcgaaaacagcgcaacagggaaaaacugcgaaaucgacuccguacccguaaaaugccgccaagguuacugcuuacggauaacacaagaaggccgcggccacguaaaacugucacgcggcuccgaagucguccuagaugccugcgacaccucaugcgaaaucaugaucccaaaaggaacaggagacauucucguggacugcucuggaggccagcaacacuuccuaaaagacaaccugauugaccucggaugucccaaaaucccccucuuaggcaaaauggccauauacaucugccgcaugaguaaccaccccaagaccacgauggccuuccuauucugguucucguucggcuaccucauaacaugcauacuaugcaaggcuauuuucuaccuccugaucaucaucgggacacucggcaagcgucugaaacaauaucgcgaacuaaagccccaaaccugcaccauaugcgaaaccacuccggugaacgccaucgacgcagaaaugcacgaccucaacugcagcuacaauauaugccccuauugcgccagccgccucacuagcgacggccucgcacggcacguaauucagugcccgaagcgcaaagaaaaaguggaagagacggaacucuaccuaaaccucgagcgcauacccugggucguucgaaagcuccuucaagugagcgagucaacaggggucgcacuuaaaagguccuccuggcuaaucguccuauuaguccucuucaccguaucccuaagccccguacaaucggcccccaucgggaggaaaccccuguuucuagacuccaucgccaaaggaaugaaaaaucuccucaauucgacaucccuugagacgucccuauccaucgaagccccuuggggagccauaaacguccaaucgaccuacaaaccuacaguauccacggcaaacauagcccuuucaugguccuccguagaacaccguggcaauaaaauccuggugucgggacguuccgaaucuauaaugaaguuagaagaacgaaccggaauuagcugggaucugggcguggaagacgcaagcgaaucuaaguuacugaccgucuccgucauggaccuuagccaaauguacucccccguguucgaauaccucucaggugaccgccaagucgaagaauggcccaaagcgacaugcacaggcgacuguccagagcgcuguggcugcacaagcaguaccugccuccacaaagaauggccacacucgcggaacuggcgcugcaacccaacauggugcuggggcgucggcaccggauguaccugcugcggucuagaugucaaagaccucuucacagacuacauguucgugaaauggaagguggaguacaucaaaaccgaagccauaguaugcguagaacucacaucacaagagcgacagugcucccuaauagaagcgggaacgcgcuucaaccuaggccccguaaccaucacccucuccgaaccacgaaacauccaacaaaaacugccacccgaaaucauaacacuccaucccagaauagaagaaggcuucuucgacuuaaugcacguacaaaagguccucuccgcuucaaccgucugcaagcuacaauccugcacgcacgguguacccggcgaccuccaagucuaccacaucggcaaccuccucaaaggagacaaggucaauggacaccucauccacaagaucgaaccccacuucaacacgagcuggauguccugggaugguugcgaucucgauuacuacuguaacaugggcgacuggcccagcugcaccuacaccggagucacacaacacaaucacgccucuuucgucaaccuacucaacaucgaaacggacuacaccaaaaacuuucacuuccacucgaaacgcgucacagcacauggcgacacgccccaacucgaccuuaaggcgaggccgaccuacggagccggagaaaucaccguccuagucgaggucgcagacauggaacuccacacgaagaaaaucgaaaucucuggccucaaauucgcuucccugaccugcacaggcugcuaugcaugcucaagcggcaucuccugcaaaguacgcauacacguggaugaacccgacgaacucacgguccacgucaaauccgacgacccagauguagucgccgccucguccucacuuauggcaagaaaacuugaguucggcacggacucaacguucaaagccuucagugccaugcccaaaaccagcuuaugcuucuacauaguagaacgcgaacauugcaaaucaugcaaugaagaagacaccaaaaagugcgucaacacaaaacuagaacaaccccaauccauccuaaucgaacacaaaggcaccauaaucggcaagcaaaauuccacauguacagcccgagcaucaugcuggcucgaaucggucaaaucauucuucuacgggcuuaaaaacaugcucucgggcauauucggaaacguauucaugggcauauuccucuuccuagcccccuucauccugcucauccuauucuucauguucggguggcgcaucuuauucugcuucaaauguugccggcgaacucgcggacucuucaaguaccgccaccugaaagacgaugaggagaccggauaccgccgcaucaucgaacgacugaauaacaagaaaggcaaaaauaaacuacucgacggcgaaaggcucgcagaccggcgcaucgccgaacuauucuccacuaaaacacacaucggc

SEQ ID NO: 15528 - RNA, 2916 nt, Artificial Sequence
  derived and/or modified CDS sequence (opt11) from CCHFV(NIVA 118595, Artificial)__JN572083.1__Gn-4aa-Gc
ucggaagaauccggcgacgacugcaucucccgcacccaacuccuccgaaccgagacagccgagguccacggagacaauuacggaggacccggcgacaaaauaaccaucugcaacggcucaacugucgucgaccaacgccuaggaucagaacucgggugcuacaccauaaaucgggucaaaucauucaaacucugcgaaaacuccgccacuggaaaauccugcgagauugacucgauccccguaaaaugccgccagggguacugccucaaaaucacucaggaaggcaggggacacgucaaacuuaguagaggcagcgaaguagugcucgacgcaugcgacuccagcugcgaggucaugauacccaaaggaaccggcgacaucuuagucgacugcucaggcggacaacaacacuuccucaaagacaaccuaaucgaccucggcugcccgaaaaucccccuucucgguaaaauggccauauacauaugcaggaugucaaaccacccuaaaaccacaauggccuuccuauucugguucucauucggcuacgucauuaccugcauccucugcaaagugaucuucuaccuccuaauaauauuuggaacacucggaaaacgcuuuaagcaauaccgcgaacucaaaccgcaaaccugcacaaucugcgaaacaacaccgguaaacgccaucgacgcggaaaugcacgaccuaaacuguagcuacaauauaugccccuacugcgccucccgccuaacuagcgacggccuagcccgccacgucacccaaugcccaaagcgcaaagaaaaagucgaagaaaccgaacuuuaccucaaccucgaacgaauccccuggguaguacgcaaacuucuccaagucagcgaaagcacaggaauagcacucaaacgcuccucauggcuaauaguacugcugguacucuucaccgugucuaucacccccguacaauccgccccaauaggacgccguccccuauuccucgauuccauagucaagggaaugaagaaccuacuaaauucuacgucccucgaaacaucgcuaaguaucgaggcucccuggggugccauuaacguccagucaaccuacaaaccuacaguaucugcagccaauauagcccucuccuggucguccgucgaacaccgcggaaacaaaauacuggucagcggacgaagcgaguccaucaugaaacuugaagaacgcaccggcaucagcugggaccucggcguggaagacgcgagcgaaagcaaacuccuuacagucucagugauggaccucagccaaauguacucaccugucuucgaguaucucaguggagaccgacagguggaggaauggccuaaagcaacaugcacaggagacuguccggaacggugcggcugcacaagcuccacgugccuccacaaagaauggccgcacucacgcaauuggcgcugcaaccccaccugguguugggguguagggaccgguugcacaugcugcggccuagaugucaaagaccuauucacagacuacauguucgugaaauggaaagucgaguacauaaaaacugaggcuauagugugcguugaauugaccucccaggagagacaaugcagccuaauagaagcaggcacgcgauucaaccucggcuccguaaccauaacacuaagcgaaccccgcaacauccaacaaaaacucccacccgaaaucauaacccuccacccccgcauagaggagggcuucuucgaccuuaugcauguccagaaaguccucucggcguccaccguaugcaaacuacagaguugcacccacgggguucccggggaucuucaaguauaccacaucggaaacuugcuuaaaggugaccgagucaacggccaucuaauccacaagauagagcaacaccucaacacauccuggauguccugggacggcugcgaucucgacuauuacugcaacaugggcgacuggccuuccugcacauacaccggcguaacucagcacaaccacgccagcuucgucaaccuacucaauaucgagacagacuacaccaagacguuccauuuccauagcaaacgcgucacagcacacggagacacaccccagcuagaccuuaaagcccgacccaccuacggugccggugaaaucaccguccuaguagaaguagcagacauggaacuccacacaaagaaaaucgaaaucuccggccuaaaauucgccucccuauccugcacgggaugcuacgccuguucaucaggcauauccugcaaaguccgaauacaugucgacgagccagacgaguuaaccguccacgucaaaucagacgacccagauguaguugcugccagcagcucacugauggcacgcaaacucgaaagcggaaccgacagcacauucaaagccuucagcgccaugccgaaaaccuccuuaugcuucuacauugucgaacgggaauacuguaagggcugcuccaaagaggacacccaaaaaugcgugaauaccaagcuagaacagccucaaagcauccuuaucgaacacaaaggaaccaucauaggaaagcaaaacaauaccugcaccgcuaaggcuucaugcugguuagaauccgucaaaucguucuucuacggacucaagaacaugcuguccggcaucuucgggaacgucuuccuagggauauuuuccuuucucgccccauuuguacugcucauucucuucuuuauguuuggcuggcgaauacuauucugcuuuaaauguugccgacgaacacgugggcuguucaaauaccgacaccuaaaagaugacgaagaaaccggcuaccgaaaaauaaucgagcgccucaacaauaagaaaggcaaaaacaaacuacuggacggcgaacgacucgcggacagaaaaauugccgagcucuuuucgacaaaaacccacaucggc

SEQ ID NO: 15529 - RNA, 2916 nt, Artificial Sequence
  derived and/or modified CDS sequence (opt11) from CCHFV(NIV 112143, Artificial)__JN572085.1__Gn-4aa-Gc
ucugaggaguccggagacgacugcauuagccgcacccagcugcugcggacagagacggccgaggugcacggcgacaacuauggcgggcccggagacaaaauaacaauuugcaacggguccaccgucgucgaccagagacucggcagcgaguugggcugcuacaccauaaaccgggugaaguccuucaaacuuugcgagaacagcgccacggggaaaucgugcgaaaucgacucgaucccggucaagugccgccaggguuacugccugaaaaucacccaggaggggcggggccacgugaaacugucucgcgggagcgaggugguacucgacgcgugcgacuccagcugcgagguaaugauccccaagggcaccggcgacauauugguggacugcuccgggggccagcaacacuuccucaaggacaaccucaucgaccuggggugccccaagauuccacugcucggcaagauggcaauauacaucuguaggaugagcaaccacccgaagacaaccauggccuuccuguucugguucucguucggcuacgucaucacgugcauacuguguaagguaaucuucuacuuacugaucaucuucgggacccugggaaagcgguucaagcaguaccgggagcugaagccccagaccugcaccaucugugagaccaccccagugaacgccauagacgccgagaugcacgaccugaacuguucuuacaacaucugccccuauugcgccagucgccugaccuccgacgggcuugcccggcacgucacgcaguguccgaaacgcaaggagaaggucgaggagaccgaacuguaccugaaccucgagcguauccccugggugguccgcaagcugcuucaagucuccgagagcaccggcaucgcccucaagcggucgucauggcugaucgucuuacuuguccuauucaccguaagcaucacgccggugcaguccgcccccaucgggcgccggccgcuguucuuggacagcaucgucaagggcaugaagaaccuuuugaacagcacgagccucgagaccucccugagcauugaggcgcccuggggugccaucaauguacagucuaccuacaagcccacggugagcgccgccaacaucgcccuguccuggucuuccgucgagcaccgcgggaacaagauccucgugagcggccgguccgagagcaucaugaagcuggaggagcggaccgggaucuccugggaccugggcgucgaggacgcaagugaguccaagcuacugaccguguccgugauggaccugagccaaauguacucccccgucuucgaguaccuaagcggggaccggcagguugaggaguggccuaaggcgacaugcacgggugacugccccgagcggugcggcugcacauccaguacgugccugcacaaggaguggccccacuccagaaacuggcgauguaacccaaccuggugcuggggcguggggaccgggugcacgugcugcggccuggacgucaaggaucucuucaccgacuacauguucgugaaauggaagguggaguacaucaagaccgaggccaucgucuguguggaacugaccagccaagaacgccagugcuccuuaaucgaggcggggacgcgguucaaccugggcagcguuaccauuacccucuccgagccgcgcaacauccagcagaaguugccgcccgagaucaucacccugcacccccggaucgaagagggcuucuucgaccucaugcacguccagaagguacugagcgcauccacggugugcaagcugcagagcugcacccacggaguccccggcgaccuccaggucuaccacaucgggaaccugcugaaaggcgaccgggugaacggccaccucauccacaagaucgaacagcaccugaauacguccuggaugaguugggacgggugcgaccuggauuauuacugcaacaugggcgacuggcccuccugcaccuauacaggggucacccaacacaaccacgcuucauucgugaaccuccugaacaucgagaccgacuacaccaagacguuccacuuccauuccaaacgggucaccgcucacggcgacacgccccagcuggaccucaaggcgcgaccuaccuacggggccggcgagaucaccguucugguagagguggcagauauggagcuacacaccaagaaaaucgagaucaguggccucaaguucgcaucacuuuccugcaccgggugcuacgccugcaguucgggaaucagcuguaagguccggauccauguggacgagccggacgaacugacgguucacgucaagucugacgaccccgacguaguggccgccagcuccucccucauggcccgcaagcuggaguucgggaccgacuccacauucaaggcguucagcgccaugcccaagacgagucuguguuucuacaucguggagcgggaguacugcaaggggugcagcaaggaggauacacagaaaugcgugaacaccaagcucgagcagccgcaguccauccugaucgagcacaaagggaccaucaucgggaagcagaacaacacgugcaccgccaaagccagcugcuggcuggaauccguaaagagcuucuuuuacggccuuaagaacaugcucuccgggaucuucggcaacguguuccuggggaucuucucuuuccucgcacccuuuguccugcucauccucuucuuuauguuuggcuggcguauccuguucugcuucaagugcugccggcgcaccagggggcucuuuaaguaccgccaucuaaaggacgaugaggagacaggguaccggaaaauuaucgagcgccugaacaacaaaaaggguaagaacaaacugcucgacggagagcggcuggccgaccgaaagaucgccgaguuguucuccacuaagacccacauagga

SEQ ID NO: 15530 - RNA, 2916 nt, Artificial Sequence
  derived and/or modified CDS sequence (opt11) from CCHFV(SCT ex Afghanistan, Artificial)__KC344856.1__Gn-4aa-Gc
agcgaggaguccggcgacgacugcauuagccgaacccagcuccuacggaccgagacggccgaggugcacaacgacaacuacggcggcccgggggacaagaucaccaucugcaacggcuccaccaucgucgaccagcgccuggggagcgagcuuggaugcuacaccaucaaccgggucaaguccuucaaacugugugagaacagcgcgacgggcaaguccugcaagaucgacagcacacccgucaagugucgccagggguucugccugaagaucacccaggagggccgggggcacgucaaauugucccggggcagcgagguggugcucgacgcgugcgacuccuccugcgagaucaugauccccaaggggaccggugacaucuuaguugacugcuccggcgggcagcagcacuuccugaaggacaaccucauugaccugggcugccccaacaucccccugcucgggaagauggccaucuacaucugcagaaugagcaaucacccgaagacgaccauggccuuccuguucugguucuccuuuggcuacguuaucacguguaucuucuguaaggugaucuucuaccugcucaucgucgugggcacccuagguaagaaguucaagcaauaccgcgagcugaagccucagaccugcaccaucugcgagaccacccccacgaacgccauagacgcagagaugcacgaccucaacugcagcuacaacaucugccccuacugugcguccagacuaacaagcgacggucuggcccgccacgugacccaaugccccaagcggaaggaaaaagucgaagagaccgagcucuaccugaaccuggagcgaaucccguggaucgugcggaagcuccuccaagugagugagagcacggguguagcccucaagcggagcuccuggcucaucgugcugcuagugcuccugaccgucucgcugucccccgugcagagcgccccaaucggacggaagccccucuuccugaacuccaucgugaaggggaugaagaaccugcucaacagcaccaaccuggagaccucccugucgaucgaggcccccuggggcgccaucaauguccagucaacguucaaacccaccguguccaccgccaacaucgccuuguccuggucguccgucgagcaccgcggcaacaaaauccuggucuccgggcgguccgagagcaucaugaagcucgaggagaggaccggcaucuccugggaccucgggguggaagacgccagcgaguccaagagccugaccguuagugugauggaccugucacaaauguacucaccuguguucgaauaccucuccggcgaccggcagguugaggaguggccgaaggcgaccugcacuggggacugccccgaacgcuguggcugcacuagcuccacgugccugcacaaggaguggccccacagccggaacuggcgcuguaaccccaccuggugcuggggcguggggaccgguugcacgugcugcggcuuggacgugaaggacuuguuuaccgacuacauguucgucaaguggaagguggaguacaucaagacagaggccauugugugcgucgaacugaccucucaggagcgccagugcucgcugaucgaggccggcacccgguucaacuuggggccggugaccaucacgcucuccgagccccgcaacauccagcagaaacucccgcccgagaucaucacccugcacccgcggauugaggaaggcuuuuucgaccucaugcacgugcagaagguccuaagcgccucgaccgugugcaagcugcagagcugcacccacggcgugcccggggaccuccaggucuaucacaucggcaaccugcugaaaggugacaagcucaacggccacaugauccacaagaucgagccccacuucaauacguccuggaugagcugggacggcugcgaccuggacuacuacugcaacaugggggacuggcccaguugcaccuacaccggagugacgcagcacaaccacgccgcuuucgugaacuuacuuaacaucgagacggauuacacaaagaacuuccacuuccacaguaagcgcgugaccgcccacggggacaccccgcaguuagaucugaaggcccgucccacguacggugcgggggagaucaccgugcuuguggaggucgcugacauggaguugcacaccaagaagaucgacaucuccggccugaaauuugcgagccugaccugcgccggcuguuaugccugcagcuccggcaucaguuguaaggugcgcauccacguggacgagcccgacgagcugaccguccacgugaaauccgaggacccggauauaguagcugcaaguaccucccugaucgcgcggaagcuagagcugggcacugacagcaccuucaaagccuucuccgccaugcccaagacgagccugugcuucuauaucgucgagcgcgaguacuguaaguccugcucaaaggaggacacccaaaagugcguuaacaccaaguuagagcauccccaggggauucugaucgagcacaagggcaccauaaucgggaagcaaaacgacacgugcaccgccaaggcgggcugcuggcuggaaucagucaagagcuucuucuacggccucaaaaacaugcuguccggaauuuucggcaacguguuuaucggcaucuuucuguuccucgcccccuucgugcugcucauacuguuuuucauguucggcuggcggcugcuguucugcuucaagugcugccgccggacccgcggccucuucaaauaccgucaccuaaaggaggacgaggaaucgggguaccgucggaucaucgagcgccugaacaacaagaagggcaagaauaagcuccuagacggcgagcgguuagccgacaggcggaucgccgagcuguuuuccaccaagacgcacaucggc

SEQ ID NO: 15531 - RNA, 2916 nt, Artificial Sequence
  derived and/or modified CDS sequence (opt11) from CCHFV(Zahedan 2007, Artificial)__KC867273.1__Gn-4aa-Gc
uccgaggaguccggcgacgacugcauaagccgcacacaacuacuccgcaccgagaccgcggagguacacggagacaacuacggcggcccaggggacaaaaucaccaucugcaacggguccaccgucguagaccaacggcucggcagcgaacucggcugcuacacaaucaaccgaguccguucguucaaacucugcgaaaacuccgcgacaggcaaaucaugcgaaauagacuccauacccgucaaaugcaaacaagguuucugccuuaaaaucacacaagaaggccgcggccauguaaaacucucccgcggcagcgaagugguccuugaugucugcgacucgagcugcgaagucaugauccccaaaggaacaggcgauauccuagucgacugcagcggcggccaacaacauuuccucaaagacaaccuaguagaccuagggugcccaaaaaucccgcuauuagguaaaauggccaucuacauaugccgcaugucaaaccaccccaagaccacgauggcauuucucuucugguucagcuucggauacgugauaaccugcauccuaugcaaagccaucuuuuuccuacucauuauauucggcacccuugggaagcgcuucaaacaauaccgcgaacuaaagccacaaacguguacuauaugcgagacaacgcccgucaacgccauugacgccgagaugcaugaccuaaacugcuccuauaacaucugcccauacugugcaagccgucucacauccgacggacuggcccgacacgucacgcaauguccccgcagaaaagaaaagguugaagaaaccgaacucuaccucaaccuugagcgaauaccguggguaguccguaaacuacuccaaguaucagaaagcaccgggacgguccucaaacgcucaagcuggcucaucguccuacucgugcuauucacagucagucucuccccagugcagagcgccccuaucggccgccgcccccucuuccuggacagcaucguuaaagacaugaaaaacuuacuaaacagcacuucccuagaaaccucccugagcaucgaggcacccuggggcgccaucaacguacaguccacauacaagccgacagucagcacagcaaacaucgcucucucauggucguccgucgaacaccgcgggaacaaaguccucgucuccggccgguccgaaucaauuaugaaacucgaggagcgaacaggaauaagcugggaccuagggguagaagaugccucagagucaaaacuccucaccgucucugucauggaucuaucacaaauguacuccccuguauucgaauaccugagcggagaccgccagguagaggaauggcccaaagcgaccugcacaggugacugccccgaacgaugcggaugcacguccuccacaugccuccacaaagaauggccccacagccgcaacuggcggugcaacccaaccuggugcuggggaguaggcaccggcuguaccugcugcgggcucgacguaaaagaccucuucaccgacuacauguucgucaaauggaagguagaguacauaaagacagaggcaaucguaugcguggagcucaccucucaagaacgccaaugcucccucaucgaagccggaacgcgauucaaccucggaucggucaccaucacccugucagaaccccgaaacauccagcaaaagcuaccuccagaaauaauaacccugcaccccaaaaucgaagaaggcuucuucgaccucaugcacgugcaaaagguccuuucagcgaguacaguaugcaagcuccaauccugcacacauggcguaccgggcgaucuacagguguaccacaucggcaaccuacucaaaggcgaccgggucaauggccaccuaauccacaaaaucgaacaacacuuuaacacgagcuggauguccugggacggaugcgaccucgacuacuacugcaacaugggagacuggcccagcugcaccuacaccggggucacccagcacaaccacgcaaguuucguuaaccuucugaacaucgaaaccgacuacacaaaaaccuuccacuuucauuccaaacgggucacggcccauggagacacuccccagcuagaccuaaaagcaagacccaccuacggcgccggcgaaaucaccguacugguagagguggccgacauggaacuacacacaaagaaaauugagaucucaggccuuaaauucgccggucugacaugcacgggcugcuaugcaugcucaagcggcauaagcugcaaaguccgcauacacgucgaugaaccagacgaacucacaguccauguaaaaucggacgaccccgacguaguagcagccuccuccucccucauggcccgaaaacuagaguucggcacagacucaacuuucaaagccuucuccgccaugccuaaaacaucccucugcuucuacaucguagaaagagaauacugcaaaucaugcucaaaagaagacacacaaaagugcguaaacaccaagcucgaacaaccacaauccauccucaucgaacacaaaggaacgauaaucggcaaacaaaacaauaccugcaccgccaaagcgucuugcuggcuagaaagcgucaagagcuuuuucuacggacucaaaaacaugcuagggggcaucuucggcaacgucuucaucgguauauucacguuccucacuccguucauacugcucaucuucuucuucauguucggcuggcggauucuauucugcuuuaagugcugcagacgaacacgaggccucuucaaguaccgccaccugaaagacgacgaggaaaccgguuaccguaaaaucaucgaacgccucaacaacaagaaagguaaaaacagacuccuagauggagagcgccucgccgaccgcaaaaucgccgaacucuuuucaacgaaaacucacauaggu

SEQ ID NO: 15532 - RNA, 2916 nt, Artificial Sequence
  derived and/or modified CDS sequence (opt11) from CCHFV(SPU 44/08, Artificial)__KJ682805.1__Gn-4aa-Gc
agcgaagaauccaacgacgacugccugucgcgcacccagcuccugcggacagagaacgccgagauccacagugacaacuacggcggcccaggcgacaagaucacgaucuguaacggaagcaccaucguugaccagcgauugggcucggaacucgggugcuacacuaucaaucgggucaagagcuucaagcugugcgaaaauucggccaccggaaaaagcugugagauugacuccacaccggugcgcugucggcagggauuuugccugaagaucacccaggagggacgcggucacgugaagcucagccgaggauccgaggucgugcuggacgccugcgacucuuccugcgagauuaugauccccaaggggaccggggacauccuuguggacugcagcggcggccagcaacacuuucucaaggacaaccuggucgaccuugggugccccaacauccccuuacugggcaaaauggccauuuacaucugucgcaugucgaaccacccgaagaccacgauggccuuccuguucugguucagcuucggguacguaaucacaugcauacucugcaaggccaucuucuaucugcugaucguggucggcacacucggcaagaaauucaagcaguaccgggaacugaaaccccagaccugcacaauaugcgagaccaaucccguuaaugccaucgacgcggagaugcacgaccugaacuguucguacaauaucugcccguacugcgccagccgccucacuuccgacggccucgcccggcacgucaugcagugcccgaaaagaaaggagaagaucgaggaaacagagcucuaccuuaacuuggagcgaauacccuggguugugaggaagcuguuacagguuagcgagagcacgggcgucgcccuaaagagaucaucgugguuggugauccuccugguuuugcuuaccgucagccucagccccgugcaguccgcgcccaucagcagaaagccgcuuuuccucgacuccaucgugaaggggaugaagaaccuucugaacaguaccucccuggagacuagccuguccaucgaggcacccuggggcgccaucaacguccaaucaacguuuaaacccaccgugucagccgcgaacaucgcgcugagcugguccagcguggagcacagagggaauaagauccucgucuccggccgcagugaguccaucaugaagcuggaggagcgaacuggcauuucuugggaccuggggguagaggacgcaucugaguccaagcuccugaccgucaguguaauggaccuaucucaaauguacagcccgguguucgaguaccuaucgggcgaccgacaagucgaagaauggccuaaggccacgugcaccggggacugccccgaacggugcgguugcaccuccuccacgugccugcacaaggaguggccccacagcaggaacuggcgcugcaaccccaccuggugcuggggcguagggacuggcugcacgugcugcggguuggacgugaaggacuuguucacggacuacauguuugucaaauggaaagucgacuacaucaagaccgaggccaucguaugcguugaauugaccucccaggagcggcagugcucccuaaucgaggccggcacccgcuucaaucuggggccggugaccaucacacuauccgagccccggaacauccagcagaagcuaccgcccgagaucgugacccugcacccccgcaucgaggagggcuucuucgaccucaugcacauccagaagguccugucggcguccaccgugugcaagcugcagucuugcacccauggugugcccggcgaccuccagaucuaccacauuggcaaccugcugaagggggacaagguaaacggccaccucauccauaagaucgagccccacuucaacaccuccuggaugagcugggacgggugcgaucuugacuacuacuguaacaugggugacuggcccuccugcuccuacaccggcgucacucaacacaaccacgccgccuucgugaacaugcucaacaucgagacagacuacaccaagaacuuccacuuccacagcaagcgggucacagcccauggggacacuccccagcucgaccuaaaggcccgccccaccuacggcgcgggggagaucacgguguuaguagaggucgccgacauggaacuccacacgaaaaagaucgagaucuccggcuuaaaguucgcuucgcuaaccugcaccgggugcuacgccugcaguagcggcaucagcugcaaaguaagaauccacguggacgagcccgacgagcucacugugcauguaaagagcgaggacccggacaucguggccgcgucauccucgcugauggcccguaagcuggaguucggcacggacucuacauucaaggccuucucggccaugcccaagaccucgcucugcuucuacaucguggagcgggaguacugcaaguccuguagcaaggaggauacgcagaaguguguaaacacgaaguuggagcagccccagucaauucugauagaacacaaggggacuaucaucggcaagcagaacgauacgugcaccgcgaaggccuccugcuggcucgaguccaucaagagcuucuucuacggucugaagaacaugcuguccggaaucuucgggaauguguucauaggcaucuuccucuuucuggcccccuucauuaugcugauccucuucuucauguucggcuggcguauccuguuuugcuucaagugcugcagacgcacacguggacuguucaaguaccgacaccucaaggacgacgaagagauaggcuaccggaagaucaucgaacgccugaacaauaagaagggaaagaacaagcugcucgacggcgagcggcuggccgaucgcaaaauugccgaacuauucuccaccaagacccacaucggg

SEQ ID NO: 15533 - RNA, 2916 nt, Artificial Sequence
  derived and/or modified CDS sequence (opt11) from CCHFV(SPU 383/87, Artificial)__KJ682806.1__Gn-4aa-Gc
ucagaggaauccaacgacgacugccugagccgcacccagcuccugcggaccgagaaugcggagauccacuccgacaacuacggcgggcccggcgacaagaucacgaucuguaacggcagcaccaucguggaccagcgccugggcuccgagcucggaugcuauaccaucaaccgggucaagagcuucaagcugugcgagaacuccgccaccggcaagagcugcgagauagacuccacgccggugcgcugucggcagggcuucugucugaaaauuacccaggaggggcgcggccacgugaagcucagccggggguccgaggucgugcuggacgcgugcgacagcuccugcgagaucaugauccccaagggcaccggggauauccugguggacugcucuggcggccagcagcacuuccucaaggacaaccuggucgaucuggggugccccaacaucccccuccuggguaagauggccaucuauauaugccgcaugucaaaccaccccaagaccaccauggccuuccuguucugguucucuuucggguacgugaucacgugcauccucugcaaggugaucuucuaccugcuggucguggugggcacucucggcaagaaguucaaacaguaccgggaacugaagccccagaccugcaccaucugcgagaccaaccccgucaaugccaucgacgccgagaugcacgaccugaacugcucuuacaacaucugccccuacugcgccagccgccucaccuccgaugggcuggcccggcacguuauccagugcccgaagcguaaggagaagauugaggagaccgaacuguaccucaaucuggagaggauccccugggugguucgcaagcugcuccaggugagcgagagcacuggcguagcccuuaagcgguccagcuggcuggucauccuccuggugcugcucaccgugucccugagccccguccaguccgcccccauuagccgcaagccguuauuccucgacuccaucgugaaaggcaugaagaaccugcugaacagcaccucccucgagaccucucuguccaucgaggcgcccuggggagccaucaacgugcagagcacguucaagcccaccgucuccgccgccaacaucgcccugagcugguccagcguggagcacagagggaauaagauacucgucuccggccgcagcgaauccaucaugaagcuggaggagcggaccggcaucagcugggaccuggggguggaggacgcgagcgaauccaagcuccugaccguguccgucauggaccugucccagauguacagccccguguuugaguaccucuccggcgaucgccagguggaggaguggccgaaggccacguguaccggagacuguccggagcggugcggcugcaccagcuccacgugucugcacaaagaauggccccacagccgcaacuggcgcugcaacccaaccugguguuggggcguugggaccgggugcacgugcugcgggcuggacgugaaggaccuguuuaccgacuacauguucgugaaguggaagguugacuacaucaagaccgaagccaucgugugcguggagcucaccucccaggagagacagugcagccugaucgaggccggcacccgcuucaaccuuggaccggucaccaucacgcucuccgagccccggaacauccagcagaagcugccucccgagaucgugacccugcacccccgcaucgaggagggcuucuucgaccucaugcacauccagaaagugcugagcgccuccaccgucugcaagcugcagaguugcacccacggggugcccggcgaccuccagaucuaccacaucggcaacuugcugaaaggggacaaggugaacggccaccucauccacaagaucgaaccccacuucaacaccuccuggaugagcugggacgggugcgaccuugacuacuacugcaacaugggcgacuggcccuccugcagcuacacgggcgucacacaacacaaccacgcggccuucgugaacaugcugaacaucgaaaccgacuacacaaagaacuuccacuuucacagcaagcggguaacggcccacggggacacuccccagcucgaccugaaggcccgccccaccuacggcgcuggggagaucaccguccugguggagguggcggacauggagcuccacacgaagaagaucgaaaucuccggccuaaaauucgccagucuaaccugcacagggugcuacgccugcuccagcggcaucucuuguaagguccggauccacguggacgagccagaugagcucaccgugcacgucaagagcgaggaccccgacauaguggccgccuccagcucccugauggcgcgcaaacuggaguucggcacggacagcaccuucaaggcguucuccgccaugcccaagaccucccucuguuucuacaucguggagcgggaguacugcaaguccugcuccaaggaggacacccagaagugcgucaacacuaaacuggagcagccccagucgauccugaucgaacacaaggggaccaucuucggcaagcagaacgacacgugcaccgccaaggcgagcugcugguuggaguccgucaagagcuucuuuuacgggcuaaagaacaugcuguccgggaucuucgggaacguguucaucggcguguuucucuuucuggcccccuucaucaugcugauccucuucuucauguucggcuggcgcaucuuauucuguuucaagugcugccggcgcacccggggacuguuuaaguaccgacaccucaaggacgacgaggagaucggcuaccggaagaucaucgagcgccugaauaauaagaaggggaagaacaagcugcuagacggcgaacggcuggccgaucggaagauugccgagcuguucagcaccaagacccacaucggg

SEQ ID NO: 15534 - RNA, 2916 nt, Artificial Sequence
  derived and/or modified CDS sequence (opt11) from CCHFV(SPU 130/89, Artificial)__KJ682807.1__Gn-4aa-Gc
agcgaagaaccgaacuaugacugcuugagccgcacgcaacuccuccgcacagaaaacgcagagauccacuccgacaacuacggaggaccaggcgacaaaauaacaaucugcaacggauccaccaucgucgaccaacgucuaggcucagaacuaggcugcuauacaaucaacagaguaaagagcuucaaacucugcgaaaacuccgcuaccgggaaaaguugcgaaaucgacucuacaccggugcgcugccggcagggcuucugccucaagaucacccaggaaggcagaggccacguaaaauuaucaagaggaucagaaguaguacuggacgccugcgacuccagcugcgagaucaugaucccgaaagggaccggugacauacucgucgacugcucugggggccaacaacacuuccucaaggacaaccucgucgaccuagggugccccaacaucccacuccuuggcaaaauggccaucuacaucugccgaaugucaaaccaccccaaaaccacuauggccuuccuguuuugguucuccuuuggauacgucaucacauguauccucugcaaaguaaucuucuaccuacucauagugguuggcacccuaggcaagaaauuuaaacaguacagagaacucaaaccacaaaccugcaccauaugcgaaaccaaccccguaaacgccauagacgccgaaaugcaugaucucaacugcucauacaacaucuguccauauugugcaucgagacucaccagcgacggccucgcacgccacguaaugcaaugccccaaaagaaaagagaaaauagaggaaacggaacuguaccuaaaccuugaacggaucccaugggucguccgaaaauuauuacaaguaucugaauccaccggcguagcccucaagcgcuccucauggcucgucguccuccuaguucuacuaacaguaucacuaucacccguccagucagcgccgaucucacgaaaaccccugucccuagauagcauugucaaaggcaugaaaaaccuccuaaacucaacaucuuuggaaacgucccuaucaaucgaagcccccuggggcgcaaucaacguccaguccacauucaagcccaccguuagcgcagcaaacaucgccuuaucauggucauccgucgaacaccgagguaauaagauccuggugucgggccgauccgagucaauaaugaaacuugaagaacgcaccggcauauccugggaccuaggcgucgaagaugccagcgaauccaaacuacuaacuguauccgugauggaccucucgcaaauguacucaccaguauuugaguaccugucaggcgacaggcaggucgaagaauggcccaaagcaacgugcacaggcgacugucccgaaagaugcggcugcaccuccagcacaugcuuacacaaagaguggccccacagccgcaauuggcgcugcaaccccacguggugcuggggaguaggaaccggcuguaccugcugcggacucgacgucaaagaccuauucaccgacuacauguucgucaaguggaaaguagacuacauaaaaaccgaagcaaucguaugcgucgaacucacaucccaagaacgccaaugcucacuaauagaagccggcaccagauucaaccugggccccgucaccauaacccuaagcgaaccacgaaacauccaacaaaaacuacccccagaaaucguaacccuacauccgcggaucgaagaaggcuucuucgaucucaugcacauccaaaaaguccucuccgccucgaccguuugcaaacuacaaagcugcacccacggcguaccuggcgaccuacagauuuaccacaucggcaaucuacuuaaaggugauaaagucaacggccaccuuauacacaaaauagaaccccacuucaacaccuccuggaugucgugggacgguugcgaccuagacuacuacugcaacaugggagacuggccauccugcagcuacaccggagucacccaacacaaccacgccgcauucgucaacaugcugaacaucgaaaccgacuacaccaaaaacuuucacuuccacucaaaacgagugacagcccacggagauaccccucagcuggaucucaaagcccgcccuacguacggcgccggagaaaucacuguccuuguagaaguagccgacauggaguuacacacgaaaaaggucgagauuucaggucuaaaauucgcaucauugacgugcaccgguugcuacgccugcuccucaggcaucagcugcaaaguccgaauccacguagacgaacccgacgaacucaccgugcacgugaaauccgaggaucccgacauaguagccgcuucuuccucgcucauggcacggaaacuugaguucggcaccgacucaaccuucaaggcauucucagcgaugcccaagacuagccucugcuuuuacauagucgagcgcgagcacuguaaaagcugcucuaaagaagacacccaacguugcguaaacacgaagcuggaacaaccccagucaaucuuaaucgaacacaaaggaaccauaauuggaaaacaaaacgauaccugcaccgcgaaagcauccugcuggcucgaaagcaucaaauccuucuuuuacgggcucaaaaacaugcuguccggcaucuucggaaacgucuucaucggcgucuuucuguuccucgcaccguucauuauccuaauacuguucuucauguucggauggcguauacuguucugcuucaaaugcugccgccgcacccgcggccuccuaaaauaccgccacuuaaaagacgacgaagaaaucgguuaccgaaaaaucauagaaaggcugaacaacaagaaagguaaaaacaagcuccuagacggcgaaagacucgccgaccgcaaaaucgccgaacucuucuccacaaaaacccacaucggc

SEQ ID NO: 15535 - RNA, 2916 nt, Artificial Sequence
  derived and/or modified CDS sequence (opt11) from CCHFV(SPU 497/88, Artificial)__KJ682808.1__Gn-4aa-Gc
agcgaagaaucgaaugacgacugccucucccggacccaacuccuacgcacagaaaaugcugaaauccacuccgacaacuauggcggacccggcgacaaaauuacaaucugcaacggguccaccauaguggaccaacgccuaggaagcgaacugggcugcuauacaaucaaccgcguaaaauccuucaaacuaugcgaaaacucagccacuggaaagucaugcgaaauagacagcacacccguccggugccggcaaggcuuuugccuaaaaaucacccaagaaggaaaaggacacgucaaacuaucccgcggaucggagguaguccucgacgcaugcgacucauccugcgaaaucaugauccccaaaggcaccggcgacauccuggucgauugcuccggagggcaacaacacuuccucaaagacaaccuggucgaccuagggugccccaacaucccacucuuaggaaaaauggcaaucuacaucugccgcauguccaaccacccuaagaccaccaugguauuccuauucugguucagcuucggcuacgucauaaccugcauccucugcaaagucaucuucuaccuacuuaucguagugggcacccuaggaaagaaauucaaacaauaccgcgaacucaagccccaaacaugcacuaucugcgagacaaacccaguuaacgccaucgacgccgaaaugcacgaccucaacuguucauacaacaucugccccuacugcgcaucgcgccucacaucggacggucucgcaagacacguuaugcaauguccaaaaagaaaagaaaagaucgaggaaaccgaacucuaccucaaccuugaacggauucccuggguaguacgcaaacuccugcaaguauccgaauccaccggcgucgcccucaaacgcucauccuggcucgucauccuacucguacuccuuaccgucucccuaagccccguccaauccgcccccauuuccagaaaaccccucuuccuggacagcauaguaaaaggcaugcgcaaccuccugaacuccacuucacucgaaacaucacuaucgauagaagcccccuggggugcaaucaacguccaaagcaccuucaaaccaacaguaucugcagcgaauauagcgcuaucaugguccuccgucgaacaccgagggaacaaaauacucguaagcggccgcagcgaguccauaaugaaacuagaagaacgcacaggcaucuccugggaccucggagucgaggaugcguccgagucaaaguuacugacugucuccguaauggaccucucacaaauguacagccccgucuucgaauaucuaagcggcgaucggcaagucgaggaauggcccaaagcaaccuguaccggagauugccccgaacgcugcggcuguacaagcuccacgugccuucacaaggaauggccucacagccgaaauuggcgcugcaacccaaccuggugcugggguguaggaaccggcuguaccugcugcggccuagacgucaaagaccucuucaccgacuacauguucguaaaauggaaggucgauuacauaaaaaccgaggcaaucgucugcguagaacuuacaagccaagaacgccagugcucacugauagaggcugguacccgcuucaaccucggacccgucaccaucacccuuucagaaccacgcaauauacaacaaaagcugcccccagagauagucacccugcacccacgaaucgaagagggcuucuucgacuugaugcauauccaaaaaguacuguccgccucaacggucugcaagcuacaaaguugcacccacggggucccgggagaccuacaaaucuaccacaucggcaaccuacucaaaggcgacaaagucaacggacauuugauccacaaaauagagccacacuucaacacaucauggauguccugggacgguugcgaucuagacuacuauugcaacaugggcgacuggcccucaugcagcuacaccggggucacacaacacaaccacgcugccuuuguaaacaugcuaaauauagaaacagacuacaccaagaacuuccacuuucacucgaaacggguaacagcacacggagacacgccacaacuggaccucaaagcacgacccacauacggcgcgggcgaaaucaccguccucguagaagucgccgacauggaauugcacacaaagaaaaucgagaucuccggucucaaguucgccagucuaaccugcaccggaugcuacgccugcucaagcggcauauccugcaaaguccggauacacguagacgagcccgaugaacucacuguccacgucaaaucagaagaccccgacaucgucgccgcauccuccucccuaauggccaggaaacuggaguuuggcacagacuccacauucaaagcauucucugcaaugcccaagacaucucucugcuucuauaucguugagcgagaguacugcaaaucaugcagcaaagaagacacccaaaagugcgucaacacuaagcuggaacaaccccaauccauccuaaucgaacacaagggaaccauaauagguaaacaaaaugacacaugcacagcacgagccagcugcuggcuagaguccauaaagagcuucuucuacggacucaaaaacaugcuaucagguaucuuuggcaacgucuucaucgguaucuuccucuuuuucgcaccauucauaaugcuaauccucuucuucauguucggcuggcggauccucuuuugcuuuaaaugcugcagacgcacaagaggacuauucaaauacagacaucuaaaggacgacgaagaagucggcuaccggaaaauaauagaaagacuaaacaauaagaaaggcaaaaacaaacuacucgauggugaacgccuugcagaccgaaaaaucgccgaacuauucucaacuaagacacacaucggc

SEQ ID NO: 15536 - RNA, 2916 nt, Artificial Sequence
  derived and/or modified CDS sequence (opt11) from CCHFV(SPU 18/88, Artificial)__KJ682810.1__Gn-4aa-Gc
uccgaagagucgaacgacgacugccucucccguacccaacuccuccgcacggaaaacgccgaaauccacagcgacaacuacggcggacccggggacaaaauaaccauauguaacggauccaccaucguagaccaacgacuagguagcgaacuuggaugcuacaccauaaaccgagucaaaucauucaagcugugcgagaacucagcaacagggaaaucgugcgagauagacucgacgccaguacgcugccgacaaggauucugccuaaagaucacccaggagggacgagggcauguaaaacugucccggggaagcgaagugguccuagacgcuugcgacucaucgugcgagaucaugauacccaaaggcaccggcgacauucuggucgacugcuccggaggccaacaacacuuccuuaaggauaaccuagucgaccucgggugccccaacauuccucuucuaggcaaaauggccaucuauaucugccggaugaguaaccacccaaaaaccacgaugggauuccuguucugguuuucauucggguacgucauaaccuguauacucuguaaggucaucuucuaccuacucauaguagugggcacgcuagggaagaaauucaaacaauaccgcgagcucaaaccccaaacaugcacuauaugcgagacaaaccccguaaacgccauagacgccgaaaugcaugaccuaaacugcagcuacaauauaugccccuacugcgccucccgacucacgagcgacggccuagcccgccacguaaugcaaugucccaaacgcaaagagaaaauugaagagacugaacucuacuuaaaccucgaaagaauccccugggucguccgcaaauuauugcaagucagugaaagcacaggcguagcgcucaaaagaagcucauggcuagucauacuccuaguccuccugaccgucagccucaguccaguacaauccgcacccaucucgcgaaaaccccuauucuuagacucaauaguaaaagguaagaaaaaccuacucaauucaaccucacucgagaccucauuaagcaucgaggccccauggggagccaucaacguccaaagcaccuucaaaccaacagucucggcugccaacaucgcccucagcugguccagcgucgaacaucgcggcaacaaaauccuaguguccggcagguccgaaagcauaaugaaacucgaggaacgcacugggauaucgugggaccuuggagucgaagacgcgagcgaaucaaaacuacucacaguaagugucauggaccucucccaaauguacuccccaguauucgaguaucuaucaggcgaccgccaagucgaagaauggccaaaagccacaugcaccggcgacugccccgaaagauguggaugcaccagcucuaccugccuacacaaagaauggccacacucacgaaacuggcgaugcaaccccaccuggugcuggggcgucggcaccggcuguaccugcugcggacucgacgucaaagaccucuucaccgacuacauguuugucaaauggaaagucgacuacaucaaaacagaagccauaguaugcguugaacuaaccucgcaggaacgccaaugcucucuaaucgaggccggcacucgauucaaucucggaccggucacaauaacuuuaucagaaccccgaaacauccagcagaaacuacccccugagauagugacccuacacccacgcauagaagaaggcuucuucgaccucaugcacauacagaaaguacuaagcgccucaacaguaugcaagcuacaauccugcacccacgguguccccggagaccuccaaaucuaccacaucggcaaucuacucaagggcgacaagguuaauggucaccuaauccacaaaaucgaaccacacuucaacacaucauggaugagcugggacggaugcgaccucgauuacuacugcaacaugggggauuggcccagcugcucauacaccggcgucacacagcacaaccacgcagcauucgucaacaugcuaaacaucgaaacagacuacacaaagaacuuccacuuccacuccaaacgggucacggcacacggagacacaccacagcuagaccuuaaagcccgcccaaccuacggcgccggagaaauaaccguccucguagaggucgcagacauggaacuacacaccaagaaaaucgaaauauccggauuaaaauucgccucccuaacgugcacagguuguuacgcaugcaguagcgggaucuccugcaagguccgaauacacguagacgagcccgacgagcucaccgugcacgucaaaucagaagacccagacaucguagcagccuccagcagccuuauggccagaaaacuagaguucggcacagacagcacauucaaagccuucucagcaaugcccaaaacaucccuuugcuucuauaucgucgaacgggaauacuguaagagcugcagcaaggaagacacccagaagugcgucaacacgaaacuagaacaaccgcaaucaauccucaucgaacacaaagggaccaucauuggaaaacagaaugacacgugcacaggcaaagcaggcugcuggcuagaauccaucaaaucguucuucuacggccucaagaacaugcuaagcggcauauucgggaacgucuucauaggcaucuuccuguuccuagcuccguucauaaugcugauccuguucuuuauguucggcuggcguauccucuucuguuucaagugcugcagacgcacgcgagggcucuuuaaauaccgacaccugaaagacgaugaggaaaucggguacaggaaaaucauagaacgccuuaaaaacaagaaaggcaaaaauaaacugcuagacggagaaaggcuggcugacagaaaaauagccgagcuauucagcacuaaaacgcacaucgga

SEQ ID NO: 15537 - RNA, 2916 nt, Artificial Sequence
  derived and/or modified CDS sequence (opt11) from CCHFV(SPU 431/85, Artificial)__KJ682812.1__Gn-4aa-Gc
uccgaagaauccgacggagauugcauaagcagaacucaacuccuacgcacagaaaccacagaaauccacagcgacaacuacggcggcccgggcgacaaaaucacgauaugcaacggcagcaccaucgucgaccaacgacuagggagcgagcucggcugcuacaccauuaaccgcguaaaaucauucaaguuaugcgaaaauagcgcaacgggcaaaucaugcgaaaucgacuccaccccugugaaaugccgacaaggcuucugccugaaaauaacccaagaaggacgcggacacgucaaacugucccgcgggucagaaauaguccuggacgcaugcgacucaaacugcgaaaucaugauuccaaaaggcacaggagacauccuaguagacugcuccggcggccagcaacacuuccuaaaagauaaccugauagaccucggaugcccgaauaucccacugcuaggaaagauggccaucuacaucugccgcauguccaaccaucccaagacaacaauggcuuuccuauucugguucucauucggcuacguaauaacaugcauacuuugcaaagucauauucuacuuacuaaucgucgcaggcaccgucggcaaaaaguucaaacaauaccgcgagcuacgcccccaaaccugcaccaucugugaaaccauacccguaaacgcaaucgaugcagaaaugcacgacuuaaacugcuccuacaacaucugccccuacugcgccucacgccuaacauccgacggacucgccagacacguuaugcaaugcccaaaacgcaaggaaaaaguagaagagacagaacucuaccuaaaccucgagagaauccccuggguaguacgcaaacugcuccagguauccgaaucgacgggggucgcccucaaacguucauccuggcuuacgguccuucucgugcucuugauagucagccucucccccguccaaucagcacccauaggacgaaagccccuauuccuggacucaaucguuaaaggacggaaaaaucuccucaacucgacaagccuagagaccucucuauccaucgaagcaccauggggagcaaucaacguacagagcaccuucaagccaaccgucagcgcugcaaacaucgcccuaucauggucuuccgucgaacacagaggaaauaaaauccuagucucaggccgauccgaauccauaaugaagcucgaggaacgaaccggcauaagcugggaucucggagucgaagacgcaagcgaaaguaaacuccuaacagucagcguaauggaccuaucccagauguauucccccguauuugaauaccucuccggcgaccgccaaguagaagaauggcccaaagcuaccugcacaggagauugccccgaacgcugcgguugcacauccucuacaugccugcacaaagaauggccacacucucgcaacuggcgcugcaaccccaccuggugcuggggcguaggaacgggcugcacaugcugcggacuugacgucaaagaccuauucacggacuacauguuugucaaauggaaagucgaauacauaaaaacagaggccaucgucugcguagaacuaaccucccaggaacgccaaugcucgcuaaucgaagcuggcacacgauucaaucuuggcccagucaccaucaccuuaucagaaccccgcaacauacaacagaaacuacccccagaaaucauuacccuccacccccggauagaagaaggguucuucgaucucaugcaugugcaacgaguacucuccgccucuaccgucugcaaacuacaauccugcacacacgggguccccggagaucuccaaguuuaccacaucggcaaccuacuaaagggggacaaaguaaauggccaucucauccauaaaauagagccccauuucaauacguccuggauguccugggacgggugcgaucucgacuacuacugcaacaugggcgacuggcccuccugcacauauacaggagucacacaacacaaucaugccgccuucguaaaucucuugaacaucgagaccgacuacaccaaaaacuuccacuuucacuccaagcguguaacagcccacggcgacaccccacaacucgaucuuaaagccaggcccaccuacggcgccggcgaaguaaccguccuaguagaggucgccgacauggagcuccacacgaagaaaauagagauaucugggcucaaauucgccucgcugaccuguacgggaugcuacgccugcucaagcggaaucucauguaaagucaaaauucacgucgacgaaccugacgaacucacuguccacgucaaguccgaagaccccgacauagucgccgcaggcuccagccucauggcucgaaagcucgaauuuggagcggauucaacuuucaaggcauucuccgcaaugcccaaaacuagccucugcuucuacauagucgaacgggaauauugcaaguccugcagccgggaagacacccgaaagugcgucaacacaaaacucgacagaccacaauccauccucauagaacacaaagguacuauaaucggcaagcagaacaacacgugcacugcaaaagccuccugcuggcucgaaagcgugaaaaguuucuucuacggacuuaaaaacaugcuaagcggcaucuuuggaaacgucuucaucgguauauuucuauucaucgccccguucgucuuacucauauuguucuucauguucggcuggcgcauacucuucugcuucaaaugcugucgucgaacaagaggccuguuuaaauaccgucaccucaaggacgacgaagaaacaggauaccgcaaaaucaucgaaagacuaaauaauaagaaaggcaaaaacaaacuacuggacggagaacgccuagccgacaggaagaucgccgaacucuucagcacgaaaucccacauagga

SEQ ID NO: 15538 - RNA, 2916 nt, Artificial Sequence
  derived and/or modified CDS sequence (opt11) from CCHFV(SPU 48/90, Artificial)__KJ682813.1__Gn-4aa-Gc
uccgaagaaccauccgacgacugcaucucacguacacagcuccuccgaacagaaacugccgagauacacggcgacaacuacgggggccccggcgauaaaauaacuaucugcaaugggagcacuaucguagaccaacgacuaggcagcgaacuuggcuguuacaccauaaaccgcguaaagucauucaagcucugcgaaaacuccgcgacaggcaaaagcugugucauagacuccguacccgucaaaugucggcaaggcuauugccuccgaauaacccaagaaggacgcggccacguaaaacucucaagaggcuccgaggucguccucgacgccugcgacacaucuugcgaaauaaugauacccaaaggcaccggagacauacucgucgacugcucggguggucaacaacacuuccucaaagacaaccugaucgaucucggcugcccaaaaaucccccuccugggcaaaauggccauauacauuugcagaaugagcaaccaccccaccacaacaauggcauuccucuucugguucuccuuuggauacguaaucacuugcauacucuguaaagccaucuucuaccuccucauuaucauagguacccugggaaaaagauuuagacaauaccgcgaacuaaaaccacaaacaugcaccaucugcgaaacaacccccgucaacgccauagacgcggaaaugcacgaccucaacugcucauacaauaucugcccuuacugcgccucacggcucaccuccgacggguuagcucgccaugugacccaaugcccuaagcgcaaagagaagguagaagaaacagaacuauaccucaaccuagagcgaauacccugggucguacgaaaacugcuucagguaagugagagcaccggcgucgcucucaaacgauccuccuggcucauaguccuccucguccucuuuaccguaucacucucuccaguucaaucugcccccauaggacgaaaaccccucuucagagacucaaucgucaagggaaugaaaaaccugcucaacucuacaucacuagaaacgucucucuccauagaagcucccuggggcgcaauuaacguccaauccacguacaaaccgaccgugagcaccgccaacaucgcccucuccugguccucagucgaacacaggggcaacaaaaucuuaguauccggacgaucggaauccauuaugaaacucgaagaacgcacuggaaucagcugggaccuaggcguggaagacgcgagcgagucaaaacuccuuaccgucagcgucauggaccuaucccaaauguacagccccguauucgaauacuuaucaggugaccgacaaguagaagaauggcccaaggccacaugcacaggugacugccccgaacgaugcggaugcacaucaagcacaugccuucacaaggaauggccacauucccgaaacuggcgaugcaauccgaccuggugcuggggcgugggcaccgggugcacauguugcggacuugauguaaaagaccuauucacagacuauauguuugucaaguggaaagucgaauacauaaagacagaagccauagucugcgucgaacugaccucacaagaacgccaguguucccucauagaagccggcacccgauucaaccuuggacccgucacaaucacacuaucugaaccgcguaacauccaacagaaacuacccccugagauaaucacacuacacccccgaaucgaagaaggcuucuucgaccucaugcacguccaaaaagugcucagcgccuccaccgucugcaaacuccaauccugcacgcacgguguccccggagaucuucaagucuaccacauaggcaaucuacucaaaggcgacaaagucaauggucacuuaauccacaaaauagaaccacacuuuaacaccuccuggauguccugggacgggugcgaccuugauuacuacugcaacaugggcgacuggcccagcugcacuuacaccggagucacacagcacaaccgcgccuccuuuguaaaccuacuuaacaucgaaacugacuauaccaagaacuuccacuuccacucgaaacgcgucaccgcacacggcgauacgccccagcuugaccugaaagcccgacccaccuacggcgcaggcgaaaucaccgugcucguagaagucgcagacauggaacuccacaccaagaaaauagaaaucucaggccucaaauucgccucacuaaccugcacaggcuguuacgcaugcagcuccgguauuucgugcaaaguccggauccacgucgacgaacccgacgaacucacaguccacgucaaaucagacgaucccgacguaguagccgcguccagcagccucauggcacgcaaacuugaguucggcaccgacucaacguucaaagcauucuccgcaaugccaaaaaccucccucugcuucuacaucgucgaaaaagaauacuguaaaagcugcuccgaggaagacaccaagaaaugcguaaacaccaaacuagaacaaccccaauccauacuaaucgaacacaaaggcaccaucaucggcaaacaaaacuccaccuguacggcgaaggugucgugcuggcucgaaagcgccaaaucguuuuucuacggacucaaggacaugcucuccggcaucuucggaaauguauucaucggcauuuuccucuuucuagcccccuucauucuacucauccuguucuuuauguucggcuggcgaauccuccuaugcuucaagugcugucggcgaacaagaggucucuuuaaauaccggcaccucaaagaugacgaggagacuggauaccgccgaaucaucgaacgcuugaacaacaaaaaggggaaaaacaaacugcucgacggagaaagacucgccgaccgucgcauagccgagcucuuuucaaccaagacgcauaucgga

SEQ ID NO: 15539 - RNA, 2916 nt, Artificial Sequence
  derived and/or modified CDS sequence (opt11) from CCHFV(SPU 187/90, Artificial)__KJ682814.1__Gn-4aa-Gc
uccgaagaacccuccgacgacugcauuuccagaacacagcuccuccgaaccgaaaccgccgaaauacacggggacaacuacggcggcccgggcgacaaaaucacaaucugcaauggaagcaccaucguagaucagcgccuaggauccgaauuaggcugcuacaccaucaaccgcgucaaaaguuucaagcucugugaaaacucagccacaggcaaauccugcgaaaucgauuccguacccguuaaaugcagacagggcuacugccuccgcaucacccaggaaggccgcggccacgucaaacuuagucgcggcagcgaaguaguccucgacgccugugacaccuccugcgaaaucaugaucccaaaaggcaccggggacauacucguagacugcaguggcggacaacaacacuuccuaaaggacaaccucaucgaccucggaugccccaaaaucccccuacuagggaaaauggccauauacauaugcagaaugucaaaccaccccaaaacgaccauggcguuccucuucugguucucauucggguacgucauaacgugcauacucugcaaagcgaucuucuaccugcucaucaucauaggcacccugggaaaacguuucaaacaauaucgggaacucaaaccacaaacaugcacaauaugcgaaaccaccccugugaacgccaucgacgccgaaaugcaugaccucaacuguucuuacaacaucugccccuacugcgccucacgccugaccucagacgggcucgcccgccaugucacgcaguguccaaaacgaaaggaaaaaguagaggagaccgaacucuaccucaaucuggaaaggaucccgugggucguacgcaaacuccuacaggucucagagucuaccggaguagcccuaaaaagaucgucauggcuuauaguucuccucguccuauucacggucuccuuaaguccaguccaauccgccccaauuggucggcgaccccuauuucuagacucuaucguuaaaggcaugaaaaaccugcuaaacucuaccucccuagaaaccucccuuucaauagaggcucccuggggagccauaaaugugcaaucgaccuauaaacccaccgucuccaccgccaacaucgcccucuccuggucauccguagaacaccguggcaauaaaauacuggucucgggaagaucagaauccaucaugaaacuagaagaacgcaccggaaucagcugggaucuaggcguagaagacgccuccgaaucaaagcugcugacaguuuccgucauggaccuaagccagauguacucaccggucuucgaauaccuuuccggggaccggcaagucgaagaguggcccaaagcaaccugcacgggagacugcccugaacguugcgggugcaccucaucaaccugccuucacaaagaauggccacacucccgaaacuggcgcugcaacccaaccuggugcugggguguugggaccggauguaccugcugcggccuagacguaaaggaccucuucaccgacuacauguucgucaaauggaaaguagaauacaucaaaaccgaagccaucgugugcguagaauuaacaucccaagaacgacaaugcucacucauugaagccgguaccagguucaaccucggcccaguuacaauaacccucucggaaccaagaaacauucagcaaaagcuaccaccggaaauuauuacccuccacccgcgaaucgaggaaggcuucuucgaccucaugcacguacagaagguccuaucagcuuccacggucuguaaacuacaaucaugcacgcacgggguuccgggcgacuuacaaguauaccacaucggaaaccuccuaaaaggagacaaagucaauggucaucucauacacaaaauugaaccacacuucaacaccuccuggauguccugggacggaugcgaucucgacuacuacugcaacaugggcgacuggcccucgugcaccuauacaggagucacccaacacaaucacgccuccuucgucaaccuccuaaauaucgaaaccgauuacaccaaaaacuuccacuuccacagcaagcgggucacggcacacggagacacuccccaacuagaccuuaaagcccgccccacauacggugcuggugagaucacuguccuaguagagguagcagacauggaacuucauaccaagaaaaucgagaucagcggccucaaauucgccucccucacauguacaggcugcuacgccugcagcucaggcauaucauguaaaguccguauucacgucgacgagcccgacgaacugacgguccacgucaaauccgacgaccccgacguugucgcagccuccagcucacuaauggcacgcaaacuggaguucggaacugacucgaucuucaaagcguucucugccaugcccaaaacaucccucugcuuuuauauagucgaacgcgaacacugcaaauccugcagcgaagaagacacuaagaaaugcgugaacaccaaacucgaacaaccccaauccauccuaauagaacacaaaggcaccaucauaggcaaacaaaacucaacguguaccgcgaaaaccucauguuggcucgaguccgugaaaucauucuucuacggccucaagaacaugcugaguggaaucuucgggaacgucuucauuggcauauuccuuuuucucgcuccuuucauacuccucauucuauucuuuauguucggauggcgcauccuuuucugcuuuaaaugcugccgccgcacucgagggcuauucaaauaccgacaccuaaaagaugaugaagaaacaggcuaccgccgaaucaucgaacgacucaauaacaagaaaggcaaaaacaaacuccuagacggcgaacggcucgcugaccgccgcauugcagaacucuucuccacuaaaacccacaucggc

SEQ ID NO: 15540 - RNA, 2916 nt, Artificial Sequence
  derived and/or modified CDS sequence (opt11) from CCHFV(Haskovo-V46/13, Artificial)__KR092379.1__Gn-4aa-Gc
agcgaagaacuaggggacgacugcauaagccgcacccagcuccuacgaaccgaaaccgccgagauccaugacgacaacuacggaggcccuggcgacaagaucacaauuugcaacggcagcacuaucgucgaucaaagacucggcagugaacucggauguuauacaauaaaccgggguaagucauucaaguugugcgaaaacucagccaccggaaaaaccugcgaaaucgauucaacacccgucaaaugcaggcaagguuucugcuuaaaaauaacccaagaaggacgcgggcaugucaaacuaagccgcggaucagaggucguucuggacgccugcgacagcucaugcgaagucaugauacccaaggggaccggcgauauauuagucgacuguuccggcgggcaacaacacuuccuaaaagacaauuugauagauuugggaugcccccacauaccccuccuagggaaaauggcaauauacaucugccggaugagcaaucacccucgcaccacaauggcauuccuauucugguucuccuucggguacguaauaaccugcaucuucugcaaagcauuguucuacuccuuaaucaucaucggcacacugggcaaaaagauaaaacaauacagagaacuaaaaccacagaccugcacaaucugcgagacuacuccaguaaacgcaaucgacgccgaaaugcacgaccuaaauugcucauacaacauaugccccuacugcgccagccgccucacaagcgacggccucgcccgacauguaacgcaauguccaaaacgcaaagagaaaguggaagagacugagcuauaucucaaccuagaaagaauacccuggaucgucagaaaacuccuacaggucagcgagucaaccggcguagcccuaaagcgcuccaguuggcucaucguccuucucguccuccuaccgguaucccucucccccguccaaucagccccuguuggacguaaaccccucuuccuggacucuauagucaaagggaugaaaaaucuacuaaacucaacgucccucgaaaccucccucucaauagaagcacccuggggagcuaucaauguccaaagcaccuucaaaccgacagucucaaccgcaaacaucgccuuaagcuggaguuccguagaacaccgaggcaacaagauccuagucaccggccggucugaaagcaucaugaaacuugaagaacgcacaggggucucgugggaccuaggagucgaagacgcgagcgaaucaaaacuccuaacaguaucuauaauggaccuaagccagauguacagccccguauucgaguaccugagcggggaucggcaagucgaggaauggccgaaagcaacgugcacaggcgauugcccugagcgcuguggcugcacuucauccacaugccuccacaaagaauggccccacucucguaacuggcgaugcaauccaacauggugcuggggcguagguacaggcugcacaugcugcggcgucgacguaaaagaccucuucacagaccacauguucguaaaauggaagguagaguacaucaaaacagaggccauagucugugucgaacuaaccagccaagaacgacaaugcucccucaucgaagccggaacacgcuucaaucucggcccagucaccaucacccuaucagaaccacgaaacauccaacaaaaacucccaccugaaaucauaacccuccacccaaaaaucgaagaaggcuucuucgaccucaugcacguccaaaagguccucagcgcuuccacggucuguaaacuccaaucgugcacccacgggaucccaggagaucuccaggucuaccacaucggcaaucuuuuaaagggcgaccgaguaaacggacaccucauccacaaaaucgagccccauuucaacaccuccuggaugagcugggaugggugcgaccucgacuacuauugcaacaugggcgacuggcccucgugcacguacacgggugucacacaacacaaccacgcagccuucguaaaccuccuaaacaucgaaaccgacuacacaaagacauuccacuuccacucaaagcgcguaaccgcacacggugacacuccccaacucgaccuaaaagcaagaccgaccuauggagccggugaaaucaccguacucguggaagucgcagacauggaacuccacaccaagaaagucgaaaucaguggacucaaauucgcaucccucaccuguacaggguguuacgccugcagcagcgguauaagcugcaagguccgcauccacguagacgaacccgacgaacuaaccguccacgucaaguccucagacccagacgucgucgcagcuggcacaucccucauggcccgaaaacuagaguucggcacagacucgacauucaaagccuucucagcaaugcccaaaacaucacucugcuucuacaucgucgaacgcgaauacugcaaauccugcucagaggaugacacccaaaagugcgucgauaccaaacuugaacagccgcagagcauacucaucgaacacaaaggcaccauuaucggaaaacaaaacgacacaugcaccgcgcgagccagcugcuggcucgaaucagucaaauccuuuuucuacggccuaaagaacaugcucggaagcguauuugguaacuuccuuauuggcauacuacucuuucucgcccccuucgugcuccuaguccucuucuucauguucggcuggaagauccucuuuugcuuuaagugcugccgucgaacccgcggccuuuucaaauaucgucaccucaaggacgacgaggaaacgggauaccgucgcauaauagaacgacucaacuccaagaaaggaaagaacagacuccuugacggggaacggcucgcagaccggaagauugccgaacuauucagcacgaaaacccauaucggc

SEQ ID NO: 15541 - RNA, 2916 nt, Artificial Sequence
  derived and/or modified CDS sequence (opt11) from CCHFV(24-R-2012, Artificial)__KR814856.1__Gn-4aa-Gc
agcgaagaacccggagacgacuguaucagccgaacccaacuccuccgaaccgaaacggcagaaauccacgacgacaacuacggugggccaggagacaaaaucaccaucugcaacggcucuaccauaguagaccaacgccucggaagcgaacucgguugcuacacaauaaaccgggugaaaucauucaaacucugcgaaaacuccgcaacagguaaaacaugcgaaaucgacuccacccccgucaagugucgccaaggguuuugccucaaaaucacacaagaagggcgcggacacguaaaacuaucacguggauccgaagucguccucgacgccugcgauacaagcugcgaggucaugauacccaaaggcacuggagacauccuaguagacugcuccggcggccagcaacacuuccucaaagacaaccucaucgaucucgggugcccccacaucccccuccuaggaaaaauggcaauauacaucugccgaauguccaaccaucccaggacaaccauggcguuccuauucugguucucuuuuggcuacgucaucacuuguauauucugcaaagcucucuucuacucccucaucauaauaggaacacuaggcaagaaaauaaaacaauaccgagaacucaaaccgcaaaccugcacaaucugcgaaaccgcccccguuaacgcuauagaugcagaaaugcacgaccugaacuguagcuacaacaucugcccuuauugcgcaucccgacucacauccgacgggcucgcccgacauguaccacaaugccccaagcgaaaagagaaaguggaagaaacggaacuauaccugaaccucgaacgcauaccguggaucguacgaaaauuacuacaagucuccgaauccacgggcguggcacucaaacgcucaagcuggcucauaguccuucucguacuccugaccgucagccuaucacccguccaguccgcccccguuggacgaaaaccccuauuucucgacagcaucgucaaaggaaugaaaaaccuccuuaacucuaccucccucgagaccucauuaucuauagaggcucccuggggcgcaaucaacguccagucaaccuuuaaaccuaccguauccacggcaaacaucgcacucuccugguccuccgucgaacaccgagguaacaagauccucguaacgggacgguccgaaucgauaaugaaacuagaggagcgaaccggagucucgugggaccucggcgucgaggacgcaucugagagcaaacuccuuaccguaucaaucauggaccuaucacaaauguacucccccguuuucgaguaccucucaggggaccgccaagucgaagaguggcccaaggcuacaugcacaggagacugccccgaaagauguggaugcaccagcucgacaugucuacacaaggaauggccccacagccggaacuggcguugcaaccccaccuggugcuggggcgucggaaccggcuguaccugcugcggcgucgacgugaaagaccuauuuaccgaccacauguucgucaaauggaaaguugaauacauaaaaacggaggccaucgucugcguagaacucaccagccaagaacgccagugcucacuaaucgaagccgggacacgcuucaaccugggaccagucacuaucacccuaagcgaaccgagaaacauccaacaaaaacucccacccgaaauaaucacccuacaccccaaaguugaagaaggcuucuucgaccucaugcacguccaaaagguguuguccgcaucgaccgucugcaaacugcaaucuugcacacauggcauucccggugaccuccaagucuaccacaucggaaaccuacucaaaggggaccgcguaaacggccaccucauccacaaaauagagccgcacuucaacaccucauggaugucgugggacggcugugaucucgacuacuacugcaacaugggagacuggcccucauguaccuacacaggagucacacaacacaaccacgccgccuucgucaaccuacugaacaucgaaaccgacuauaccaaaacguuccacuuucacucaaaacgcgucacagcccacggcgacaccccgcaacuagaccucaaggccagaccaaccuacggcgccggagaaauuaccguccucgucgagguugcggacauggaacuacacacaaagaaaguagaaaucuccggacuaaaauucgccucgcuugccugcacaggcuguuacgccugcagcagcggaaucucaugcaaagucagaauacauguggacgagcccgacgaacuaacaguccacgucaagagcaacgacccagacguuguugccgcauccacuucacucauggcuagaaaacuggaguucggcaccgacaguacuuucaaggcauucucagcaaugcccaaaaccucucuuugcuucuauaucguagaaagagaauacugcaagucaugcagcgaagaagacacccaaaagugcgucgacaccaaacuagaacaaccgcaaucgauccucauugaacauaaaggcacaauaauuggcaaacaaaacgacaccuguaccgccaaggcuuccugcuggcucgaauccgucaaauccuucuucuacggccucaaaaacaugcucggcucagucuucggcaacuucuucaucggcauacuccuguuccucgccccauucguacuacucguccucuucuucauguucggcuggaaaauccuauucugcuucaaauguugcagaaggacacgaggucuucucaaauacaggcuacugaaagacgacgaggaaaccggauaccgacgcaucaucgaacgccucaacaacaagaaaggcaaaaaccgccuccucgacggagaacgacuagccgaccggaaaaucgccgaacucuucagcacgaaaacccacaucgga

SEQ ID NO: 15542 - RNA, 2916 nt, Artificial Sequence
  derived and/or modified CDS sequence (opt11) from CCHFV(36-ST-2014, Artificial)__KR814857.1__Gn-4aa-Gc
ucagaagaacccggcgacgacugcaucucccggacccaacuacugaaaacugaaaccgccgaaauccacgacgauaacuacgguggccccggcgacaaaauaaccaucuguaauggcagcacaaucguugaccaacgccuaggcucagaacugggaugcuacacuaucaaccgagucaaauccuucaaauuaugcgaaaacuccgcaacagguaaaacgugcgagaucgacucaacucccguaaaaugcagacaaggauuuugccucaaaauaacacaagaaggaagaggacacgucaaacucagccgcggcuccgaaguaguccucgaugccugcgacuccagcugcgaaaucaugauccccaaaggcacgggagacauacucgucgacugcuccggaggccaacagcacuuccucaaagacaaccucauugaccugggauguccacacaucccccuacucggcaaaauggcaauauacaucugcaggaugagcaaccacccccgaacuaccauggccuuucucuucugguucagcuucggcuacgucauaaccugcauauuuugcaaagcacucuucuacucacugaucauaaucggaacacuaggaaagaaaaucaaacaguaccgcgaacucaagccgcaaacaugcacaaucugcgaaacagcaccagucaacgccaucgacgcagaaaugcacgaccucaacugcuccuacaacaucugcccauacugugcuagccgccuaaccuccgacggacuugcucgccacgucacccaguguccaaaacgaaaggaaaaagucgaagagaccgagcucuaccuaaaccuagaacggauaccguggaucguccgcaagcuccuacaggucagcgagucaacaggaguagcccuaaaaagaucaucuuggcuaaucguacugcuugugcuccucacagucucacucuccccaguacaauccgcucccgucggccgcaagccccuauuccuggacuccaucguaaaaggcaugaaaaaccuccuaaacaguaccucccucgaaacaucccuuuccauagaagccccuuggggcgcuaucaacguacaaucaacguucaaacccacaguuagcacagccaacaucgcccuaucaugguccuccgucgaacacaggggaaacaaaauacucguuacaggcagaucugaaucaaucaugaaacucgaggaacgcacaggcgucuccugggaccuaggagucgaggacgcauccgaguccaagcuacugacugugucaaucauggaccucucccagauguacucacccguauucgaguaccuaucaggagaucgacaaguagaagaauggccgaaagcaaccugcaccggagacuguccggaacggugcggcugcacuagcaguaccugccuccacaaagaauggccccacuccaggaacuggcgcugcaaccccacauggugcuggggcgugggaacaggauguaccugcugcggagucgacgucaaggaccuauucaccgaccacauguucauaaaauggaaagucgaauauaucaaaaccgaagccaucguuugcgucgaacucacaucacaagagcgccaaugcagccucaucgaagccggcacgcgcuucaaccucggacccgucaccauaacacucucugaaccacgcaauauccaacaaaaacuuccacccgaaaucaucacacuccacccaaaaaucgaagagggcuucuucgaccucaugcacguccagaaaguacuaucggccucgaccgucuguaagcuccaguccugcacccauggaaucccgggcgaccuacagauauaccacaucggaaaccuacuaaaaggagaccgacugaauggccaccuaauccacaagaucgaaccacacuuuaacaccagcuggaugucaugggacggaugcgaucuagacuacuacuguaacaugggcgacuggcccuccugcacguacaccggcgucacccaacauaaccacgcugcauucgugaaccuucucaacauugaaacagauuacacuaaaaccuuccacuuucacucaaaacgaguaacagcacacggcgacacuccccagcuagaccucaaggcaagacccaccuacggugcaggcgaaauaacaguccucgucgaaguagcagacauggaacuccacaccaagaaagucgagaucuccggccugaaauucgccucucuagcauguaccggcugcuacgcaugcuccagcggcaucagcugcaaaguccgaauccacguggacgaacccgacgaacuuacgguacacguaaagucuagcgacccagacgucgucgccgcauccaccucccucauggccagaaaacuagaguucggaacagacagcaccuuuaaagccuuuagcgcaaugccaaaaaccucccugugcuucuauauagucgaacgugaauacugcaaaagcugcucugaagacgacaccaagaaaugcguagacacuaaacucgaccaaccccaguccauacucaucgagcacaagggaacuauaauaggaaaacaaaacgacacgugcacagccaaagcauccugcuggcucgagagcgucaaguccuucuuuuacggccucaaaaacaugcucggauccguauucggcaacuucuucguaggcauacuccuauuccuagcccccuucguccugcugguccuauucuucauguguggauggaaauuucucuucuguuucaaaugcugccgccgaacccgcggccuauucaaauaccgucaccucaaagaugacgaagaaacagguuacagacgaaucaucgaaagacucaacuccaagaaaggcaaaaaucgucuacuagauggcgagcgccuggcugaccgcaaaaucgccgaacuguucuccaccaaaucccacauugga

SEQ ID NO: 15543 - RNA, 2916 nt, Artificial Sequence
  derived and/or modified CDS sequence (opt11) from CCHFV(37-R-2013, Artificial)__KR814858.1__Gn-4aa-Gc
agcgaagaaccuggcgacgacugcauaagccguacccaacuucuccgaacugagaccgccgaaauccacgacgacaacuacggcggccccggcgacaaaauuacaauuugcaacggcucaacaauuguagaccaacggcuuggaagcgaacuaggcugcuacacaaucaaccggguaaaaaguuucaaacuuugcgagaacucugccaccggaaagacaugcgaaauagauucuacucccgucaaaugccgccaaggauucugccucaaaaucacacaagaaggccgaggacacguaaaacugucaagaggcucggaaguaguuuuggacgcgugcgacaccucaugcgaaguaaugauacccaaaggcacaggagacauccuagucgauugcucaggcggccaacaacacuuucucaaagacaaccucaucgaucuaggcugcccccauaucccccuacuuggcaagauggcaauuuacaucugccgcauguccaaucacccccgcaccacgauggccuuccucuuuugguuuagcuucggcuacgucauaaccugcaucuucugcaaggccuuauucuacagccuuaucaucaucggcacccucggaaagaaaauaaaacaauaccgcgagcuuaagccacaaacaugcacuauaugcgaaacagccccaguaaacgcaaucgaugcugaaaugcacgaccucaacugcucauacaacaucugcccguacugcgccagcaggcucaccagcgacggacucgcccgucacgucccacaaugccccaagcgcaaagaaaaaguagaagaaaccgaacuauaccuaaaccuagagcgcauacccuggaucguacgcaaauuacuacagguauccgaauccacaggcgucgcccugaaacgaucaucuuggcuaauaguccugcuugucuuacuuaccguaagccucucccccguccaauccgcgccggucggccgcaaaccccuguuccucgauuccaucguaaagggcaugaaaaaccuccuaaacucaacaucgcuagaaaccucccuuuccauagaagcacccuggggagcaauaaacguacaauccaccuucaaaccaacugucuccaccgcgaacaucgcccucuccuggagcuccguagaacaucgcggcaacaaaauacucguaacaggcaggucagaaucaaucaugaaacuagaagaacgaacaggaguauccugggaccuagggguagacgacgcauccgagucaaagcuccucaccgugucuauaauggaccugucccagauguacuccccagucuuugaauaccucagcggugaccgacaaguagaagaauggccgaaagccacgugcaccggagacugccccgaacggugcggaugcacauccucgaccugccuacacaaagaauggccucauagccgaaacuggcgaugcaauccaaccuggugcuggggcgugggcacaggcuguaccugcugcggcguagacgucaaagaucuauucaccgaccauauguucgucaaauggaaagucgaauacaucaaaaccgaagccaucguaugcgucgagcugacaucccaagagcgccaaugcucccucauagaagccggcacacgauuuaaccugggaccaguaacaaucacccuauccgaaccacgaaacauucagcagaagcugccacccgaaauaauaacccuacaccccaaagucgaggaaggcuuuuucgaccucaugcauguacagaaaguacugagcgccuccacagucugcaagcuacaaagcugcacccacgguaucccaggcgaccuucagguguaccacauaggcaaccuacucaaaggcgacagagugaacggccaccucauccacaaaauugaaccccacuucaacacaucuuggaugucuugggacgggugcgaccucgacuacuacugcaacaugggcgacuggcccagcugcaccuauacaggaguaacccaacacaaccacgccgcauucguuaaccuacuaaacaucgaaaccgacuauacaaaaaccuuccauuuccacagcaaaaggguaaccgcccacggcgauacuccccaacuagaccuaaaggcccgacccacguacggagcgggcgaaaucaccguccucgucgagguagcagacauggaacuacacacaaagaaagucgagaucuccggccucaaauucgcaucacucgccugcacgggcuguuaugcauguucaucaggcaucuccugcaaagucagaauacacgucgacgagccugacgaacucacgguacacguaaaaucaaacgaccccgacgugguagcagcauccaccagccucauggcccgaaaacucgaguucggcaccgacucaaccuucaaagccuucuccgccaugccgaaaacaucgcuguguuucuacauagucgaaagggaauacugcaaauccugcucagaagaagauacacaaaagugcguagauacaaaacucgaacaaccccaaagcaucuuaaucgaacacaaaggaaccaucaucggcaagcaaaacguaacaugcaccgcuaaagccagcugcuggcuagaaucagucaagucuuucuucuacggccucaagaacaugcuaggaucagucuucggcaacuuuuucauaggcaucuuacucuuccucgcaccauucguccuccuaguccucuucuucauguucggguggaaaauacuauucugcuucaaaugcugccguagaacaagaggccuccuaaaauaucgauugcuuaaagacgacgaagaaacgggauacaggcgcaucauagaacgacuuaacaacaagaaagguaaaaacagacuacuagacggcgaacgccuagcugacagaaaaaucgccgaacucuucuccacaaaaacccacauuggu

SEQ ID NO: 15544 - RNA, 2916 nt, Artificial Sequence
  derived and/or modified CDS sequence (opt11) from CCHFV(44-ST-2010, Artificial)__KR814859.1__Gn-4aa-Gc
ucggaagaaccaggcgacgacugcaucagcagaacacaacuccucaaaacggaaacagccgagauacacgacgacaacuauggaggccccggcgacaaaauaacaaucugcaacggcagcaccaucgucgaccaacgccucggcagcgagcuaggcuguuacacgaucaaccgcgucaaauccuucaagcuaugugaaaacucugcaaccggcaagacaugugaaauagauuccacccccgucaaaugccgccagggauucugccugaaaaucacccaggaaggccgcggacacgucaaacuuagccgagguuccgaggucguucucgacgccugcgacucgagcugcgagauaaugauuccuaaaggcaccggagacauccuugucgacugcagcgggggccaacaacacuuccucaaagacaaccuaauagaccuagguugcccccacaucccacuccucgggaagauggccaucuacaucuguagaauguccaaucaccccagaaccaccauggcauuccuccuaugguucucauucggcuacguaaucacauguaucuuuuguaaagccuuauuuuacagccucaucauuaucggaacccuagggaagaaaauaaaacaguaccgcgaacucaaaccacagaccugcaccauaugcgaaaccgcaccaguaaacgccauagacgcggaaaugcacgaccucaauugcagcuacaacaucugccccuacugcgcaucaagacuaaccucagacggccuagcacgucacguuacucaaugcccaaaacgaaaagaaaaagucgaagaaacagaacucuaccucaaccuggagagaauaccauggaucguacgcaaacugcuacaaguauccgaguccacaggaguugcguuaaagcgcagcucguggcuaaucguacuacuuguacuccucacggucagccucagcccuguccaguccgcgcccguaggccgcaaaccccucuuccucgacuccauagucaagggcaugaaaaaccuccugaacucaacaagccucgaaacaucccuaucgauagaagcaccauggggcgccaucaacguacaaaguaccuucaaacccacugucagcaccgccaacaucgcacucuccuggucauccgucgaacaccgaggcaacaagauccucgucaccggacgauccgaauccauaaugaaacucgaggaacgcaccggcgucucgugggaccucggcgucgaagaugccagugaauccaaauuacucacagucagcauuauggaccucucccaaauguacagccccguauucgaauaccuaagcggugaccgccaagucgaagaauggccgaaagcuacauguacaggugacuguccagaacguugcgguugcacauccaguaccugccuccacaaagaauggccacacagccgcaacuggagaugcaacccuaccuggugcuggggcguuggaaccggauguaccugcugcggggucgacguaaaagaccuauucaccgaccauauguuuauaaaguggaaaguugaauacauaaagaccgaagcgauagugugcgucgaacucaccagccaagaacggcaaugcucacucaucgaagccggcacucgcuuuaacuuagggcccgucacaaucacacucucagaaccccgcaacauacagcaaaaacucccgcccgaaaucaucacucuucaccccaaaaucgaagagggcuucuuugaccucaugcacguacaaaagguacugucggccagcaccguuugcaaacuacaauccugcacacacgggaucccgggcgaccugcaaauauaccacaucggcaaccuccucaagggagaccgccucaacggccaccucauccacaaaauagaaccccacuuuaacaccuccuggauguccugggacggcugcgaccucgacuacuauuguaauaugggcgacuggccaucaugcaccuacaccgggguaacccaacacaaucacgcggccuucguuaaccugcucaacaucgaaacggacuacacaaagacauuccacuuccacucaaagagagucacagcccauggcgacacaccgcaacucgaccucaaagcccgccccacuuacggcgccggcgagaucaccguacucgucgaaguagccgacauggaauuacacacuaaaaaggucgagaucagcggucucaaauucgccucucucgcaugcaccgggugcuacgccuguucaucggggauaucaugcaagguccggauacacgucgacgaaccugacgaacuaaccguacacgucaaauccucagacccagacgucgucgccgcgucuacuagccucauggcucgcaagcuggaauuuggcacagacuccaccuuuaaggcuuucucagccaugcccaaaaccucccuuugcuucuacauagucgagcgcgaauacugcaaaucauguuccgaagacgauaccaagaaaugcgucgacaccaaacucgaucaaccccaauccauccuuaucgaacacaaagggacgauaauaggcaaacagaacgauaccugcacagcgaaagcauccugcuggcucgaaucaguaaaaucguucuuuuacggacucaaaaauaugcucggcucgguauuuggcaacuucuucgucggcauacuccucuuccuagcacccuuuguccuauuaguccuuuucuucaugugcggguggaaaauccucuucugcuucaaauguugccgaagaacccgcggacuauucaaauacaggcacuuaaaagacgacgaagagacaggcuaccgccgcauaaucgagagacucaacucgaagaaaggcaaaaaccgccuccucgacggagaacgacuagccgaccgcaaaaucgcggaacucuucuccaccaaaucacacauagga

SEQ ID NO: 15545 - RNA, 2916 nt, Artificial Sequence
  derived and/or modified CDS sequence (opt11) from CCHFV(46-ST-2012, Artificial)__KR814860.1__Gn-4aa-Gc
agugaggaacccggugaugacugcauuagucgcacccagcuccuacggaccgagacggccgagauccacgacgacaacuacgggggcccgggggacaagaucaccaucugcaacggcucgacuaucguggaccagagacugggaucggagcugggcugcuacacuaucaaccgggucaagagcuucaagcucugcgagaacucagccacggguaagacaugcgagauagauucaacccccgugaagugccgccagggguucugccugaagauuacccaggaaggccgggggcacgugaaguugucccgcggcucugaaguaguguuggacgcgugugacuccagcugcgaggugaugauccccaaagguacgggggauauccuggucgacugcuccggcgggcaacagcacuuccugaaagacaaccucaucgaccugggaugcccgcacaucccucugcucgggaagauggccaucuacaucugcagaaugagcaaccacccccgcaccaccauggcguuccuguucugguucuccuucggcuacgugaucacuugcauauucuguaaggccuuauucuacucacucaucaucaucggcacccuggggaagaagaucaagcaguaccgggagcugaaaccccagacauguacgaucugcgagaccgccccagugaacgcgaucgacgccgagaugcacgaccucaacugcuccuacaacauaugcccguacugcgccucacgccugacguccgacggccuggcccggcacgucccccagugccccaagcgcaaggaaaagguugaggagaccgagcucuaccuuaaccuugagcggaucccuuggaucgugcgcaagcuccugcaggucagcgaguccacggggguagcgcugaagcgaagcagcuggcucaucgugcugcugguucuccugacuguuagucugagcccagugcaguccgcccccgucggccgcaagccccucuuccuggacagcaucgugaaggggaugaagaaccugcucaacuccacgagccuagagaccucccugucuaucgaagcaccguggggcgccaucaacguucaguccaccuucaaaccgacugucagcacggcgaacaucgcgcucuccuggagcuccguggaacaccggggcaacaagauccuggugacagggcgcagcgaguccaucaugaagcuggaggaacgcaccggcgucagcugggaccucgggguggaagacgccuccgagagcaagcugcugaccgucuccaucauggaccucagccagauguacucacccgucuucgaguaucuguccggcgaccgccagguggaagaguggcccaaggccacguguaccggggacugucccgagcgguguggcugcaccagcuccacgugccugcacaaggaguggccacauagcaggaacuggcgcugcaaccccaccuggugcuggggcgucggcaccggcugcacgugcugcgggguggacgugaaggaccucuucaccgaccauauguucgucaaguggaagguggaguauaucaaaaccgaggcuauugucugcgucgagcugaccucccaggagcggcagugcucucugauagaggcuggcacccgcuucaaccuggggcccgugaccaucacccucuccgagccccggaacauccagcagaaguuaccgcccgagaucaucacgcugcauccaaagguggaggagggcuucuucgaccucaugcacguccagaaggugcuaagugcguccaccgugugcaagcugcagagcugcacccacggcauccccggggaccuccaagucuaccacaucggcaacuugcugaagggggaccgcaucaacggccaccucauccauaagaucgagccgcauuuuaacacauccuggaugagcugggacggcugcgacuuggacuacuacuguaacaugggggacuggcccuccugcacguacacuggcgugacccagcacaaccacgccgcguucgugaaccugcucaacaucgagaccgacuacaccaagaccuuccacuuccacagcaagcggguaacagcccacggggacacaccccaacuggaccugaaggcgcgcccgaccuacggcgcgggggagaucaccgugcucguggagguugccgacauggagcugcacaccaagaagguggagaucaguggccugaaguucgccagccucgccugcaccgggugcuacgccugcucuagcgggaucagcugcaaggugcggauccaugucgacgagcccgacgagcugacgguccacgugaaguccagcgaccccgacgucguggcagccuccaccagccucauggcccgcaagcucgaguucggcaccgacucgaccuucaaggccuucagugcgaugccuaagacuucccugugcuucuacaucguggagcgggaguacugcaagagcugcuccgaggaggacacccagaagugcgucgacacccggcuagagcagccgcagagcauccucauagaacacaaagggaccaucaucggcaagcagaacgacacgugcaccgccaaggcauccugcuggcuggaguccgucaaguccuucuuuuacgggcugaaaaacaugcugggcagcguguucggcaauuucuucauaggcauccugcuguuucucgcccccuuugugcuacugguccuuuucuucauguucggcuggaagauccucuucugcuucaagugcugcaggcgcacccgggggcugcucaaguaccgccaccugaaggacgacgaggaaaccggcuaccggcgcauuaucgagcggcugaacaacaagaaggggaagaaccgccuccuggacggagaacgccuggccgaucgcaaaaucgcggagcuguucuccacgaagacccacauaggc

SEQ ID NO: 15546 - RNA, 2916 nt, Artificial Sequence
  derived and/or modified CDS sequence (opt11) from CCHFV(47-ST-2013, Artificial)__KR814861.1__Gn-4aa-Gc
agcgaggagccuggcgaugacugcauaucccgcacgcagcugcucaagaccgaaacggcggaaauccacgacgacaacuacgggggcccgggggacaaaaucaccauaugcaacggcuccaccaucgucgaccagcggcugggcuccgagcugggcuguuacaccaucaaccgcguuaagagcuucaagcugugcaagaacuccgccaccggcaagaccugugagaucgauagcacuccagugaagugccgucaaggguucugccugaagaucacacaagaaggccgcgggcacgugaagcucucccggggcagcgaggucguacuggacgcgugcgacuccagcugcgagaucaugaucccgaaggggacgggcgauauccugguggacugcuccggcggccagcagcacuuccugaaggacaaccucaucgaccugggcugcccccacaucccguugcucgggaagauggccaucuacaucugucguaugagcaaccacccucggaccacuauggcauuccuguucugguucucguucggcuaugucaucacguguaucuucugcaaggccuuguucuacucacucaucaucaucggcaccuuagggaaaaagauuaagcaguaccgcgagcucaagccccagacgugcaccaucugcgagaccgcccccgugaacgcuauugacgccgagaugcacgaccucaacugcuccuacaacauuuguccguacugcgcuagccggcugaccuccgacggccuggcccgccacgugacccagugucccaagcguaaagagaagguggaggagaccgagcucuaccucaaucuggagcgcaucccuuggauuguccggaagcuccuccaagugagcgaauccaccggcguagcacugaagcggagcagcuggcugauagugcugcugguguugcugacgguauccuugaguccagugcagucugccccggugggccggaaaccccucuuccuggacagcaucgucaagggcaugaagaaccugcucaacaguaccagccuggagaccucccugucaaucgaagcccccuggggcgcuaucaacgugcaguccaccuucaaacccaccgucuccacagccaacauagcucucuccugguccuccgucgagcaccgcggcaacaagauccuggugaccgggcgaagcgaguccaucaugaaacuggaggagcgcaccggcgucuccugggaccucggcguggaggacgccuccgagagcaaacugcugacgguguccaucauggaccugagccagauguacagcccggucuucgaguacuuguccggggaccgccagguggaggaguggcccaaggcgaccugcaccggggagugcccggagcggugcggcugcaccaguuccacaugcuugcauaaggaguggccccacagccggaacuggcgcugcaaccccaccuggugcuggggcguggggaccggcugcacgugcugcggcgucgacguuaaggaccucuucaccgaccacauguuuaucaaguggaaaguggaguacauaaagaccgaggccaucguuugcguggagcugaccucccaggagcgccagugcagcuugaucgaggccggcacgcgguucaaccuggggcccgucaccaucacgcucuccgagccccgcaacauccagcaaaagcugcccccugagauaaucacacugcacccuaagaucgaggagggguucuucgaccuuaugcacguccagaagguacugagcgccuccaccgucugcaagcuacagagcugcacccacggcauccccggggaccuccagauauaccauaucggcaaccugcugaagggggaccgggucaauggccaucucauccacaagaucgaaccccacuucaacacguccuggauguccugggacggcugcgaccuagauuacuacugcaacaugggcgacuggccguccugcaccuacaccggcgugacucagcacaaccacgccgccuucgugaaccugcucaacaucgagacggacuacaccaagaccuuccacuuccacagcaaaagagucacggcacauggggacacgccucaacuggaucugaaggccaggcccaccuacggcgcgggggaaaucaccguguugguggaggucgccgacauggagcugcacaccaaaaagguggagguuagcggccugaaauucgccagccucgccugcacgggcugcuaugccugcuccagcggaaucucuugcaagguaagaauccacguggacgagccggacgagcugaccguccacgucaaguccagcgaccccgacgugguugcugcuuccaccagcuugauggcccggaagcucgaguucggcacagacuccacguucaaggccuucagcgcgaugcccaagaccucccugugcuucuacauugucgagcgugaguacugcaaguccuguuccgaggaugacaccaagaagugcguugacaccaagcuggagcagccccaaagcauccucaucgaacacaaggggacgaucaucgggaagcagaacgacacgugcaccgccaaggccucuugcuggcuggagagcgugaaguccuucuucuacggcuuaaagaacaugcucggcagcgucuuuggcaacuucuucguggggauccugcuguuucuggccccuuucguccugcugguccucuucuucauguuuggcuggaagauccuauucugcuuuaaaugcugccggcgcacucggggucuguucaaguaccgccaccucaaagaugacgaggaaaccggauaccgucgcauaaucgagagacugaacuccaagaagggcaagaaccgccugcucgacggcgagcggcuggccgauagaaagauagcggagcuguucagcacuaaaacccauaucggu

SEQ ID NO: 15547 - RNA, 2916 nt, Artificial Sequence
  derived and/or modified CDS sequence (opt11) from CCHFV(52-R-2014, Artificial)__KR814862.1__Gn-4aa-Gc
ucugaagaaccaggcgacgauugcaucucacgaacccaacuacuacgcaccgagacugcagaaauacacgaugauaacuauggagggccuggagacaaaaucacaauaugcaacggcagcacuaucgucgaccagcgccucggcagcgaauuaggcugcuacacaauaaaucguguaaaaucuuucaaacugugugaaaacucagcaaccgguaaaaccugcgaaaucgacucaacuccggucaaaugcagacaaggcuucugccugaagaucacccaagaaggacgaggucacgucaaacugagccgcggcucggaagucguccuagaugcaugcgacaccucaugugaggucaugauccccaaaggaaccggugacauccuaguggacugcucaggcggacaacaacacuuccucaaagacaaccugaucgaccucgggugcccgcacguaccucuacucggcaagauggcuaucuacaucugccggaugucgaaccacccccgcaccaccauggcauuccuauucugguucuccuucggauacguaaucaccuguauauucugcaaagcccuguucuauucacucaucaucaucggcacucugggcaagaagauuaaacaauauagagaacuaaaaccacaaaccuguaccauaugcgaaacagcccccguaaaugccauagacgccgaaaugcacgaccuuaacugcagcuacaacaucugccccuacugcgccagccgccuaacauccgacggccuggcgcgccacgugccgcagugcccaaaacgcaaggaaaagguagaagaaaccgaacucuaccucaaccucgaacgaauaccauggaucgugcggaaacuccuacaaguaagcgaaucgaccggcgucgcacuaaaaagaucauccuggcuaaucguacuccuaguccuacuaacggugucccuaucccccguacaaagcgcgccagucggucggaaaccccucuuccuagacaguauuguuaaagggaugaaaaaucuccugaacuccacuucccuagaaacaucacucucgauugaagcgccauggggagcaauaaaugugcaauccaccuucaaacccacaguaucuacugcuaacaucgcucuauccugguccagcguggagcaucgcggcaacaaaauccuuguuaccggucgcucagaauccaucaugaaacucgaagaacgaacgggggucagcugggaccuaggagucgaugaugcaucugaaagcaaauuacugaccguuucaaucauggaccuaucucaaauguacucccccguauucgaguaccuauccggugaccgccagguugaagaauggcccaaagcaaccugcacgggcgacugcccagaacggugcggcugcacuucgucuaccugccuucacaaggaauggccccauucccgcaacuggcgaugcaaccccaccuggugcuggggugucggcaccggcuguaccugcugcggcguagacguaaaagaccuuuucacugaccacauguucgucaaguggaaggucgaauacaucaagacagaagccauagucugcgucgaacuaaccucccaagaacgacaaugcucccuuaucgaagccggcacacgcuucaaccuaggcccagucaccauaacucuauccgaaccacgcaacauucaacaaaaacuaccgcccgaaauaaucacccuccaccccaaaguagaggagggauucuucgaccuaaugcacgugcaaaaaguacucagcgccucgacaguguguaaacuccaaaguugcacccacggcauccccggcgaccuccagguguaccacaucggcaaccuucuaaaaggcgacagaguaaacgggcaccucauacacaaaaucgaaccgcauuucaacaccucauggaugucaugggacggcugcgaccucgacuacuacugcaacaugggcgacuggcccuccugcaccuacaccggcgugacccaacacaaccacgccgccuucgugaaccuacucaacauagaaacggacuacacaaagaccuuccacuuccacucaaaacgcguaacagcccacggagacaccccgcaacucgaccuaaaagcccgcccaaccuacggcgccggagagauaacgguucuaguagaaguagccgacauggaacuacacacaaagaaaguagagauauccggccucaaauucgccagccuagcgugcaccgguuguuacgcaugcuccucuggcauauccugcaaaguccgcauacaugucgacgaaccggaugaauuaacaguacacguuaaaucuaaugacccagacgucguagcagccuccaccagccuuauggcacgaaaacuagaguucggcaccgacuccaccuuuaaagcauucuccgcgaugccgaaaaccucgcucugcuucuacauaguagaaagagaauacugcaaaucuuguuccgaagaagacacccaaaaaugugucgacacaaaacucgaacaaccacagucgauccucauagaacacaaagguacaauuaucgggaaacaaaacgacacuugcacagcaaaagccgggugcuggcucgaaagcguaaaauccuucuuuuacggccuaaagaauaugcucggcuccguuuucggcaauuucuucaucggaauccuccuauuccuagccccauucgucuuacucguccuauucuucauguucgguuggaaaauccuauucugcuucaaaugcugccgccguacgcgcgggcuacuuaaguaccggcuccucaaggacgacgaagagacuggauaucgucgcauaauagagagacuuaacaacaagaaaggcaaaaaccggcuacuggacggcgaacgccucgccgacagaaaaaucgcugaacuauucucaacgaaaacacacauaggc

SEQ ID NO: 15548 - RNA, 2916 nt, Artificial Sequence
  derived and/or modified CDS sequence (opt11) from CCHFV(75-R-2012, Artificial)__KR814863.1__Gn-4aa-Gc
uccgaagaacccggcgacgacugcaucucccgcacacaacuacuacgcacagaaacggcugagauccacgacgacaacuauggcggccccggagacaaaaucaccaucugcaacggcuccaccaucguggaucaacgccugggcucggaacucggaugcuacacgaucaacagagucaaaucauuuaagcuaugcgaaaacuccgccaccgguaaaacaugugagauagacagugcgccaguaaaaugccgucaaggcuucugccucaaaauaacacaggaaggccgaggacacguaaaacuaagccgcggcuccgaagucguacucgaugcaugcgacagcuccugcgaagugaugaucccaaaaggcaccggcgacauacucgucgacugcagcggaggacaacaacacuuccucaaagacaaccucauugaccuuggaugcccccacaucccccuccucggcaagauggccaucuacauaugcagaauguccaaccauccccguacaaccauggcauuccuauucugguucuccuucggcuacgugaucacauguauauucugcaaagcccucuucuacucguuaauaaucaucggaacccuaggcaagaaaaucaaacaauaccgcgaacucaaaccacagacaugcaccauaugcgaaacugcccccgucaacgcaaucgacgcagaaaugcacgaucucaacugcuccuacaacauaugccccuacugcgcaagccggcugaccucugacggccuugcacgacauguuccucaaugccccaagcgcaaggaaaaagucgaagaaacagagcuauaccucaacuuagaacggaucccguggauuguccgcaaacugcuucaagucucagaaagcaccggcgucgcccucaagcgaucaaguuggcucauaguccuccuaguguuauuaacagugagccugagccccguccaaucugcacccgugggccgcaaaccccuauuccucgacagcauagugaagggaaugaaaaaccuacucaacucaaccucgcucgaaaccucgcuuuccauagaggccccuuggggagcaauuaauguucagucaaccuucaaaccaaccgucagcaccgcaaacauugcauuaucauggucauccguggagcauagaggaaacaaaauacugguuacaggucggucagaaagcaucaugaaguuagaagaacguacgggcguaucgugggaccucggcguagaagacgccagcgaaagcaagcuacucacugucagcaucauggaccuaagccaaauguacuccccuguauucgaauaccucucgggggaccgacaggucgaagaauggccaaaagccaccuguaccggcgacuguccugagcgaugcggauguacuucaucuaccugccugcacaaagaauggccacauuccagaaacuggcgcugcaacccaaccuggugcuggggcgucggaaccgggugcacaugcugcggcgucgacguuaaggaccuauucaccgaccacauguucgucaaauggaaggucgaguauaucaaaacagaagcgaucgucugcgucgaacucaccucccaagaacgucaaugcucgcucaucgaagccggcacccgcuucaacuugggcccggucacaauaacgcuaagcgagccacgaaacauccaacagaaacuacccccugaaaucauaacccuccaccccaaagucgaggaaggcuucuucgaccuaaugcacguccaaaagguccugucagccucuaccgucugcaaacugcaaagcugcacccacggcaucccaggcgaccugcagguauaccauauuggaaaucucuuaaaaggcgaccgcgucaacggacaccuuauacacaagauagaaccccacuucaacaccucuuggaugagcugggacgguugcgaccucgauuacuacuguaacaugggugacuggcccucaugcaccuauacaggaguaacgcaacauaaucacgccgccuucgucaaucugcucaacauagaaacagauuacaccaaaaccuuccacuuccacucaaaaagaguaacagcacacggcgacacgccccaacuggaucugaaagcccgacccacauacggagccggugaaauuaccguccucguagaagucgccgacauggaacuccacacgaagaaagucgagaucuccggacuaaaauucgcaucgcuagccugcacaggcuguuacgccugcucaucuggaaucaguugcaaaguccgcauucauguagaugaacccgacgagcucacgguccacgucaaaucauccgauccagacgucguagccgcaucaacaucucuuauggcgcguaaacucgaguucggcaccgacucgacauucaaagccuucuccgcaaugcccaaaacgucacucugcuucuacauuguagaaagggaauacugcaaaucgugcuccgaagaagacacccaaaaaugcgucgauacgaaacuugagcaaccacaaucaauucuaaucgaacacaaaggcaccaucauagguaaacagaacgauacaugcaccgccaaagcaagcugcuggcuagaauccgucaagagcuuccucuacgggcucaaaaacaugcugggcuccgucuucggcaacuucuucauuggcauauuacucuuccucgcccccuuuguacuacucguccuguucuucauguucgguuggaaaauacuauuuugcuucaaaugcugccgacgcacccgaggacuccucaaauaucgacuccucaaagaugacgaagagaccggguaccgacgcaucaucgaacgucuaaacaauaagaaaggcaaaaaccgccuacuagacggagaacgacuggcggacagaaaaauugccgaacucuucagcacgaaaacccacauagga

SEQ ID NO: 15549 - RNA, 2916 nt, Artificial Sequence
  derived and/or modified CDS sequence (opt11) from CCHFV(75-ST-2010, Artificial)__KR814864.1__Gn-4aa-Gc
uccgaagaaucuggcgacgacugcauuucccgcacgcaacuucuuagaaccgaaaccgcagaaauacaugacgacaacuacgggggacccggagacaaaauaaccauaugcaacggcagcacaaucguggaccagcgccucggcuccgaacucgguugcuacaccauaaaccgugucaaaucauucaaacucugcgaaaauuccgcgaccggcaaaaccugcgagaucgacagcaccccagucaaaugccgacagggcuucugccucaaaauaacacaagagggccgaggacacgugaagcucucccgaggcucugaagugguccucgacgcuugcgacucgagcugcgaagucaugauuccuaaagguacaggggacauacuuguggacugcucgggcggucagcagcacuuucugaaggacaaccucaucgaccuaggcugcccacacauaccccuacucggaaaaauggccauauacaucugccgaauguccaaccaccccagaaccaccauggcguuccuauucugguucuccuucggcuacgugauuaccugccuguucugcaaagcccucuucuacucacucauaaucaucggcacccucggcaagaaaaucaaacaauacagggaacuccguccgcagaccugcacaaucugcgaaacggccccugucaacgcaaucgacgccgaaaugcacgaccuuaacugcuccuacaacaucugcccauacugugccagccgacuaacauccgacggacuagcacgccacguaccccagugcccaaaaaggaaggaaaagguagaagaaacggagcucuaccucaaucuagaacggaucccauggaucguccgaaaacuccuacaaguguccgagucaacaggaguagcucuaaaaagauccucuuggcuaauaguccuacucguacuacuaacaguuucacuaucccccguucagagcgcacccgugggccgaaaaccacuauuccucgacuccauagucaaagguaugaaaaaccuccucaacucaaccagccuagagacuucguuaagcauagaagccccauggggcgcuaucaacguccaauccaccuuuaaaccuacuguauccacugcuaacaucgcccuauccuggucaagcguagaacaccgcggcaacaaaauccucgucacgggcagguccgaaagcauaaugaaacucgaagaaagaaccggcguauccugggaccuaggcguagaagacgcaucggaauccaaauuacucacagugagcaucauggaccuaagccaaauguacucccccguauucgaguaccucucuggggaccgucaaguagaagaauggccuaaagcaaccugcacuggcgacugccccgaacgaugcggcugcaccagcuccaccuguuuacacaaagaguggccucacucccgaaacuggcgcugcaacccaacauggugcuggggcguuggcacuggcuguaccugcugcggcguagacgucaaagaccuauucaccgaccacauguucguaaaauggaaggucgaauacaucaaaaccgaagccauagugugcgucgaacuuaccucccaagaacgccaaugcucucuaaucgaagccggcacccgcuucaaccugggcccagucaccaucacccucucagaaccccgaaacauccaacagaaguuaccgcccgagauaaucacccuccacccaaaaguagaagagggauuuuucgaccucaugcacguccaaaagguacuaucagccagcaccguaugcaaauuacaaucuugcacacacggcaucccaggcgaucuccaaguauaccacauugggaaccuacucaagggcgaccgggucaauggacaucuaauacacaaaaucgagccccacuucaacacuagcuggaugucuugggacggcugcgacuuagacuacuacugcaacaugggagacuggcccuccugcaccuacacuggcguuacacagcacaaccacgccgcuuucgucaaccuacuaaacaucgagacagacuacaccaaaacguuccauuuccacucaaaacgcguaacagcccacggugacacgccccaacuugaccugaaagcucgaccgacguacggcgcaggcgagaucacgguucuggucgaagucgccgacauggaacuccauacaaagaaagucgaaauaagcggccucaaauucgcaucgcuagcuugcaccggcugcuacgccugcagcucaggcaucuccugcaaagucagaauccacgucgacgaaccagacgaacucacaguccacgucaaaagcagcgauccugacguagucgccgccucgaccucccuuauggcccgaaagcucgaauuuggaacggacuccaccuucaaagccuucuccgcaaugcccaagacgagccuuugcuucuauauaguggagcgagaauacugcaaguccugcagcgaagaagauacacaaaaaugugucgacaccaagcuagaacaaccgcaauccauccucauagaacauaaaggcaccaucaucgggaaacaaaacgauaccugcacagccaaggccucgugcuggcucgaauccgucaaaucauucuucuacggcuugaaaaacaugcuaggguccguauucgggaauuucuuuauaggcauccuccucuuccuagcucccuucguacuucuaguccuauuuuucauguucggauggaaaauccuauucugcuuuaaaugcugccgacgcgcgcgcgggcuccugaaauaccgccaccuaaaagacgacgaagagacaggcuaccgcaaaaucaucgagcgacugaacaacaagaaaggcaaaaaccgacuucucgacggugagcggcuagcggacaggaaaaucgcagaacuuuucagcacaaaaacacacauagga

SEQ ID NO: 15550 - RNA, 2916 nt, Artificial Sequence
  derived and/or modified CDS sequence (opt11) from CCHFV(3756-ST-2007, Artificial)__KR814866.1__Gn-4aa-Gc
ucagaagaacccggagacgacugcaucucaagaacccagcuccucaaaacggaaacugcagaaauccaugacgacaacuacggaggucccggcgacaaaaucaccaucugcaauggcucuaccaucguagaccagcgccuaggcuccgaauuaggcugcuacaccaucaacagaguaaaaucauucaaacucugcgaaaauagcgccaccggcaaaaccugcgaaauagacucaacuccagucaaaugccgccagggcuucugcuuaaagauaacacaagaggggcgcggacauguaaagcuaagccgcggaucggaaguaguccucgaugcgugcgauucauccugcgaaaucaugaucccaaaggggacaggagacauccucguugacugcagcggcggccaacaacacuuccucaaagacaaucuaaucgaucuuggcugcccccacaucccccuccuagggaagauggccauauacaucugcagaaugucgaaccacccccgcacaaccauggcauuccucuuuugguucuccuucggauacgucauuacuugcauuuucugcaaagcgcuauucuacucccuuaucaucauaggcacacuaggaaagaaaaucaaacaguaccgcgaacuuaaaccccagaccugcaccauaugcgaaacugcucccguaaaugcgaucgacgcggaaaugcacgaucuaaacuguagcuacaacaucugucccuacugugccucgcggcucacguccgacgggcucgcacggcacguaacccaaugccccaaacgcaaagaaaaaguagaagaaacagagcucuaccucaaccuggaaaggauccccuggaucguacgcaagcuccuacagguaagcgagucaaccggcgucgcuuugaaaagauccucuuggcucaucguccuacucgugcuccucaccgugucccuauccccaguacagucagcgcccgugggacgcaaaccccuauuucucgacaguaucgucaaagguaugaaaaaccuacucaacucaacaucucuagaaacuucccuaucaauagaggcccccuggggcgccaucaacguacaauccacauucaaaccgaccgucagcacggccaacaucgcccuuucauggagcagcguagaacaccgcggaaauaaaauacucgucacgggccgcuccgaaagcaucaugaaauuagaagaacgcaccggggucagcugggaccugggcgucgaagacgccuccgagucgaaacuacuaaccgucuccauaauggaccuaucucaaauguauuccccuguauucgaguaccuuuccggggaccgccaagucgaagaauggccuaaagccacuugcacaggugacugcccugaacgcugcggcugcacuucaagcacaugccugcacaaggaguggccccacucccgaaacuggcgauguaaccccacauggugcugggguguaggcacgggcuguacaugcugcggcgucgacguaaaggaucucuuuacagaccacauguucaucaaguggaaaguggaguacaucaaaacagaggcgaucguaugcguagaacuaacuagccaggaaagacaaugcucucucaucgaagccggaacacgcuucaaccugggccccgucacaauuacacucucggaaccccgaaacauccaacaaaaacuaccucccgaaauaauaacacugcaccccaagaucgaagagggcuucuuugaccuaaugcacguacaaaaaguucucuccgcgagcaccguaugcaaacuacaaucgugcacacacggcauacccggcgaccuccaaauauaccacaucggcaaucuccuaaaaggcgaccgaguaaacggucaccucauucacaaaauagaaccccacuucaacaccagcuggaugagcugggauggcugcgaccuagauuacuacuguaacaugggagacuggccuucaugcacguauacggguguaacacagcacaaccacgcggccuucguaaaccuccucaacauagagaccgacuacacgaaaacauuccacuuucacuccaaacgggugacggcgcacggggacacgccccaauuagaucucaaggcacggcccaccuacggggcaggagaaaucaccguucuaguggaagucgccgacauggaacuccacacuaaaaaggucgaaaucuccggccucaaauucgccucccucaccuguaccggcugcuacgcaugcucgagugguaucagcugcaaaguccgcauccacgucgacgaacccgacgaacucacaguccauguaaaguccuccgacccggacguagucgcugccucaacgucacuaauggcccgcaaacuggaguucggcaccgacucaaccuucaaagccuucagcgcaaugcccaaaacaucacuaugcuucuauauugucgagcgagaauacuguaaaagcugcuccgaagacgauacaaagaaaugcgucgacaccaaacucgagcaaccacaaucgauccuaauagaacacaaaggcaccauaaucgggaaacaaaacgauaccugcacagccaaagccucaugcuggcuagaaagcguaaaaucguucuucuacggccucaagaacaugcuagggucaguauucggcaguuucuucgucggaauacucuuauuccucaccccguucgugcuccuaguacuauucuucauguucgguuggaaaauccuauuuugcuuuaagugcugccgccguacgcgcggacuauucaaauaccgacaccucaaagacgacgaagaaacuggguacaggagaauaauugagcgccuaaacucgaaaaaggggaaaaaccggcuccuagacggcgaacgccuugcagaccgaaaaauagcggaacucuucucaacgaaaacccauauaggc

SEQ ID NO: 15551 - RNA, 2916 nt, Artificial Sequence
  derived and/or modified CDS sequence (opt11) from CCHFV(3809-ST-2007, Artificial)__KR814867.1__Gn-4aa-Gc
uccgaagaacccggagacgacugcauaagcagaacucaacuccuucgcaccgaaacagccgaaauccacgacgacaacuacggaggcccaggcgacaaaauuaccauauguaacggcucuaccauaguagaccaacgacuaggcuccgaacuaggcugcuacaccaucaaucgcgugaaauccuucaaauugugugagaacagcgccacuggaaaaaccugcgagaucgacagcacaccaguaaaaugccgacaaggcuucugccucaaaaucacccaagaaggcagaggccacguuaaacuuucacgcggcuccgaagucguccucgacgccugugacucuuccugcgaaguaaugaucccuaaaggcacuggggacauccucguggacugcuccgguggccaacaacacuuccuaaaagacaacuuaauagaccucgggugcccccauaucccccugcucggcaaaauggcuaucuacauaugucgaauguccaaccacccucgaaccaccauggccuuccuguucugguucuccuucggcuacguaauaacaugcaucuucugcaaagcauuauucuacucacucaucaucaucggcacccucggcaagaaaaucaagcaauaccgcgaacucaaaccacaaacuugcacuaucugcgaaaccgcccccguaaacgcaaucgacgcugaaaugcacgaccuuaacugcuccuacaacaucugcccguacugcgcaucccgacuaaccuccgacggccuagcacgccacgucccacaaugccccaaacgcaaagaaaagguagaagaaaccgaacucuaccucaaucuagaacgcauccccuggauaguccggaaacuucuacaaguuucagaaucaaccggaguugcccuuaaacgcucauccugguuaaucguguuacuuguacuucugaccguuagucucucaccaguccaauccgccccuguaggccgcaagccccucuuucucgacucaaucgugaaaggcaugaaaaaccuccuaaacuccacaucccucgaaaccucuuuaagcaucgaagccccuuggggcgcgaucaacguucaauccaccuucaaaccaaccgucuccaccgcuaacaucgcccucaguugguccucaguagaacaccgcggcaacaagauccucgucacaggccgcucugaaucaaucaugaaacucgaggaacguaccggagucuccugggaccucggcgucgaggacgccucagaauccaaacuacucacagucagcauuauggacuugucccaaauguacucaccagucuuugaauaccugucgggcgaccgacaagucgaggaauggccaaaggccacaugcaccggcgacugccccgagcggugcggcugcacgucuagcaccugucuacacaaagaguggccgcacucacgaaacuggcguugcaacccgacauggugcuggggugucggaacuggcuguacuugcugcggcgucgacguaaaggaccucuucaccgaccacauguucgucaaguggaaagucgaguacaucaaaacagaagcgaucguaugcguagagcugaccucccaagaacgacaaugcucccucaucgaagcaggcacccgcuucaacuuaggccccgucaccauuacccuauccgaaccgagaaacauacaacaaaagcucccucccgagauuauaacccuucaucccaaagucgaagaaggcuucuuugaccucaugcacguccaaaagguacugucugcaagcaccguaugcaaacuacaauccugcacucacggaauaccaggugaccuucagguauaccacauagguaaccuacuuaaaggcgaccgagucaacggacaccucauccacaaaaucgaaccccacuucaacaccagcuggauguccugggacggcugcgaccuagacuauuacugcaacaugggcgacuggcccuccugcacuuacacgggggucacacaacacaaccaugcagcguuuguaaaccuucuaaacaucgaaacagacuacacaaaaacuuuccauuuccacaguaaacgcguaacugcacacggggacaccccacagcucgaccucaaagcacgccccacauacggagccggagaaaucaccguccucguagaaguagccgacauggaacugcacacaaagaagguagaaauuucgggccuaaaguucgcuucccucgccuguacaggaugcuacgcaugcucgagcggaauauccugcaaaguacgcauccacguagacgagccagacgaacucacaguucauguaaagucaagugacccggacgucguagccgcuagcaccuccuuaauggcacgcaaacucgaguucggcacugacucaaccuucaaagcauuuagugccaugccaaagaccagccucugcuucuacaucguagaaaaagaauacugcagaucaugcuccgaagaagacacgcaaaagugcgucgacacaaagcucgaacagccccaaagcauacucaucgaacacaaaggcaccauaaucgguaaacaaaacgauaccugcacggccaaagccucaugcuggcucgaaucugucaagagcuuuuucuaugggcucaaaaacaugcuugguuccgucuucgggaauuucuucaucggcauacuuuuauuccuaacacccuucguacuucuaguacucuucuucauguucggcuggaaaauccucuucuguuucaaauguugccgucgaacacggggccuccucaaauaccgccaucucaaagacgacgaggaaacuggcuaccgccgaaucauagagcgccucaacaacaagaaaggcaaaaaucgacuccucgacggagaacgccucgcugaccggaaaauugcagaacucuucuccaccaaaacacacaucggu

SEQ ID NO: 15552 - RNA, 2916 nt, Artificial Sequence
  derived and/or modified CDS sequence (opt11) from CCHFV(3820-ST-2007, Artificial)__KR814868.1__Gn-4aa-Gc
agcgaggaaccaggugacgacugcauaucccguacccaacuccucaagacagaaaccgcagagauacacgacgacaacuacggaagcccgggagauaagaucacaaucugcaacggaagcacgauagucgaccaacgacucgggucagagcuaggcugcuacacaauaaacagagucaagucguucaaacuaugcgaaaacagcgccacuggcaagacuugcgaaauagacagcacgccugucaaaugccgacaggguuucugucuaaaaauaacacaagagggccgcgggcacgugaaauuaucccgcggaagcgaaguaguccuagaugccugcgacagcagcugcgaaauaaugauacccaagggaacaggggacauccugguggacugcagcggcggccaacaacacuuccugaaagacaaccucauugaccugggaugcccacacaucccccuacucggaaagauggccaucuacaucugccgaaugucaaaucacccccgaacaacaauggcguuccuauucugguucucauucggcuacgucauaacuugcauauucugcaaggcccucuucuauagucuaauaaucauuggcacccuggggaaaaagauaaaacaauaccgcgaacucaaaccccagaccugcacaauaugcgagaccgcccccguaaacgcgaucgacgcggagaugcacgaccuaaacugcagcuacaacauaugccccuacugcgcuagccgucuaacaagcgacggacucgcccgccacgucacccaaugccccaaacgaaaagaaaaggucgaagaaacagaacucuaccucaaccuugaacgcauucccuggaucguacgaaaacuccuccaaguauccgaguccaccggcguggcccucaagcgauccagcuggcucaucguccuacucguccuacucgcaguaucgcucagccccguacaaagcgcaccaguaggcagaaagccccuauuccuagacucaaucguuaaaggcaugaaaaaucuacugaacuccacaucgcuagagacuucacuguccaucgaagcccccuggggcgccauaaacguacaaagcacauucaagccaaccgucuccaccgcaaacauagcccucucaugguccagcguagagcacagagggaacaaaauccucguaaccggucgcucagagaguaucaugaagcuagaagaacggacaggcgucucaugggaccuagggguagaagacgcaagcgaaucaaagcuacuaacaguauccaucauggaccugucccaaauguacucuccggucuucgaauaccucucuggagacagacaagucgaggaauggccgaaagcuaccugcacaggagacuguccagagcgcugcggcugcaccuccucuaccugccuccacaaagaauggccccacucacgcaacuggagaugcaacccaaccuggugcuggggcguggggacaggcugcacaugcugcggcgucgacgucaaagacuuguucaccgaccacauguucaucaaauggaaagucgaauauaucaaaaccgaagcaaucgucugcgucgagcucaccucacaagaacgccaaugcucccucaucgaagccggaacgagguucaaccucggcccagucaccaucacacuaucggaacccagaaacauccaacaaaagcucccacccgaaaucaucacccuacaccccaaaauagaagagggcuucuucgaccuaaugcacguccaaaaaguguuaucggcaucgaccgucugcaaacugcaaucgugcacacacggcauccccggggaccugcagauauaccacaucggcaaucuccucaaaggcgaccgcgucaacggacaccugauacacaaaaucgaaccccacuucaacaccucuuggaugaguugggacggaugcgaccuagacuacuacugcaacaugggggacuggcccucaugcacguauacgggcgucacacagcacaaccacgcggcauucguaaaccuccuaaacauagaaacagacuacacaaaaaccuuccauuuccacucaaaacgugucacggcccauggcgauacaccccagcucgaccucaaagccagaccaacuuacggugcaggggaaauaacggugcuaguggaaguagccgacauggagcuacacaccaaaaagguagagauauccggccucaaauucgccucguuaacaugcacaggcuguuacgccuguaguucuggcaucucaugcaaagucaggauucauguagacgaaccggacgagcuaaccguccacguaaaaagcucagaccccgacgugguagcagccucgacaagccuaauggcaagaaagcuagaguucgggaccgacuccaccuucaaagcguucucagcaaugccaaaaacaucccucugcuucuacaucguagaacgcgaauacugcaaaagcugcagcgaagacgacaccaagaaauguguagacaccaaacucgaacaaccccaauccauccuuaucgagcacaaagguaccauaauuggcaaacaaaacgacacaugcacggccaaagccuccugcuggcuugaaagcguaaagucauucuucuauggacuaaagaacaugcuuggaucggucuucggcucguucuucgucggcauacuauuauuccucgccccguucguacuccucguccucuucuucauguucggauggaaaauccuauucugcuucaaaugcugccgcagaacccgagggcuauucaaauaccgccaccuuaaagacgacgaagaaaccggcuacagacgcauaaucgaacgacuaaacagcaaaaagggcaagaacagacuacuagacggcgaacgccuagcagaccguaaaauugccgaacuauucucaacaaaaacacacaucgga

SEQ ID NO: 15553 - RNA, 2916 nt, Artificial Sequence
  derived and/or modified CDS sequence (opt11) from CCHFV(4495-ST-2008, Artificial)__KR814869.1__Gn-4aa-Gc
uccgaagaaagcggcgacgacugcaucuccagaacgcagcuccuccgcaccgagacggcagaaauacacgacgacaacuacggcggaccaggggacaagaucaccaucuguaacggcagcacgauaguugaccaaagacucggaucagagcuaggguguuacaccaucaaccgaguaaagagcuucaaacucugugagaacuccgcaacaggaaagacaugcgagauagacagcacacccgucaaaugccgccaaggcuucugccugaagauaacacaagaaggccgcggucacgucaaacuuaguagaggaucggaagucguccucgacgccugcgacucaagcugcgaagucaugauacccaaagguaccggcgacauccucguagacugcagcggagggcaacagcacuuccuaaaagacaaccuuaucgaccucggaugcccgcacauaccccuacucggcaagauggcaaucuacauuugccgcauguccaaccacccgcgaacaacgauggccuuccuauucugguucucauucggcuacguaauaaccugccuguucugcaaagcacuuuucuacucccucaucaucaucggcacacucggaaagaaaauaaaacaauaccgagaacuccguccacaaacaugcacaauaugcgaaacagcucccguaaacgcuaucgacgccgagaugcacgaccucaacugcagcuauaauaucugucccuacugcgcuucacggcugacauccgacggccuagcaaggcacguaccccaaugcccgaaacgcaaagagaaagucgaagaaacagaauuauaccuaaaccucgaacgcauacccuggaucguccgcaaacugcuacaggucagcgaaucaacaggaguggcccugaagcgauccucguggcucaucgugcuucuaguccuacuuacuguaagccuaagccccguacaaagcgcccccguaggacgcaaaccgcuauucuuagauaguaucgucaaaggcaugaaaaaccuccucaacucuacaucucuugaaacaucccucucgaucgaagcaccauggggagcaaucaacguacagagcacuuucaaacccaccgugagcaccgccaacauugcacuauccuggucguccguagagcacagaggcaacaaaauccucgucaccggccgcagcgaaucuauuaugaaacuagaagaacgaaccggcauaucaugggaccucggcgucgaagacgcauccgaaagcaaacuucuaaccguuucaauuauggaccucucgcaaauguacucacccguauucgaauaccugucaggcgaccgccaagucgaagaauggcccaaagcuaccugcacaggagacugccccgagcgaugcggaugcacauccuccaccugucuucauaaagaauggccccacucccgaaacuggcgaugcaaucccaccuggugcuggggcguagggaccggcugcacgugcugcggcgucgacgucaaggaccucuucaccgaccacauguucgucaaauggaaagucgaauacaucaagacagaagccaucguaugcguagaacuuaccucccaagagcggcaaugcucccucauagaagcgggcacccgcuucaaccuaggacccgucaccaucacacuaagcgagccacguaacauacagcaaaagcucccgccagaaaucauaacacugcacccaaaaguggaagaaggcuucuucgaccucaugcacguccaaaaaguccucagcgcauccaccgugugcaagcuacagucuugcacacacggcauacccggcgaccuacaaguuuaccacaucggcaaccuccugaaaggagaucgcguaaacggccaucucauacacaagaucgaaccacacuuuaacaccucauggauguccugggacgguugcgacuuagacuauuacugcaacaugggggacuggcccucaugcaccuacaccggcgucacucaacacaaccaugccgccuucgucaaccuccugaacaucgagacagacuauacuaagaccuuccacuuccacagcaaacgaguaacugcacacggagacacaccccaacuagaccugaaagcgcgcccgaccuacggugccggcgaaauuacgguccuaguagagguagccgacauggagcuccacaccaagaaagucgagaucuccggccucaaauucgcgucucuugccugcaccgguugcuaugccugcucaagcgguaucuccugcaaaguucggauccacguagacgaacccgacgaacucaccguccacguaaagagcucagaccccgacgucgucgcagccaguacuucucuuauggcccguaaacucgaguucggcaccgacucaaccuucaaagccuuuuccgccaugccaaaaaccucgcuaugcuucuacaucgucgaacgagaauacugcaaaucuugcagcgaagaagauacccagcgaugugucgacacgaagcucgaacaaccccaauccauacucaucgaacacaagggcaccaucauaggcaaacagaacgacacaugcaccgcaaaggcuucaugcuggcucgaaucagucaaguccuucuucuauggccucaagaacaugcucggcuccgucuucggcaacuucuucauuggcauacuucuguuccuugcacccuucguacuccuaguacuguucuucauguucggcuggaaaauacuauucugcuucaaaugcugcaggcgagcgcgcggccuacuuaaauaccgccacuugaaggacgacgaagaaaccggcuaucgaaaaaucauagaacgauuaaacaacaagaaaggcaaaaaccguuuacucgauggagaacggcuagccgaccguaaaauagccgaacucuucagcacaaaaacccacauaggg

SEQ ID NO: 15554 - RNA, 2916 nt, Artificial Sequence
  derived and/or modified CDS sequence (opt11) from CCHFV(4691-ST-2009, Artificial)__KR814871.1__Gn-4aa-Gc
uccgaagaaccaggcgacgacugcaucucgcguacccaacuccuaaaaaccgagacagcggagauacacgacgacaacuacggcggcccaggugacaaaaucaccauauguaacggaucgaccaucguagaccaacgacucggcucagaacucggaugcuacacaauaaaccgagucaaaucguucaaacuuugugaaaacagcgcgaccgggaaaaccugcgagaucgacuccacaccaguaaaaugccgccaaggauucugucucaagaucacccaggaaggacgaggccaugucaaacucucucguggaagcgaaguggugcucgacgccugcgacuccuccugcgaaaucaugauccccaaaggcacaggagacauccuagucgacugcagcggcggccagcaacacuuccucaaagacaaccucauugaccucgguugcccacacauaccccuacucggaaagauggccaucuacaucugccgcaugucaaaccacccccgaacgacaauggcauuccuguucugguucuccuucggcuacgucaucacaugcauauucugcaaagcccuuuucuauucccucaucaucauuggaacccucggcaagaaaauaaaacaauaccgcgaacuaaaaccccaaaccugcacaauuugcgagacagcccccgucaacgccauagaugccgaaaugcacgaccuaaacugcuccuacaacaucugccccuacugcgccucacgccuaacuuccgacggguuagcacgccacgucacccagugcccaaaacgaaaagaaaaaguagaagaaaccgaacucuaccuaaaccuagaacgcauccccuggauuguccgaaaacugcuucaagucuccgaaagcaccggggucgcacuaaaacgaucuuccuggcuuauuguccuccuuguacuccuaacaguaagccuaagccccguacaauccgcgcccguuggacgcaaaccccucuuccucgauuccauagucaagggcaugaagaaccuccuaaauucaacuucacucgaaacaucccuaagcauagaggcacccuggggagccauaaacguacaaagcaccuuuaaaccugcugucuccaccgcuaacaucgcacuaucauggagcagcgucgaacaccgcgggaacaaaauucucguaacgggccgauccgaaucaauaaugaaacucgaagaaagaaccggcguaagcugggaucucggcguagaggacgcuagcgaauccaaacuccuaacggucuccaucauggaccuaucacaaauguacagcccaguauucgaauacuuaucaggcgaccgccaggucgaagaguggccaaaggcaacguguacaggagacugcccagaacgcugcggcuguacaucaaguaccugccuacacaaggaguggccccacucccgaaacuggagaugcaacccuacauggugcugggguguuggcacaggauguaccugcugcggaguagacguaaaagaccuauucaccgaccacauguucaucaaguggaaagucgaauacaucaaaaccgaagcuaucguaugcgucgaacuaaccucucaagagcgccaaugcucacuaaucgaggcaggaacccgcuucaauuuaggacccgucacgauaacccuaucagaaccccgaaauauccaacaaaaacugccacccgaaauaaucacacuucacccuaaaaucgaagaaggcuucuucgaccucaugcacguacaaaaaguccugagugccucaacgguuugcaaacuucaguccugcacccacggaaucccgggagaucuucaaaucuaccacauaggcaaccuucuuaaaggagaucgcguaaacggccaccucauccacaaaaucgagccacacuucaacaccucguggaugagcugggacggcugcgaucuugauuauuacugcaacaugggggacuggccauccuguacguacaccggcgucacucagcacaaccacgcagcauucgucaaccuacucaacaucgaaacagacuacacaaagacauuucacuuucacagcaaacgcgucaccgcccacggcgacacaccccaacucgaccucaaagccaggccgaccuacggcgcaggagaaaucacugucuuagucgaggucgccgacauggaacuccacaccaagaaagucgaaaucucaggccucaaauucgcaucgcucgcaugcaccgguugcuacgccugcuccuccggaauaucuugcaaaguucggauacacguugacgagcccgacgagcuaacuguccacguaaagagcuccgaucccgaugucgucgccgccuccaccucacuaauggcccgaaaacuugaguucgggaccgacucuaccuucaaagccuucucagccaugcccaaaaccagccuuugcuucuauaucguggaacgggaauacugcaagagcugcuccgaagacgacaccaagaaaugcguagacacaaaacuugaacaaccccaauccauacugaucgaacacaaaggaacaaucauaggcaaacaaaacgauacgugcaccgcaaaagcgaguuguuggcuagaaagcguuaagucauucuucuacggguuaaagaacaugcuagguagcguguucggaaacuucuucguuggcaucuuacuauuccucgcacccuucguccuccuaguacuauucuucauguucgguuggaaaauacuauucugcuucaaaugcugucgacgcacccggggccuuuucaaauacagacaccucaaagacgacgaagaaaccggguaucggcgaaucaucgaacgccuaaacuccaagaaagguaaaaaucgacuacucgacggcgaacgccucgcugaucggaaaaucgcugaauuauucuccacaaaaacccacaucggc

SEQ ID NO: 15555 - RNA, 2916 nt, Artificial Sequence
  derived and/or modified CDS sequence (opt11) from CCHFV(4701-ST-2009, Artificial)__KR814872.1__Gn-4aa-Gc
agcgaggaaccgggcgaugacugcaucucgcgcacucaacugcuaaaaaccgaaacagccgagauacacgacgacaacuacggcggaccuggcgacaaaauaacaauaugcaacggcucaaccguugucgaucaacgacucggcagcgaacucggaugcuacaccauaaaccgcguaaaauccuucaaacucugcgagaacagugccaccgggaagaccugcgaaauagacucaacaccagucaaaugccgacagggcuucugucucaaaaucacacaggaaggccgcggccacguaaaacucagccgcggcuccgagguaguacucgacgccugugauagcuccugugaaaucaugauaccaaagggaacuggcgacauacucgucgauuguagcggaggccaacagcacuuccugaaagacaacuugaucgaccucggcugcccccacauaccccuccucggaaaaauggccaucuacauuugccgcaugagcaaccacccacgcacaacgauggcguuccuguuuugguucaguuucgguuacgucauaaccugcaucuucuguaaagcccuauucuacucccucaucaucaucgguacgcuagguaagaaaaucaaacaguacagagagcuuaaaccgcagacaugcaccaucugcgaaaccgcccccguaaaugccauugacgcagagaugcacgaucucaacugcuccuauaacaucugccccuacugcgccagccgucucaccagcgacggccuagcgcgacacgucacacaaugucccaagagaaaggaaaaaguagaagaaacugaacuauacuuaaaccucgaacguauaccauggauaguaaggaaacuccuacaggugucggaaucaaccggggucgcgcugaagcgaagcuccuggcugaucguauuacucguacuccucacaguaucacucucaccaguccaauccgcaccaguagggcgcaagccacuuuuucucgauuccauaguaaaaggcaugaaaaaccuacucaauuccacaucgcucgaaaccucacuguccaucgaagcaccauggggcgccaucaacgugcaaucgaccuucaaacccaccgucuccaccgccaacaucgcgcugagcugguccuccguagaacaccgcggcaacaaaauacucgucacaggccgcagcgaaucaaucaugaaacuagaggagcgcaccggcguuucaugggaccuaggggucgaagacgccucagagucgaaacugcuaacugucucaaucauggaccucucacaaauguacucccccgucuuugaauaccuauccggcgaccgacaaguagaagaauggccaaaagcaaccugcacaggugacugccccgaacgcugcggcuguacgucaucaaccugccuccacaaagaauggccgcacucccggaacuggcgaugcaacccaacauggugcuggggcguagguacaggcuguaccugcugcggagucgacgucaaagaccuauucaccgaccacauguucaucaaauggaaaguagaauacauaaaaaccgaagcgauagugugcgucgaacuaaccucccaagaacgccaaugcucccugaucgaagcaggcacccgcuucaaucucggaccaguaacaauaacccuaagcgaaccccguaacauacaacagaagcuaccacccgaaauaauaacacugcaccccaaaauugaagaaggauucuucgaccugaugcacguccaaaaaguccuauccgcaagcacagucugcaaacuccaauccugcacccacggcauccccggagaccuccagaucuaccacaucggaaaccuacuuaagggagaucgaguaaacggccaccucauccacaagaucgaaccccacuucaacacuagcuggauguccugggacggaugcgaccucgacuacuacugcaacaugggugacuggcccucauguaccuacacaggcgucacccaacacaaucacgccgcguucguaaaccuucuaaauaucgaaacagacuauacaaaaaccuuccacuuccauuccaaaaggguaaccgcccacggcgacacaccccaacucgaccuaaaagcaagacccaccuacggcgcaggagagauaaccguacucguggaagucgcagauauggaacuccacacuaagaagguagagaucagcggacucaaguucgcaucccuuaccugcaccggcugcuacgccugcucaucaggcaucuccugcaagguccgaauccacgucgaugagccagacgaacucacaguccacgucaaaagcucagacccagauguagucgcagcauccacaucccuaauggcccguaaacuagaguucggcaccgacucuacauucaaagccuucuccgcuaugcccaaaaccucacugugcuucuacauaguagaaagggaauacugcaaguccugcagcgaggacgacaccaaaaagugcgucgacacuaaacucgagcaaccacaaagcauauugauagaacacaaaggaaccauuaucggcaaacaaaacgauaccugcaccgccaaggcaucaugcuggcuagagagcgucaaaucauucuucuacgggcugaaaaacaugcucgguucgguguucggcggcuucuuuguggguauucugcucuuucuggcccccuucguacuacuuguccuauucuucauguucggguggaaaauccucuucugcuucaaaugcugcagacggacgcgcgggcuauucaaauauaggcaccuuaaggacgacgaggaaacaggcuaccgacgcaucaucgaacgccuaaacucaaagaaaggcaaaaaucgacuccucgauggagaacgccucgccgaccgcaaaaucgccgaacucuucagcacaaaaacccacauaggc

SEQ ID NO: 15556 - RNA, 2916 nt, Artificial Sequence
  derived and/or modified CDS sequence (opt11) from CCHFV(5170-R-2011, Artificial)__KR814873.1__Gn-4aa-Gc
ucagaagaaccgggggacgacugcauauccagaacacaacuccucaaaacugaaaccgccgaaauucacgacgacaacuacggcggcccuggagacaaaauuacaaucugcaauggcucaaccaucguugaccagcgccuaggauccgaacucggcugcuacaccaucaaucgaguaaaauccuucaagcucugcgaaaacagcgcuaccggaaaaaccugcgaaaucgacagcacccccgucaagugucgacagggcuucugccugaagauaacccaagaaggucgcgggcauguaaaacuuucucgcggaucagaaguaguacuggacgucugcgacagcuccugcgaaauaaugaucccgaagggcacuggagauauccuaguagacugcagugggggacaacagcacuuccucaaagacaaccucauagaccuggggugcccccacauaccguuacuaggcaagauggcgauauacauaugucgcaugucaaaccaccccagaaccaccauggccuuuuuauucugguucaguuucggguacgucaucacgugcaucuucugcaaagcacuauucuacucacuaaucaucaucggcacguuggguaaaaagauaaaacaauauagagaacugaaaccacaaaccugcaccaucugugaaaccgccccagugaaugcgauugacgccgagaugcaugaccuuaacugcucuuauaacaucugccccuacugcgccucgagacucacauccgaaggacucgcacgccaugugacucaaugcccaaaacgcaaggaaaaaguggaagaaacagaacuauaccuaaaccucgaaagaauccccuggauaguacgcaagcuacugcaagucagcgagucgacgggcgucgcccucaaacgcucauccuggcuaauaguccuccuaguccucuuaaccguaagccuauccccaguccagagcgccccaguaggccgaaaaccacucuuccucgacagcaucguaaaggggaugaaaaaccuccugaacuccacaagccuagaaacaucccucucuaucgaagcccccuggggcgccaucaacguucaauccacguuuaaaccgacagucuccacugccaacauagcccugucauggucuuccguagaacaccgaggcaacaaaauccuuguaaccggccguucugaauccauaaugaagcucgaagaacggacuggcguaagcugggaccuaggagucgaagacgcaucagaauccaaacuccucacugucuccaucauggacuuaucacaaauguacucgccugucuucgaauaccucagcggggaccgucaggucgaagaauggccuaaagccacaugcaccggggacuguccagaacgcugcggcugcaccuccagcacaugccuacacaaggaauggccacacagccggaacuggcgguguaacccaaccuggugcuggggcgucggcacuggaugcacauguugcggcgucgacguaaaagaccuauuuaccgaccacauguucaucaaauggaaaguagaauacauaaagacagaggccaucgucugcguggaguuaaccucucaagaacggcaaugcucgcuuauagaagcuggaacccguuuuaaucucgguccuguaaccaucacacucucggaaccccgcaacauacaacaaaaauuaccacccgagaucaucacccugcacccaaaaauagaagaaggcuucuucgacuuaaugcacguccaaaaaguccuaagcgcaagcaccgucuguaaacuccaaagcugcacccacgggauccccggcgaccuccaaauuuaucacaucggcaaccuccucaagggagaccgaguaaacggacaccucauccacaaaaucgaaccccacuucaacacauccuggaugucgugggacggcugcgaccucgacuacuacugcaauaugggcgacuggcccucauguacguacacaggugugacacaacacaaccacgcggccuucguaaaucuccuuaacaucgaaacggacuacacaaaaaccuuccacuuccacucaaaaagaguaacggcccauggagacacaccgcaacuggaccucaaggcacgaccaacauacggagcaggcgaaaucacaguauuaguagaagucgccgacauggaacuccacaccaagaaaguugaaauauccggccucaaguucgccucacuaaccugcacaggcugcuaugcuugcagcagcgggaucucaugcaagguccgaauccacguggacgaaccugacgagcucacaguccaugucaaguccucggaccccgacguaguagcagccagcaccucucucauggcccggaagcuagaguucggcacagacucgaccuuuaaagccuucucagccaugccuaaaaccucccucugcuucuacaucgucgaacgagaguacugcaaauccugcagugaggacgacaccaaaaagugcguagacaccaaacuagaacagccacaauccauccucauagaacacaaaggcaccaucauaggcaaacaaaacgacacaugcaccgcaaaagccucaugcuggcucgagucagugaaaucauucuucuacggccucaaaaacaugcucggaucaguguucgguagcuucuucgucggaauccuccuguuccucgcucccuucguacuacucguacucuucuucauguucggauggaaaauccuauucugcuucaaaugcugucgucgcacacgugguuuauucaaauaccgacaccucaaggaugacgaggaaacagguuaccgacgcaucauugaacgucuaaacuccaagaagggcaagaauagacuauuagacggcgaacgacuagccgaccgcaaaauugccgaacucuucagcacaaaaacacacaucggg

SEQ ID NO: 15557 - RNA, 2916 nt, Artificial Sequence
  derived and/or modified CDS sequence (opt11) from CCHFV(Oman-199809166, Artificial)__KR864901.1__Gn-4aa-Gc
uccgaggagagcggagaggacugcaucagccgaacccagcuccugagaaccgaaaccgcagaaauccauggcgacaacuacggcggcccaggcgacaagauuaccaucugcaacggaagcacuauagucgaccaaagacucggcucagaacucggaugcuauaccaucaaucgcgucaaaucguucaaacucugugaaaacagcgcaacuggcaaauccugcgaaaucgacaauacccccgucaaauguaagcaaggauucugccugaaaaucacccaggaaggacgcgggcacgucaaacugucucgagacuccgaaguaguguuagacgccugcgauucauccugcgaaauaaugauuccaaaaggaaccggagacauccucgucgacugcucaggcggacagcaacacuuccucaaagacaaccucaucgauuuagggugcccaaauaucccccuccucgggaaaauggccauauacaucugccgcaugucgaaccaccccaaaaccaccauggcauuccucuucugguucucuuucggauacguaaucacgugcauccuaugcaaggucaucuuuuaucuucuaaucgucguaggcacacuuggcaagaaauucaaacaauaccgagaacucaaaccgcaaacuugcaccaucugcgaaaccaccccaguaaacgcuaucgacgccgagaugcacgaccuaaauuguagcuauaacauaugccccuacugcgccucgcgacuuaccucggacggacuagcacgacacgucaugcaaugcccaaaacguaaagagaaaauagaagaaaccgaacucuaccuaaaccucgaacgaauacccuggguaguacggaagcuccuccaaguuucagaaucaaccggcguagcgcucaaacguucaucuuggcuaauaguacugcuaguccuccuaacagucucacucucccccguacagucagcacccaucggccgcaagccacucuuccucgacagcauagccaaaggcaugaaaaaccugcucaacagcaccagccuugaaacaucucuuucaaucgaagcgcccuggggcgccaucaacgugcaaucgacauucaaacccaccguauccacggcaaacauagcgcuguccugguccuccgucgaacacagaggcaacaaaauucuaguuuccggccgcuccgaguccaucaugaaacucgaagaacgcacggggaucuccugggaucuaggcgucgaggacgccucggaaagcaagcuccucaccgucuccgugauggaccucucgcaaauguacagccccguguucgaguaucucuccggagaccgacagguagaagaguggccaaaggccaccuguaccggcgacugccccgaacgcugcggaugcaccuccagcacaugucugcacaaggaauggccccacaguagaaacuggcgcugcaaccccaccuggugcuggggcguaggaaccggcugcaccuguugcggccucgacguaaaagaccuuuucaccgacuacauguucgucaaguggaaggucgaauacauuaaaacagaagcaauagugugcgucgaacuaaccagccaagaacgacaaugcucacugaucgaagccgguacccgauucaaccucggccccgucacgauaacacuaucagaaccacggaacauccagcaaaaauuacccccggaaaucguaacguuacauccacggaucgaggagggcuucuucgaccucaugcacguccaaaagguccucucagccuccacggucuguaaacugcaaagcugcacacauggcgugcccggcgaucuccaagucuaccacaucggcaaccuccugaagggcgauaaaguaaacggccaccucauucacaaaguagaaccccacuucaacacaucauggaugucuugggacggaugcgaccucgacuacuauugcaacaugggagacuggcccucaugcacauacaccggagucacccagcacaaccacgcggccuucgucaaccuacuaaacauugaaacggacuacacaaagaacuuccacuuccauucaaaacgcguaacagcacacggcgacacaccccaacuggaccucaaagcccgcccgaacuacggcgcaggcgagaucaccguacucgucgaaguagcagacauggaacuacacacaaagaaaauugagaucucuggccuuaaauucgcuagccuaaccuguaccgggugcuacgcauguuccuccggaaucagcugcaaaguccgcauacaugucgacgaacccgaugaauuaacgguccacgucaaaagcgaggaccccgacauagucgccgcaucaagcucgcucauggcccggaagcuagaauuuggcaccgacucgacguucaaagccuucucagccaugcccaaaaccagccuaugcuuuuacauugucgaacgggaauauugcaaaucauguucaaaggaagacacccagaaaugcgucaacgccaaacucgaacgcccccaauccauccuaaucgaacauaagggcaccaucaucggaaagcagaacgacacaugcaccgccaaagcauccuguuggcucgaauccgucaagagcuucuucuacggacucaaaaacaugcucucaggaauuuucggaaacguauuuauaggaaucuuucuuuucuuggcccccuucauccuacucauccuuuucuucauguuuggcuggcgcauacuuuucugcuucaaaugcugccgccgaacucguggacucuucaaauaccgacaccucaaagacgacgaagaaacuggcuaucgcaaaaucaucgaaagacugaacaacaaaaaggguaaaaacaagcuacucgauggggaacggcuggccgaccgaaaaaucgccgaacucuucagcaccaaaacacacaucgga

SEQ ID NO: 15558 - RNA, 2916 nt, Artificial Sequence
  derived and/or modified CDS sequence (opt11) from CCHFV(200406546-Turkey, Artificial)__KR864902.1__Gn-4aa-Gc
agcgaggaacccggagacgacugcaucucccggacccaacuccuccgaacagagaccgcagaaauccacgacgacaacuacggaggcccaggagacaagaucaccaucugcaacgggagcacgaucguagaccaacgacuaggcuccgaacuagggugcuacacgauaaacaggguaaagagcuuuaagcugugcgaaaacagcgcaaccggaaaaaccugcgaaaucgacucaacccccgugaagugccgccaaggauucugcuuaaaaaucacacaagaaggacgaggccacgucaaauuaucacgcggauccgaagucguccuggacgucugugacucaucaugcgaggucaugauccccaaaggaaccggagacauucuaguugacuguuccggaggacagcaacacuuccuaaaggauaaccucaucgaccuaggcugcccgcacguaccccugcucggccgcauggccaucuacaucugcagaaugaguaaucacccccggaccaccauggccuuucuguucugguucucauucggauacgucauuacaugcauauucugcaaagcacucuucuacucacuaaucaucaucggaacccucggcaagaaauucaaacaauaccgcgagcuaaaaccccaaacuugcacaaucugugaaacagcaccagucaacgccauagacgcagaaaugcacgaccugaacugcucuuacaacauaugcccauacugcgcaagucgucuaaccagcgacggucuggccagacauguuccccaaugccccaaacgcaaagaaaaaguugaagaaacugaacucuaccuuaaccucgaacgaaucccauggaucgucagaaaacuccuccaagucucggagucaaccggcgucgcucugaaacgcuccagcugguuaaucguccuccuugugcuccuaacgguaucccucucccccguucaaagcgcaccaguaggacgaaaaccgcuguuccucgacucaauugucaaaggcaugaaaaaccuccucaacuccacaagccuggaaaccucacuuuccaucgaagcaccguggggagcuaucaauguacaaucuaccuucaagcccacuguguccaccgccaacaucgcacuaucguggagcucaaucgagcaccgugggaacaagauccucgucacuggacgaagugaauccaucaugaaacucgaggaaagaaccggggucuccugggaccugggcguagaagacgccagcgaaagcaaacuccucacaguguccaucauggauuuaucccaaauguacucaccagucuucgaguaccuaagcggagaccgccaagucgaagaauggcccaaagcaacuugcacaggggauugcccggagagauguggcugcaccagcuccacaugccuccauaaagaauggccacauucacguaacuggcgaugcaacccaacauggugcuggggcguuggaaccggcuguaccugcuguggagucgacgugaaagaccuguucacagaccacauguuugucaaauggaaaguagaauacaucaagacggaagcaaucguaugcguagaacucaccucgcaagaacgacaaugcucucugauagaggccggcacgcgcuucaauuuaggacccgucaccaucacccuuuccgaaccaagaaauauccaacaaaaauugccaccagaaauaauaacccuccacccaaaagucgaagagggcuucuucgaucuaaugcacguccaaaaaguacucuccgccucaaccgucugcaaacuccaauccugcacccacggcauaccaggcgaccuacaaguauaccacauuggcaaccuccugaagggagacagggucaacggacaccucauccauaaaauagaaccccacuucaacaccucauggauguccugggacggcugcgaccuagacuauuacugcaacaugggggacuggcccagcugcacauacaccggagucacccagcacaaccacgccgccuucgucaaccuacuuaacaucgaaaccgacuacaccaaaacauuccacuuccacuccaaacgcguaacagcccacggugacacaccccaacuagauuugaaagcacgaccgaccuacggggccggagagauaaccgucuuggucgaggucgcugacauggagcuccacacgaagaaaguggagaucuccggccucaaauucgccucgcucgcaugcaccggauguuacgcgugcucauccgguauaagcugcaaaguacgcauccaugucgacgagccagacgaacucaccguccacgucaaauccucagacccagacguaguagcagcaucgaccucgcuaaccgcacggaaacuagaguucggcacagacucuacauucaaagccuucuccgccaugccaaagaccagcuuaugcuuuuacauagucgaaaaagaauacugcaaguccugcaacgaagacgacacacaaaaaugcgucgacacuaagcuagaacaaccccaguccauccucaucgagcacaagggcaccaucaucggaaaacaaaacgauaccugcaccgccaaggccucaugcuggcucgaguccgucaaauccuucuucuacggccugaaaaacaugcuaggaucagucuucggcaacuucuucaucggcauacuacuauuccuggcucccuucguccuccuaguccucuucuucauguucgguuggaaaauccucuucugcuucaaaugcugcagacgcacccgcggccucuucaaguaucgucaccuaaaggacgacgaagagacaggguacaaacgcauaaucgaacggcuaaacaauaagaaaggcaaaaacagacuacucgacggagaaaggcuagcagacagaaaaauugccgagcuauucuccacaaaaacacauaucgga

SEQ ID NO: 15559 - RNA, 2916 nt, Artificial Sequence
  derived and/or modified CDS sequence (opt11) from CCHFV(1-CR/HU-2015, Artificial)__KU161584.1__Gn-4aa-Gc
ucggaagaaccaggcgacgacuguauuucccgcacgcaacuacuaagaacagaaaccgccgaaauccacgacgauaacuacggagggccaggggacaaaauaacaauuugcaacgggucaaccaucguugaccaacgacucggguccgagcuaggcuguuacaccaucaacagaguaaagagcuucaaauuaugcgaaaacucagccaccggcaaaaccugcgaaaucgacuccacccccguaaaaugccgacagggauucugucucaaaauaacgcaagaaggccgcggccacguaaaacucucgcgaggcagcgaaguaguacuagacgccugcgauucauccugcgaaguaaugauccccaaaggaaccggcgacauccugguagacugcucaggcggacaacaacacuuccuaaaagacaaccuuauugaccuaggcugcccacacaucccacuccucggcaaaauggccaucuacaucugccgcauguccaaccaccccaggacaacaauggccuuccucuucugguucucguuuggcuacgucauaacuugcaucuucugcaaagcccuguucuacagcuuaauaaucauagggacccucgguaagaagauaaaacaguacagagagcuaaaaccacaaacaugcaccauaugugagaccgccccugucaacgcaaucgacgcugaaaugcacgaccugaauugcucguacaauauauguccuuacugcgccagcaggcucacguccgacggccucgcccgccacgugacccaaugccccaaaagaaaagaaaaagucgaagagacagaacucuaccucaaccucgaacgcaucccguggaucguacgaaaacuacugcaagucuccgaaucaacuggggucgcccugaaaagaagcagcuggcuaauaguccuccuaguacuucucacagucucccuaagccccguccaguccgcuccaguaggucgcaaaccacucuuccucgacuccaucgugaaaggcaugaaaaaucuccucaacuccacaucgcucgagacaucacucucaaucgaagcacccuggggcgcaauaaacguccaaucuacauucaaaccaaccguauccaccgcaaacaucgcacucuccuggucaagcgucgaacaccgcggcaacaaaauccucguaacaggccggagcgaaucuauuaugaaacuagaggaaaggacuggaguaaguugggaccuuggaguagaagaugccagcgaaucaaaacuccucacaguaucaaucauggaucucucacagauguauucccccguauucgaauaucuauccggagacagacaaguagaagaauggcccaaagcuacaugcaccggcgacuguccagagcgaugcggcugcaccucaagcacaugccuucacaaagaauggccccacagccgcaacuggagaugcaacccaacaugguguuggggcguggguacgggcuguaccugcugcggagucgacgucaaagaucuguucacugaucacauguucgucaaauggaaaguagaauacaucaagaccgaagccauagucugcguugaacugacuucgcaagagcgacaaugcucucuaauagaagccggcacccgcuucaaccucggaccaguaaccaucacucucucagaaccucgcaacauacaacaaaaacucccaccagaaaucauaacgcuacaccccaaaauagaagaaggcuucuucgaccugaugcacguacagaaaguccugagugccucaaccguaugcaaacuacaauccugcacccacggcauaccaggagaccuacaaguauaccacauaggaaaucuacucaagggcgaccgagucaacggccaccucauacacaaaauagaaccacacuucaacaccuccuggaugagcugggacggcugcgaccuagacuacuacugcaacaugggcgacuggcccucaugcacauacaccggaguaacccagcacaaucacgcagccuucgucaaccucuuaaacaucgaaacagacuacaccaaaaccuuccacuuccacucaaaacgcguaacggcgcacggcgacacgccccaacucgaccucaaggcaagacccaccuacggcgcaggcgagaucaccguacucguagaaguggccgacauggaacuucacaccaagaaaguagaaauaucuggcuuaaaauucgccucacucgcaugcacuggcugcuacgcauguagcagcggcauauccugcaaaguacguauacacgucgacgaaccugaugaacucaccguacacgucaagagcucagacccagacguuguagccgcaagcacaucccugauggcccguaaacucgaguucgguaccgauuccacauucaaggcguucuccgccaugccgaagaccucucucuguuucuacauaguggaacgcgaauacugcaaauccugcuccgaagaugacacaaagaaaugcguagauacaaaacucgaacagccacaaucaauccucauagaacacaaaggaaccauaauuggcaaacagaacgauaccugcacagcuaaggccucaugcugguuagaauccgucaaaucauucuucuacggccuuaaaaacaugcuaggaucagucuuuggcaacuucuucauaggcauacuccuuuuccucgcaccauucgugcuccuagugcuguucuucauguucggcuggaagauccucuucugcuuuaaaugcugcagaaggacccgcggccuguucaaguaucgacaccuaaaagacgacgaagaaaccgguuaccgacgaaucaucgaacgccuaaacaacaagaaaggcaaaaacagacuccucgacggagaacgccucgccgaccggaaaauagccgaacuguucagcaccaaaacacacauuggu

SEQ ID NO: 15560 - RNA, 2916 nt, Artificial Sequence
  derived and/or modified CDS sequence (opt11) from CCHFV(Gaib, Artificial)__KX013445.1__Gn-4aa-Gc
uccgaagagucgagcgacgacugcaucagccgcacccagcucuugcgcaccgaaaccgccgaaauacacaacgauaauuacgggggccccggcgacaaaaucacaauaugcaacggaucaacaaucgucgaccaacggcucggcucagaacuaggcuguuauaccaucaaccggguaaagagcuucaaacucugcgaaaacagcgccaccggcaaaucaugcgaaaucgacuccauccccgucaaaugccgacaaggcuucugccugaaaaucacccaggaagggcgcggccaugugaaacucagccgcggcucugaagucguccucgacgccugcgacucauccugcgaaaucaugaucccaaaaggcaccggcgacauucuagucgacugcagcggagggcaacaacacuuccucaaggacaaccucaucgaccucgggugccccaauauaccccuacucggaaaaauggcuaucuacauaugccgcauguccaaccaccccaaaaccacaauggcuuuccuauucugguucucauuuggauacgucaucacauguauauucugcaaagcaauauucuaccuacucauaaucguagguacacuugguaagaaauuuaaacaguaccgagaacuuaaaccucagaccugcacuauaugcgaaacgacucccgucaacgcaauagacgccgaaaugcaugacuuaaacugcuccuauaacaucugccccuacugugccucucgacuaacuucagacggccucgccagacacguaguccauugcccaaaacgcaaagagaaaauagaagaaaccgaacuauaucucaaccucgagcguguaccgugggucgugcgaaaacugcuccaaguguccgaauccacugguguugcccucaaacgcuccuccuggcucauaguccuccucguccuacucaccgucucccugucacccguccaauccgcccccauagguagaaaaccccucuuuucagacucaaucguaaaaggcaugaagaaccugcucaacuccacaucucuugaaaccucccuaucaaucgaggcuccauggggcgcaaucaacguccaaucaacauucaagcccacugucucaacggcaaacauagcccugucgugguccuccaucgagcacagaggcaacaaaauccuaguuuccggucgcuccgaaagcauaaugaaacucgaagaacgaacaggaauaagcugggaccucggugucgaggacgcaucagaaucccgccuacuaaccguaagcguaauggaucuaucacagauguauucacccguuuuugaauaccucaguggcgaccggcaagucgaagaauggcccaaggcaaccugcaccggagauugcccagaaagauguggaugcaccucgucaacgugccuacacaaggaauggccacacuccagaaacuggcgcuguaacccuaccuggugcuggggagugggcacgggcugcaccuguugcggccuagacgucaaagaccucuucaccgacuacauguucgucaaguggaaagucgaauacaucaaaaccgaggcuaucgugugcgucgaauuaacuucccaagagcgccagugcagccuaauagaggccggcacacgcuucaaccuaggacccguaacaaucacacuuagcgaacccagaaacauccaacaaaaacucccacccgaaaucaucacccuccacccccgcauagaggaaggcuucuuugaccuaaugcacguccaaaaggugcuauccgccucgaccgucugcaaacuacaaagcugcacacacggcguacccggugaccuccaagucuaccacauaggcaaucugcucaaaggcgauaaagucaacggccaccucauccauaaaauagaaccccauuucaacacaagcuggauguccugggacgggugcgaccuagacuauuacugcaacaugggcgacuggccaucaugcaccuacacaggagucacccagcacaaccacgcagcuuucgucaaccuccucaacaucgaaaccgacuauacaaagaacuuccacuuccacagcaaaagggucaccgcacacggcgacaccccacaacucgaccucaaagcacgacccacauauggagccggagagaucacaguccuagucgaaguugcugacauggagcuacacaccaagaaaauagaaaucucaggacucaaauucgccucacuaacauguaccggaugcuacgcauguucuucaggcaucucaugcaaagucagaauccacgucgacgaaccagacgagcucacaguacacgucaaaucagaggacccagacauugucgcagcauccuccagccugauggcaagaaaacuggaguucggaacagauuccaccuuuaaagccuuuucggcuaugcccaaaaccucgcuaugcuucuauaucgucgaacgagaauacugcaaaaguugcagccgggaagacacccagaaaugcguaucgacuaaacucgaacaaccccaauccauacuuaucgaacacaagggcaccaucaucggcaaacaaaacaacacgugcacaaccaaaacaaccugcuggcucgaaagcguaaaaucauucuucuacggccucaaaaacaugcucuccuccaucuucggcaacgucuucgucggaaucuucuccuuucuagccccguucauucucuugauacuguucuucauguucggcuggcgcauccuauucugcuucaaaugcugccgccgcacccgcggccucuucaaauaccggcaccucaaggacgacgaagaaacuggcuaccgacgcaucaucgaacgccucaacaacaagaaaggcaaaaguaaacuccucgacggagaacgacucgcugaccgcaagaucgcagaacuauucucaacaaaaacucacaucgga

SEQ ID NO: 15561 - RNA, 2916 nt, Artificial Sequence
  derived and/or modified CDS sequence (opt11) from CCHFV(Hodzha, Artificial)__KX013448.1__Gn-4aa-Gc
uccgaagaaaguggcgacgacugcaucagcaggacccaacuccuacgaacagaaacagcggagauccacggcgacgacuacggcggcccuggcgacaaaaucaccaucuguaacggguccaccauaguagaccagcgccucggcucagaacugggaugcuauaccauaaaccggguaaaauccuucaaacucugugaaaacuccgccaccggaaagagcugugaaauagacucaacucccgugaaaugcagacagggcuacugccuuaaaaucacccaagaaggacggggucauguaaaacucagccguggcuccgaagucguacuggacgcaugugacuccucaugcgagguaaugauuccaaagggaaccggugacauacucguagacugcucagggggccaacaacacuuccucaaggauaacuugaucgaccuaggcugcccccgaauaccccuacuaggaaagauggccaucuacaucugccgcauguccaaccacccagagacaaccauggccuuccuguucugguucuccuucggauacgucauaacaugcauccuaugcaaagcaaucuucuaucuacugauaaucguuggcacgcucggcaaaagguucaaacaauaccgagagcucaagccccaaaccugcaccaucugcgagacuacacccgcaaacgcaaucgacgcagagaugcacgaccuaaacugcuccuacaacaucugcccguacugcgcuucccgacucacaucggauggccucgcacgccauguaacacaaugccccaaaagaaaggagaaaguagaagagaccgaauuguaccucaaccucgaacggaucccauggaucguccgaaaacuccuacaggucagcgaaucgaccggagucgcacuaaaacguucaagcuggcucaucguccuccuaguacuguucgcaguauccuuaagccccguccaauccgcacccauuggccgacgaccccuauuccuugacuccaucgucaaaggcaaaaagaaccuacuaaacucaaccucccucgaaacaucgcucagcauagaggcccccuggggagcaaucaacguacaaucaacauacaaaccuaccgucaguacagccaacaucgcacugucaugguccagugucgaacaccgcgguaacaaaauccucguaucgggccgcuccgaaagcaucaugaaacucgaagaacgaacagguaucuccugggaccucggagucgaagacgcguccgaauccaaacuccucaccguaagcgugauggaccuaagccagauguacucacccgucuucgaauaccucucgggagaccgacagguagaagaauggcccaaggcgaccugcacaggcgacugcagcgaaagaugcggcugcaccucaagcacaugccuccacaaagaguggccucacucccggaauuggcgaugcaacccaaccuggugcuggggcgucggcacuggauguaccugcugcggguuagauguuaaggaccuguuuaccgacuacauguucgugaaguggaaagucgacuacauuaaaacugaagccauagucugcgucgaacuuacaucccaggagcggcagugcagccuagucgaagcaggcacgcgcuucaaccuaggucccgucaccaucacacucucagaaccgcgaaacauccaacaaaagcuaccacccgaaaucauuacccugcacccccgcaucgaagaaggcuuuuucgaccugaugcacgugcaaaaagugcuaagcgcguccaccguuugcaaacuacaaagcugcacacacggcgucccaggcgaccuccaagucuaccacaucggcaaccuacucaaaggcgacaaggucaacggucaccuuauccacaaaaucgaaccacacuucaacaccuccuggaugagcugggacgggugugaccuagacuacuacuguaacaugggcgacuggccaagcugcacguauacgggcguaacacagcacaaccacgcguccuucgucaaccugcuuaacauagagaccgacuacaccaagaguuuccauuuccauuccaaacgcguuacggcacacggcgauaccccucaacuggaccuaaaagcacgcccuacauacggggcgggcgagauaaccguccuaguagagguagccgacauggaacuccauacuaagaaaauagagaucaccggccuaaaauucgcaucccugaccugcacaggaugcuacgcaugcagcuccgguaucucaugcaagguacgcauccacgucgaugaacccgacgaacucaccguacacgucaaauccgacgacccagacguggucgcugcauccucaucucuaauggcgaggaaacucgaguucggaaccgauucgaccuucaaagcguucucggccaugccaaagacaucacucuguuucuauaucguggaacgagaauacugcaaauccugcucuaaggaagacacccaaaaaugcguuaacacaaaacucgagcaaccccaaucaaucuuaaucgagcaaaaaggcacaaucaucgggaagcaaaacaauaccugcacagccaaagccucgugcuggcuagaauccgugaaaucauucuucuaugggcucaaaaacaugcuaucggggaucuucggaaacgucuucgucggcaucuuccucuuccuagcgccauucauacuccucauccucuucuucauguuuggauggcgcauacucuucugcuucaagugcugccggcgcacacgaggccucuucaaauacaaacaccucaaagacgaugaagaaacaggcuacagacggaucauagagcgccucaauaacaaaaagggaaagaacaaacuucuugauggcgaacggcucgcagacagacgcaucgcagaacuauucuccacaaaaacgcacauaggc

SEQ ID NO: 15562 - RNA, 2916 nt, Artificial Sequence
  derived and/or modified CDS sequence (opt11) from CCHFV(IbAn7620, Artificial)__KX013451.1__Gn-4aa-Gc
ucggaagaacccucagacgauuguaucucucgaacccaacuucuccguacagaaaccgcagagauccacggagauaacuacggcggucccggagacaagaucacaaucugcaacggguccacaaucguagaccagcgccuaggaucagaacugggcugcuacacuaucaacagagugaaaucuuucaaguugugcgaaaacagcgccacagguaaaaacugcgaaaucgauagcguccccguuaaaugccgccaaggcuacugccugcguaucacgcaagaaggcagaggccacgugaaacuuucacgcggcuccgaaauaguccucgacgccugcgacaccuccugcgaaaucaugaucccgaaaggcacaggcgacauucuugucgacugcuccggaggacaacaacacuuucucaaagauaaccuaaucgaccucggaugcccaaagaucccacuucucggcaaaauggcuaucuacauaugcaggaugagcaaccacccaaaaaccacaauggcuuuccuguucugguucucauucggguacguuauuacgugcauccucugcaaggcgauauucuaccugcuaauaaucauaggaacccuaggcaaacgccuaaagcaauaccgagaacuaaaaccucagacaugcaccauaugcgaaaccacccccgugaacgcaaucgacgccgaaaugcacgaucucaacugcagcuacaacaucugccccuacugcgccucacgucugacauccgacgggcuggcccgucacgugauacaaugccccaagcguaaagaaaaaguagaggaaacagaacuauaccuaaaccuggaacgaaucccuuggguuguucgaaaacuucugcaggucucagaaucaaccggcgucgcccuaaagcgauccagcuggcucauagugcuccucguccuauuuaccguuucguugucccccguacagagcgcaccgauagguagaaaaccacuguuccuggacucaaucgccaaaggaaugaagaacccccuaaacucuaccucccuggaaaccucacucucgaucgaagccccguggggugcaauagacguacagucaaccuacaagccaaccguguccacagccaauaucgcacucucauggagcucaguugagcaccgcgggaacaaaauccuggucuccggcagaucagaaucaaucaugaaacuagaagaacgcaccgguaucucuugggaccuggguguggaggacgcaucugaauccaaacugcuaacaguguccguaauggaccucucacaaauguacucccccgucuucgaguaccugucaggcgaccgacaaguggaagaauggcccaaagcaaccugcaccggcgacugccccgaacgcugcggcugcacgucaucaacaugccuacacaaggaauggccacauuccagaaauuggcgcugcaaccccacauggugcuggggcgucggcaccggcuguaccugcugcggccucgacgucaaggaccuguucaccgacuacauguucguuaaguggaaagucgaguauauaaaaacagaagccaucgucugcgucgaacugaccagccaagagcgccaaugcucucucaucgaagccggaacaagguucaaccucgguccggucaccaucacucucagcgaacccagaaacauacaacaaaagcucccacccgaaauuaucacacuacaccccagaaucgaagagggcuuuuucgaccucaugcacguccaaaaaguacucagcgcauccacaguaugcaaacuccaaucgugcacccacggcgucccgggcgaucuacaaguauaucauauaggaaaccuccuaaaaggcgacaaaguuaacggccaccucauacacaaaauagaaccacauuucaacacaucguggauguccugggacggaugcgaccucgacuacuacugcaacaugggcgauuggcccagcugcaccuauaccggcgucacacaacacaaccacgccucauucgucaaccugcuaaacaucgaaacagacuacaccaaaaacuuccacuuccacuccaaacgcgucacagcacacggcgacacaccccaacuagaucuaaaagcaagacccaccuacggagcuggcgagaucaccguucuaguagaaguagccaacauggaacuccacaccaagaaaauugaaauaucaggccugaaguucgcaucauuaacuugcacuggcugcuacgcuugcucauccggaauuucuuguaaaguacgaauccacgucgacgaacccgacgaacuaaccguccacgucaaaagcgacgacccggacgucgucgccgccuccuccagccugauggcccgcaaacucgaguucggcacggacuccacauucaaagccuucagcgccaugccaaagacaucccucugcuucuacauagucgaacgcgaacacugcaaaagcugcucggaagaagacaccaaaaagugcguaaauaccaaacuagaacagccucaauccauccuaaucgaacacaaaggcacgaucaucggcaaacaaaacaguaccugcacugcaaaggccucauguuggcucgaaucagucaaaucguucuuuuacgggcuaaagaacaugcuauccggcauauucggaaauguauuuaugggcaucuuccuauuccuggcccccuucauccugcuaaucuuauucuucauguucggcuggcgcauacuuuucugcuucaagugcugccgccgcacucgcggccucuucaaauaccggcaccuuaaggacgacgaggaaacaggguaccgacgcaucaucgaacgacuaaacaacaagaaagggaaaaacaaacuacuggacggagaacgucuggcagaucgacgcaucgcagaacucuucucgacuaaaacccacauaggc

SEQ ID NO: 15563 - RNA, 2916 nt, Artificial Sequence
  derived and/or modified CDS sequence (opt11) from CCHFV(K128_76, Artificial)__KX013454.1__Gn-4aa-Gc
agcgacgagucgggcgacgacugcaucagccgcacccagcugcucagaacugagacggccgagauccacggggacaacuacggcgggccaggcgacaagaucaccaucugcaacggguccacaaucguggaccagagacugggcagcgagcugggcugcuacaccaucaaccgggucaaguccuucaagcucugugagaauagcgccacgggaaaguccugcgagauagacagcauccccgugaagugccgccagggcuacugccugaagaucacccaggagggccggggacacgugaaacugucccgcgggagcgaagucgugcucgacgcgugcgacucaagcugcgaagugaugauccccaagggcaccggcgacauccuggucgacugcucagggggccagcagcacuuccugaaggacaaccucaucgaccuggggugcccaaaaaucccccugcuuggcaagauggcaaucuacauaugccggaugagcaaucacccgaagaccacgauggccuuccuauucugguucucguucggcuacgugaucaccuguaucgugugcaaggccaucuucuaccugcucauuauugucgggacacugggcaagcgcuucaagcaguaccgggagcugaaaccccagaccugcacaaucugcgagaccacucccaccaacgccaucgacgcggagaugcacgaccucaacugcagcuacaacaucugccccuacugcgccucccgccugacgagcgauggguuggcccggcacgugacccacugcccgaagcggaaggagaagguagaagaaaccgaacuauaccugaaucuggagcggauccccuggguugugcgcaagcuccuccagguguccgagagcaccggcguggcccugaaacggagcuccuggcucaucgugcugcugguccucuucgcggugagccugucccccgugcagagcgccccaauaagucgacggccgcuguuccaggacagcaucgugaaggggaugaagaaccuccucaacuccacgagccuggagaccucccucagcaucgaggcccccuggggugccaucaauguacaguccaccuacaagcccgccgugagcgcggccaacaucgcccuguccuggagcuccguggagcaccgcggcagcaagauccuggucuccgggcgguccgaguccaucaugaaacuugaagaacgcacuggcaucagcugggaucuggggguagaggacgccagcgagucaaagcugcuuacgguaagcgucauggaucucucccaaauguauucccccguguucgaauaccugagcggcgaccggcaagucgaagaguggccgaaggcuacgugcacaggcgacugccccgagcgaugcggcugcaccagcucuacgugcuuacacaaggaguggccccacucucgcaacuggcgguguaaccccaccuggugcuggggaguggggaccggcugcacgugcugugggcuggacgugaaggaccuguucaccgacuacauguucgucaaguggaaggucgaguacaucaagacagaagccaucguaugcgucgagcucacaucccaggaaaggcagugcagccugaucgaggcaggcacccgguucaaccugggccccgugacgaucacccuguccgagccccgcaauauucagcagaagcucccgcccgagaucaucacccugcacccccggaucgaggagggcuucuucgaucugaugcacguucagaagguccucagcgccuccaccgugugcaagcugcagagcugcacacacggcgugcccggggaccugcaggucuaccacauaggcaacuuacugaagggggaucgugugaacggccaccugauacacaagaucgagccccacuuuaauacguccuggaugagcugggauggcugcgaucucgacuauuauugcaacaugggggacuggcccaguugcaccuauacaggcgucacccagcacaaccacgccagcuuugucaaccugcugaacaucgagacggacuauaccaagagcuuccacuuccacuccaagcgggugaccgcacacggggacaccccacaacucgaucugaaggcgcgccccaacuacggcgccggggagaucacagugcuggucgagguggccgacauggagcuucacaccaagaagauagagaucagcggccugaaguucgccucccugacuugcaccgggugcuaugccugcagcuccggaaucucuugcaaggugagaauccacguugacgagcccgacgagcuuacugugcaugugaaguccgacgacccggacgucguugcagccagcuccagucugauggcgcgcaagcuggaguucggcaccgacuccaccuucaaggccuucuccgcgaugcccaaaacgucccuuugcuucuacauuguugagcgggaguacugcaaaagcugcuccaaggaggacacacagaagugcgucaauaccaagcuggagcagccccagagcauccucaucgaacacaaggggaccaucauaggaaagcaaaacaacacguguaccgccaagaccucaugcugguuggagagcgugaaaucuuucuucuacgggcucaagaacaugcugagcggaaucuucggcaacguguucgucgggaucuuccucuuccuggcccccuucauccuacucauccuguucuucauguucggcuggcgcauccuguucugcuucaagugcugccggcgcacccggggccucuuccgcuacaagcaccuggagaacgacgaagagaccggguacagacgcaucaucgaacggcugaauaacaagaaggggaagaacaagcuccuggacggcgagcgccuggccgaccgccggaucgccgaacuguucagcacaaagacccauaucggc

SEQ ID NO: 15564 - RNA, 2916 nt, Artificial Sequence
  derived and/or modified CDS sequence (opt11) from CCHFV(K168_40, Artificial)__KX013457.1__Gn-4aa-Gc
agugaugagucuggggacgacugcaucagucgcacccagcugcuccggaccgagaccgcggagauccacggggacaacuacggcgguccuggagacaagaucaccaucugcaacggguccaccaucguggaucagcgccucggcagugagcugggcugcuacaccaucaaccgggucaaguccuucaagcucugcgagaacucagccacugggaaguccugcgaaguggacagcauccccgucaagugccgacagggcuacugccugaagaucacucaggaggggcgcggccacgucaaacugagucgcggcagcgagguggugcucgacgcuugcgacaguagcugcgaggucaugauacccaaggguaccggugacauccugguggauugcucagggggccagcaacacuuccugaaggacaaucucaucgaccugggcugccccaagaucccccugcucgggaagauggccaucuacaucugccggaugucgaaucauccgaagaccacgauggcauuccuguucugguucuccuucggcuacgucauaacuugcaucguaugcaaggccaucuucuaccugcucaucaucgucgggacccugggcaaacgcuucaagcaguauagagaacugaaaccccagaccugcacaaucugcgagacuaccccgaccaacgcaauagacgcggagaugcacgaccugaacuguagcuacaacaucugccccuacugcgcgucccgacugacgucggacgggcuugccagacacgugacgcacugcccgaagcguaaggagaaagucgaggagaccgaacucuaucugaaccuggaacgaauccccuggguugugcgcaaguuguuacagguguccgagaguaccgggguagcccugaagcggagcuccugguuaaucgugcugcucguacuguucgcggugagccugucccccgugcagagcgcccccaucgggcgucggccgcuguucuuagacggaaucgucaagggcaugaagaaccugcugaacuccacgagccuagaaaccucccucucgaucgaggcccccuggggcgccaucaacgugcaguccaccuacaagccgacgguaucagcugcgaacaucgcccuguccuggagcuccgucgagcauagggggaacaagauccuugugagcgggcggagcgagagcauuaugaagcuggaggagcguacgggaaucuccugggaccuggguguagaggacgcaagcgagagcaagcuccugaccgugucagucauggaccugagccagauguacucccccgucuucgaguaccucagcggcgaccggcaaguggaggaauggccgaaagcuacaugcaccggcgacugcccugagcgcugcgggugcacguccaguaccugucugcacaaagaguggccccacucccgcaacuggcggugcaaccccaccuggugcugggguguugggaccggcugcacgugcugcggguuagauguaaaggaccucuucaccgacuacauguucgugaaguggaagguggaguacaucaagaccgaagcuaucguuuguguggagcugaccagucaagagcgccagugcucccugauagaggcggguacgcguuucaaccuggggccggugaccauaacccucagcgagccccgcaacauccaacagaaguugcccccagaaaucaucacccuacacccgcggaucgaggagggguucuucgaucucaugcacguacagaaaguacuauccgccagcaccgugugcaagcugcaguccugcacgcauggcguccccggggaccuucagguuuaucauaucggcaaccugcugaagggcgacaaagugaacgggcacuugauccauaagaucgagccccacuucaacaccagcuggauguccugggacggcugcgacuuagacuacuacugcaacaugggggacuggccuuccugcacauacacaggugucacccagcacaaucacgccucauucaucaaucugcucaacaucgagaccgacuacaccaagagcuuccacuuccauucgaaacgcguuaccgcccacggagacaccccucagcuggaccugaaagcucggcccaacuacggcgccggcgagaucaccgugcucgucgagguggccgacauggaacuucacacuaagaagaucgagaucagcgggcucaaguucgccucgcucacuugcacuggcugcuacgccugcagcagcgguaucucaugcaagguacgcauacacgucgacgagcccgacgagcucaccgugcacgugaagucggacgacccugacgucguagccgcguccucuucccugauggcccgaaagcucgaguucggcaccgauagcaccuucaaggccuucuccgccaugcccaagacuucccugugcuucuacaucguggagcgcgaguacugcaagucaugcagcaaagaagacacccagaagugugucaacacuaaacuggagcacccccaguccauacucaucgagcacaaagggaccaucaucggcaagcaaaacaacacgugcaccgcgaagaccagcuguuggcucgaguccgugaaguccuucuucuacggccugaagaauaugcucuccggaaucuucggcaacguguucgucgggauauuucuuuuccuagcccccuucauccuccugauccuuuucuucauguucggauggagaauccucuuuugcuucaaauguugccgcaggacgcgcgggcuguuccgguacaagcaccuggaggacgacgaggagacgggcuaccggcggaucauagaacgacucaacaauaagaagggcaagaacaaacugcuggacggggagcggcucgccgaccgccgcaucgccgaacuguuuagcaccaagacccacaucggc

SEQ ID NO: 15565 - RNA, 2916 nt, Artificial Sequence
  derived and/or modified CDS sequence (opt11) from CCHFV(K168_125, Artificial)__KX013460.1__Gn-4aa-Gc
ucagacgaaagcggcgacgacugcauaagcagaacacaacuccuacgcacagaaaccgcugaaauccacggcgacaacuacggaggcccaggagauaaaaucacuauaugcaacgguagcaccauagucgaccaacgccuaggcucugaacuaggcugcuauaccaucaauagaguuaaauccuucaaacucugcgaaaacagcgcgaccgggaaaucaugcgaagucgacuccaucccaguaaaaugccgccaaggcuacugccucaaaauaacccaggaggggcgagggcacgucaagcucucaagaggauccgaaguaguauuagacgcgugugacagcucuugcgaagucaugauccccaaaggcaccggcgacauccuugucgacuguagcgggggacaacaacacuuccugaaagacaaccuaaucgaccugggcugcccgaaagucccccuccucggaaaaauggccauauacauaugccgcauguccaaccacccaaagaccacaauggccuuccuauucugguucucauucggcuaugucauaaccugcauagucugcaaagcaaucuucuaucuccucaucaucguaggaacccuaggcaagcgguucaaacaauaccgcgaacuuaagccccaaacuugcaccauaugugaaacgacucccaccaaugccaucgaugcugaaaugcacgaccucaacugcagcuacaauaucugccccuacugugcaucgcgccuaaccucagacgggcucgcccgccacguaacgcauugcccgaaacguaaggagaaaguagaggagaccgaacucuaccucaaccuagagcgcauacccuggguaguacgcaaacuccuacaaguaucagaauccacaggcguagcccugaaacgcuccuccuggcugaucguccuacucguccucuucgcagucucccucagccccguacaguccgccccaaucggucgacgaccccucuuccuagacuccauaguaaaaggaaagaaaaacuuacugaacucaaccagucucgaaaccagccuaucuaucgaagccccauggggagcaaucaauguccagagcaccuacaaacccaccgucuccgcagccaacaucgcccuaucgugguccagcgucgaacaucgcggcaacaaaauccuagucuccggccgcucagaaaguauaaugaaacuagaggaacguaccggcaucuccugggauuuaggggucgaggacgccagcgaaagcaaauugcuaacaguuuccguaauggaccucucccaaauguacucucccguauucgaauaccucagcggagacagacaaguagaggaauggccuaaggcaaccugcaccggugacugcccagaacgauguggaugcaccucauccacaugccuccauaaagaauggccccacucgaggaacuggcgcugcaacccaacaugguguuggggcguagggaccgguugcacaugcugcgggcuagacguaaaagacuuguucaccgauuauauguucgucaaauggaaagucgaauacauaaaaaccgaagccauaguaugcguagaacuaacgucccaggaacgacagugcagccucauagaagccggcacacgcuucaaucuuggccccgucaccaucacccuaucggagccccgcaacauccaacaaaaacugccgcccgagauaauaacacuccauccaaggaucgaagaaggguucuucgaccuuaugcacguccaaaaaguucuaucggcuucuaccgucuguaaacuccaaagcuguacacacggcgugccaggugaccuucagguuuaccacaucggaaaucuacucaagggcgacaaaguuaacggccacuuaauccacaagaucgaaccccacuucaacaccagcuggauguccugggacgggugcgaccuagacuacuacugcaacaugggugacuggccuucgugcacauacacuggcguaacucagcauaaccacgccagcuucauaaaccuucucaacaucgaaaccgacuacaccaaaucuuuccacuuccacagcaagaggguaaccgcccacggagacacaccacaacucgaccucaaagcccgccccaacuauggcgcaggagaaaucaccgucuugguagaagucgccgacauggaacuacacaccaagaaaaucgaaauaagcggccucaaauucgcaucacuaacguguacaggaugcuacgcgugcucgucaggaaucagcugcaaaguccggauccacguagacgaaccggacgaacucacgguccauguaaagagcgacgaccccgacgucgucgccgccucaagcagccucauggcccgaaaacucgaguucggaaccgacucuaccuucaaagccuucucagcuaugcccaaaacaagccuguguuucuacaucgucgaaagggaauacugcaaauccugcagcaaagaagauacccaaaaaugcguaaacacaaaacucgaacacccccaaucuauacucaucgaacauaaaggcacaaucaucggcaagcaaaacaauaccugcaccgcgaaaaccagcugcuggcuggaauccgucaaauccuucuucuacggacuaaagaauaugcuaucaggcaucuucggcaacgucuucgucggcaucuuccuguuccuagcuccguucauacuacucauccucuucuuuauguuuggcuggcgcauucucuucugcuucaaaugcugucgccgcacacgaggccuguuccgauacaagcaccucgaggacgaugaagagaccggcuaucgccgcaucauugaaagacuaaacaacaagaaaggcaaaaacaagcucuuagacggugaacgucucgccgaccgccgcauugcugaacuuuucagcacaaaaacccauaucggc

SEQ ID NO: 15566 - RNA, 2916 nt, Artificial Sequence
  derived and/or modified CDS sequence (opt11) from CCHFV(K229_194, Artificial)__KX013463.1__Gn-4aa-Gc
ucagaggaaccgggcgacgacuguaucagccgcacccaauuacuaaagaccgaaaccgccgaaauccacgaugacaacuacggcggcccaggagacaaaaucacuaucugcaacggcucaacaauagucgaucagagacugggauccgaacuagguugcuauaccaucaaucgagucaagagcuucaaacugugcgaaaacuccgccaccgguaagacaugugaaauagacagcacaccggucaaaugucgccaaggauucugccucaaaauaacucaggaaggacguggacacgucaaacuuagucgcggaagcgaagucguacuagacgccugcgacucaagcugcgaaaucaugauacccaagggcacaggagacauacuggucgacugcuccggaggucaacaacacuuccucaaagggaaccuaaucgaccugggcuguccacauauaccacuauuaggaaagauggccaucuacauuugccgcaugucaaaccacccccgaaccacaauggccuuucuauucugguucucauucggcuacguaaucacaugcaucuucugcaaagcgcucuuuuacagccuaauuaucaucggcacccugggcaagaaaaucaaacaauaccgugaacucaaaccccaaacgugcaccauaugcgagacugccccggucaaugccauagacgccgaaaugcacgaccuaaacugcucuuacaacaucugcccauacugcgcaucacggcucacauccgacggacucgcccgacacguaacccaaugcccuaaacgcaaagaaaagguggaagaaaccgaauuauaccucaaccucgagcggaucccauggaucguaagaaaacuccuacaagucuccgaaucuaccggcgucgcgcucaagcgaucauccuggcuaaucguacuacucguucuccucaccgucagccugagccccguucagucagcacccgucggacgaaaaccacuguuccucgacaguaucgucaaaggcaagaaaaaccuccugaacuccacaucccuagagacaagucuaagcaucgaagcaccauggggagcaauaaacguacagagcacguucaaaccaaccgucuccaccgcaaacauagcacucagcuggucauccgucgaacaccgaggaaacaaaauccucgucaccggccgguccgagagcaucaugaaauuagaagaaagaacaggcgucagcugggaccucggaguugaagacgccagcgaaagcaaacucuuaaccguguccaucauggaccucucacaaauguacucacccgucuucgaauacuuauccggcgaccgacaaguggaagaauggccaaaagccacuugcaccggagacuguccugagcggugcggcugcaccucaagcacuugccuacacaaagaguggccacacucgagaaacuggcgcugcaacccgacauggugcuggggcgucgggacggguuguaccuguugcggagucgacgucaaagaccuuuucacggaccauauguucauaaaguggaagguagaauacaucaaaaccgaagcuaucgucugugucgaacuuacaucccaggaacgucagugcuccuuaauugaagccggcaccagauucaaccucggaccagucacaauaacacuauccgaaccccgaaacauccagcaaaaacuuccacccgaaaucaucacacugcaucccaaaauugaagaaggcuucuucgaccuuaugcacguacaaaaaguacucagcgcauccaccgucugcaaacuucaauccugcacccacggcaucccgggggaccuacaaaucuaccacaucggcaauuuacuaaaaggcgaccgacucaacggccaccuaauccacaagaucgaaccacacuuuaacaccagcuggauguccugggacggcugcgaccuggacuauuacugcaacaugggugacuggccuuccugcaccuacaccggcguaacccagcacaaccacgcagccuucgugaaccuacuaaacauagagaccgauuacaccaaaacuuuucacuuccacagcaaacguguaaccgcccacggcgacacaccgcaacucgaccucaaagcccgacccacauacggggccggcgaaauuaccguccucguagaaguagcagacauggaacuccacaccaaaaagguugagauaucggggcugaaauucgcuucccuugccuguaccggcugcuauuccugcucaagcggaaucucauguaaggucagaauacacgucgacgagcccgacgaacucacgguccaugucaaaucaucagaccccgacgucgucgcagcaucaacaucccucauggcgcggaaacuagaguucggcaccgacuccacauucaaagccuucuccgcaaugccaaaaaccucccuaugcuucuacaucgucgaacgcgaauacugcaaauccugcuccgaggacgacaccaagaaaugcguggacacaaaacucgaacaaccccaaucaauccuaauagaacacaaaggcacaauaaucggaaaacaaaacgacaccuguacagcuaaagccucuugcuggcucgaauccguaaaguccuucuucuacggccucaaaaacaugcucggcagcgucuucggcaacuuuuucgucgguauacuccuauuccucgcacccuucguccuccuuguccuauuuuucauguucggcuggaaaauccucuucugcuucaaaugcuguaggcgaacccgcggccucuuuaaauauagacaccucaaagacgacgaagagaccggcuaccgaaaaaucauagagcgacucaacuccaaaaagggcaaaaacagacugcucgacggagagcgccuagcagaccgaaaaaucgccgagcuauucagcaccaaaacccacauaggc

SEQ ID NO: 15567 - RNA, 2916 nt, Artificial Sequence
  derived and/or modified CDS sequence (opt11) from CCHFV(K229_243, Artificial)__KX013466.1__Gn-4aa-Gc
ucagaggagccgggagacgauugcaucagccgaacacaacuccuaagaaccgaaaccgcggaaauccacgacgacaacuacggaggacccggcgacaaaaucaccauaugcaauggauccacaaucguagaccagcgacucggcuccgaacuaggaugcuacaccaucaacagagucaaauccuucaagcucugcgaaaacucugccacaggcaaaaccugcgaaaucgacuccacccccgucaaaugccgacaaggcuuuugccuaaaaaucacucaagaaggcagaggacacgucaaacugucccgcggcagugaagucguacucgacgccugcgacagcagcugcgagguaaugaucccaaaaggaacaggagacauccucgucgacugcucaggcggacagcaacacuuccuuaaagacaaccucauagaccucggaugcccacacaucccccuccuuggcaagauggccauauacaucugucggaugucaaaccacccccgcacaacaauggcauuccucuucugguucagcuucggcuacgucauuacaugcauauucugcaaagcccuauucuacucccuaaucauaaucggaaccuuaggaaagaaaaucaaacaguaccgcgaacucaaaccacagaccugcaccauaugcgaaaccgcccccguaaacgcgaucgacgcagaaaugcacgacuuaaacugcucauacaauauuugccccuacugugccucgcggcuaacauccgacggacuagcgcggcacgucccacaaugcccuaaaaggaaagaaaaaguagaagaaacggagcuuuaucuaaaccuagagagaauaccauggauaguccggaaacuacuccaaguauccgagagcaccggcguagcauuaaaacgcucgucauggcugauaguacuucucguacugcucaccgucucacuaagcccgguccaaucagccccagucggacgcaaaccccucuuccucgacaguauaguaaagggcaugaagaaucuucuaaauuccaccagucuagaaacaagccuaagcaucgaagcaccauggggcgcuaucaacgugcaaucaaccuucaaaccaaccguaagcacggcaaacaucgcccucucguggucgagcgucgaacaucgcgguaacaaaauccuagugacaggccgcucugaauccauaaugaagcuagaggaacgaaccggcgucucaugggaccucggcguagaggacgcgagugaaaguaaacuacucacaguuuccauaauggaccucucccaaauguacucgcccgucuuugaguaccucucaggcgaccggcaagucgaggaguggccaaaagccacaugcaccggagacugccccgagcgcugcggcugcaccaguuccacuugccuacacaaagaguggccccacagccgcaacuggcgcugcaacccuacauggugcuggggugugggcacagggugcacaugcugcggcgucgaugucaaagacuuauucaccgaccacauguuugucaaguggaaagucgaauacaucaaaacagaggccaucgucugugucgaacuaacaagccaggaacgacagugcucccuaaucgaagcaggcacgcgcuucaaucucggaccagucacaauaacccucucagagccccgcaacauccagcagaaacucccacccgagauuauaaccuuacaccccaaaguggaagaaggcuucuucgaccucaugcacguccagaaagugcucuccgccagcaccgucugcaaacugcaauccugcacccaugguauacccggcgaccuacagguuuaccacauuggaaaccuccuaaaaggugaccgaguaaacggacaccucauucacaaaaucgaaccccacuucaauacgagcuggauguccugggacggcugcgaccuagacuacuacugcaacaugggcgacuggcccuccugcaccuacaccggcguaacacaacacaaccaugcugccuucgucaaucugcuaaacauagagacagacuauacuaaaaccuuccauuuccacagcaagcgcguuaccgcccacggcgauacuccccagcucgaccucaaagcccgacccacguacggagcaggagaaauaaccguacucguagaaguagccgacauggaauuacacacaaagaaagucgaaaucuccggccuaaaauucgcaucucucgccugcacaggauguuacgcaugcuccagcggaaucuccugcaaaguaaggauccacguagacgaaccagacgagcucaccguccacgucaaauccucagaccccgacgucguagccgccagcaccagccucauggcccgaaagcucgaguucggcaccgacucgacauucaaggccuucuccgcgaugccaaagaccagccuaugcuucuacauaguugaaaaagaauauugcaaguccugcagcgaagaggacacccaaaagugcguggauacaaaacucgaacaaccccaguccauccuaauagaacacaaaggcacgaucauaggcaaacaaaacgacacaugcacugccaaagccagcugcuggcucgaauccgucaagucguucuucuacgggcucaaaaacauguugggcagcguauucggcaacuucuucaucggcauacugcuuuuccugaccccguucgugcucuuaguacuauucuucauguucggauggaaaauccuuuucugcuucaagugcugccggcgaacccgcggccuccugaaauacagacaccucaaagacgacgaagaaacaggauaccgacgaaucauagaaaggcucaacaacaaaaagggcaaaaaccgccuccucgacggcgagcgacucgccgaccgaaaaauagcagaacucuucagcacaaaaacccacauugga

SEQ ID NO: 15568 - RNA, 2916 nt, Artificial Sequence
  derived and/or modified CDS sequence (opt11) from CCHFV(K315_14, Artificial)__KX013469.1__Gn-4aa-Gc
ucagaggaaccaggcgacgacugcauaucacggacacaacuccugaagaccgaaacugccgagauacacgacgacaacuacggcggucccggugauaagauuacaaucugcaacggcagcaccgucgucgaccaaagacucggcuccgaacuuggcugcuacaccauaaaccgcguaaaauccuucaaacucugcaaaaacagcgccaccggaaagacgugcgagauagacucaacccccgucaaaugccgacaaggauucugccucaagauuacacaagagggucgaggccauguaaaacuaagccgcggcucggaaguaguucucgacgucugcgacagcucgugugaaauuaugauacccaaaggaaccggagacauccucguagacugcuccgguggacaacaacacuuucucaaagacaaccugauagaccuagguugcccccacauaccccuccucggcaaaauggcuaucuacaucugcagaauguccaaccacccacgcacuaccauggcuuuccuauucugguucucguucggcuacguuauaaccugcauuuucugcaaagcucucuucuacucgcucaucauaaucgguacucuaggcaagaaaaucaagcaauaccgugaacuaaagccccaaacaugcaccauuugugaaaccgcgccugucaacgccaucgacgccgaaaugcacgaccucaacugcagcuacaacauuugcccauacugcgcgucucgacuaaccagcgaaggccuggcccggcacgucacacagugcccaaaaagaaaagaaaaagucgaagaaaccgaacuauaccucaaccuagaacgaaucccauggaucgucagaaaacuacuccaagucucagaauccaccggcgucgcacuaaagagauccucuuggcuaaucgugcuacucguccugcuaaccguuucgcuaagccccguccaauccgcacccgucggacguaagccacuguuccuugacucaauagucaaaggaaugaagaaacuccucaacagcacaucccucgagaccucccucuccaucgaagcucccuggggcgccaucaacguccaguccacguuuaaaccaacggucaguacagcaaacaucgcccucucauggagcuccgucgaacaccgcgggaacaaaauacucgucaccggccggucagagucaauaaugaaacucgaagaacggaccggcgucuccugggaucugggaguggaggacgccucagaguccaaacuccuaacggucagcaucauggaccugagccaaauguacucaccggucuucgaguaucuuagcggagaccgccaagucgaagaauggcccaaggcaaccuguaccggagacugccccgaacgcuguggcuguaccucauccacuugcuuacacaaagaauggccccacagccgcaauuggcgaugcaacccaaccuggugcuggggagucggaaccggauguacaugcugcggcgucgacgucaaagaccuuuucacugaccacauguucaucaaauggaaagucgaguacaucaagaccgaagccaucgucugcgucgaacucaccucccaggaacgucagugcucacucauagaagcaggcacgcgguucaaccucggccccguuaccauaacacucagcgaaccaagaaacauucaacaaaaacuucccccagagaucauaacgcuccaccccaaaaucgaagaaggcuucuuugaccuaaugcauguccaaaaaguccuuagcgccagcacgguaugcaaacugcaauccugcacgcacggcaucccaggggaccuccaaaucuaccacaucgggaaucuucuaaaaggggaccgagucaauggccauuuaauccacaaaauagaaccccacuucaacacaagcuggaugucaugggacggcugcgaccuagacuacuacuguaacaugggcgacuggccauccugcacauacaccggagucacacaacacaaccacgccgccuucgucaaccuacuaaacaucgaaaccgacuacaccaaaaccuuccacuuccacagcaaacgcguaacagcccacggcgacaccccacagcucgacuuaaaagcaagaccaaccuacggagccggcgaaauuaccguccuaguagaagucgcggacauggaacuacacacaaagaaaguagaaaucuccggacucaaauucgccucgcucacuugcaccggaugcuacgcgugcucauccggcaucuccugcaagguucgaauacacguagacgaacccgacgaacucaccguccacgugaaguccucugacccagacguuguagccgccucaacgagccucauggcacgcaaacuugaguucggcacagacuccaccuucaaagccuucuccgccaugcccaaaaccucccucugcuucuacaucgucgaacgcgaauauugcaaaucaugcucggaagacgacaccaagaaaugcgucgacacaaaacucgaacaaccgcaaucaauucuaaucgagcacaaagguacuaucauaggaaaacaaaacgauaccugcacagccaaagccucauguuggcuagaguccgucaaauccuuuuucuacggacucaaaaacaugcuaggcucaguguucgggucguucuucguaggaauacuucucuucuuagcccccuuuguccugcugguccuuuucuuuauguucggauggaaaaucuuauuuugcuucaagugcugccgacggaccagaggacucuucaaguaccgucaucuaaaagacgacgaagagaccggcuaccgacgcauaauagaacgucucaauucuaaaaaggguaagaaccgccuccucgacggcgaacgucucgccgaccgcaaaaucgcugaacucuucucuaccaaaacccacaucggu

SEQ ID NO: 15569 - RNA, 2916 nt, Artificial Sequence
  derived and/or modified CDS sequence (opt11) from CCHFV(K323_27, Artificial)__KX013472.1__Gn-4aa-Gc
ucugaggaacccggcgacgacugcaucuccagaacccaacuacucaaaacggagacagccgaaauccacgacgacaacuacggcggccccggcgacaaaaucaccaucugcaacggcagcaccaucguagaccaaaggcucggcucagaacuaggcugcuacaccaucaacagaguaaaauccuucaaacucugugaaaacuccgcgaccggcaagaccugugaaauagacuccacgccagucaaaugcagacaaggcuucugccugaaaauaacccaggaaggacgcggccacguaaaacucucaagaggaagcgagguaguccuagaugcuugcgauuccucaugcgaaauaaugauaccaaaaggcaccggagauauccugguugauugcagcgguggccagcaacacuuccucaaagacaaccucauugaccucggcugcccccacaucccccuccucggcaaaauggccauuuacauuugccggaugucuaaccacccacgcacuacuauggcguuccuauucugguucaguuucggauacgucauaaccugcaucuuuugcaaagcccuuuucuaccuacucaucauaaucggcacccucggcaagaaaauaaaacaauaccgagagcucaagccacaaacgugcacuaucugcgaaacagcccccgucaacgcuauagacgccgagaugcacgaucucaauugcucauacaacauaugccccuacugcgcaucccgccugaccuccgacggacucgcucgacacgucacccaaugcccgaagcgaaaggaaaaggucgaggaaaccgaacuauaccuaaaccucgaacggaucccguggaucguccguaaacuccuccaaguaucggagagcacaggcguggcccucaagcgcaguagcuggcucaccguacuucuaguucuacuaacagucucccuaagccccguucaaucagcaccaguaggccgcaagccccuauuccucgauagcaucgccaaaggcaugaaaaaccuacuuaacuccaccagccucgaaacaagccuauccauagaagcaccuuggggagcaaucaauguucaaagcacguucaagcccacugucuccaccgccaacauagcccuaucauggaguuccgucgaacacagaggcaacaaaauccuagucacaggacgcuccgagucaauaaugaagcuagaagagagaacaggcgucucaugggacuuaggcgucgaagacgcgucggaauccaaacuacuaacggucuccaucauggaccucucccaaauguacuccccagucuucgaauacuuauccggagaccgacagguggaagaguggccaaaggcaaccugcacaggcgacugccccgaacgcugcggaugcaccuccuccacuugccuacacaaagaauggccccacucacggaacuggcgcugcaacccaaccuggugcuggggcguaggcacagggugcacuugcugcgggguagacguaaaagaccucuucaccgaccacauguucaucaaauggaaaguagaauacauuaaaacagaagcaauaguauguguagaacuaaccggccaagaacgacaauguucccuaauagaagccggaacucgcuucaaccuggggcccguaacgauaacccuaagcgaaccccgaaacauacaacaaaaacuuccuccagaaauaauuacccuacaccccaaaaucgaagaaggguucuucgaccuaaugcacguccaaaaaguccuuucagcaucgacuguaugcaagcuacaaucuugcacgcacgggaucccaggagaccugcaaauauaucacaucggaaaucuccuaaaaggagaccgcguaaacgggcaccuaauccauaaaauagaaccucacuucaacaccucauggaugagcugggauggcugugaccucgacuacuacugcaacaugggcgacuggccguccugcacauacaccggcgucacacaacacaaccacgcagccuucgugaaccuccuaaacauagagaccgacuacaccaaaacauuucacuuccacagcaaacggguaaccgcccacggugacacaccccagcuagaccuaaaggcccgacccaccuauggugccggugaaaucaccguccucgucgaaguagcagacauggaacuccacaccaagaaagucgaaauaucgggccuaaaauucgcgagccugacgugcaccggcugcuacgccuguagcucgggcaucagcugcaaagucaggauucacguagacgaacccgacgaguuaacagugcacgugaaaucaucggacccagacguagucgcagcguccaccuccuugauggcccgaaaacuugaguucggcacagacagcacauucaaagcauucucggcgaugccaaaaacuucccuaugcuucuauaucguggaacgagaauacuguaaaucauguagcgaagacgacaccaaaaagugcguggacaccaaacuggaacaaccccaguccauacucaucgaacacaaaggcaccauaauaggcaaacaaaacgauaccugcacagccaaagcauccuguuggcuggaaucagucaaauccuucuucuauggccucaaaaacauguuaggcucgguauucgggagcuucuucgucggaauccuccucuuccucgccccauucguccuccuuguacuuuucuucauguucggauggaaaauccuauucugcuucaaaugcugccgcagaacacgaggccucuucaaguacagacaccugaacgacgacgaggagaccggcuaccgaagaauaauagaacgacucaauucuaaaaagggcaagaaccgccugcuggacggagaacgucuugcagaccgcaagaucgcagagcuauucuccaccaagacacacaucggc

SEQ ID NO: 15570 - RNA, 2916 nt, Artificial Sequence
  derived and/or modified CDS sequence (opt11) from CCHFV(K340_6, Artificial)__KX013475.1__Gn-4aa-Gc
agcgaggaaccaggugacgacugcauuucgcgcacccaacuccuaaagaccgaaacagccgagauccacgacgauaacuacggcggucccggugacaagauaacgauaugcaaugggagcacaaucguagaccaacggcucggcucggaacucggaugcuacacgaucaacagagucaagucauuuaaacuuugugaaaacagcacgaccgggaagaccugcgaaaucgacagcacgccuguaaaaugccgccagggguucugucucaagauaacacaagaaggucgcggacauguaaaacucucgcgcggcucagaagucguacuagacgcuugcgacucuucuugcgaaauuaugauaccgaaaggcaccggagacaucuuaguagacugcagcggcggacaacaacacuuccugaaagauaaccucaucgacuuaggcugcccucacauaccgccccuuggaaaaauggcaauauacaucugccgaaugucaaaucacccccggaccacaauggcauuccuauucugguucuccuucggauacgugauaacaugcaucuucugcaaagcccucuucuacagccucaucaucauaggcacacuaggaaagaaaauaaagcaauacagagaacugaaaccccaaacguguacaauaugcgaaaccgcccccguaaacgccaucgacgcugaaaugcacgaccuaaacuguucguacaacauuugccccuacugcgccagucggcuaacaucggacggccuagcacgccacgucacgcaaugcccgaaacgcaaagaaaaagucgaagaaaccgagcuguaccuaaaccucgaacgcauaccauggaucguucggaaacugcuacaagucucagaaagcacgggcguagcacugaaacgauccuccuggcuaaucguacucuuaguacuacucaccgucucacucagcccaguccaguccgcgccgguaggacggaaaccacuaucauuagacuccaucguaaagggcaugaaaaaccuccucaacucaaccagccucgaaaccuccuuaucaaucgaagccccauggggagcgaucaacguccaaucuacguucaaaccaaccguaaguaccgcaaacaucgcacuguccugguccagcguugagcaccgaggcaacaaaaucuuagucacgggucgaagcgaaagcauuaugaaacuagaagaaagaacuggcgucucgugggaccucgguguagaagacgcuagugagagcaaacuacuaacuguuuccaucauggaccuuucccaaauguacucacccguguuugaauaccuaucaggugaccgccaagucgaagaauggcccaaagccacaugcaccggcgacugccccgagcgcugcggcugcacaagcucaaccugccuccacaaagaauggccccacagccgaaacuggagaugcaacccaaccuggugcuggggaguggggaccggauguaccugcugcggcguagacguaaaagaccucuucaccgaccacauguucauaaaauggaaggucgaguacauaaaaacagaagccaucgucugcgucgagcugaccucccaagaacgccaaugcagccuuauagaggcaggaacgcgguucaaccucggacccgugacaaucacgcuuagcgaaccacgaaacauacaacaaaaacuaccacccgaaauaaucacccugcaccccaaaauagaggaaggcuucuucgacuuaaugcacguacaaaaaguccucuccgcguccacugucugcaaacuccaaucgugcacccacggcauacccggugaccuccaaaucuaucauauaggaaaucucuuaaaaggcgaccgagucaacggccaucucauccacaaaauagaaccccacuucaacacaucguggauguccugggacggaugcgaccucgacuauuauugcaauaugggcgacuggcccuccugcaccuacacaggcgugacccagcacaaccaugcugcuuucguaaacuuacuuaacauagaaacagacuacacaaagacauuccacuuccauuccaaacgagugacagcccacggagauacuccucaacuagaccucaaagcccgcccuaccuacggcgccggagagaucaccgugcucgucgaaguuaccgacauggaauuacacacaaagaaagucgaaauuuccggucuuaaauucgccucccuaaccugcacaggaugcuaugccugcuccuccgggauauccugcaaaguccgcauucacguagacgaacccgacgagcuaaccguucacguaaaaagcucugacccagaugucguagcagccucaaccucccugauggcccgaaaacuugaguucgguaccgacucaaccuucaaggcuuucuccgccaugccuaaaacgucacucugcuuuuacaucgucgaacgcgaguacugcaaaagcugcucggaggacgacaccaaaaagugcgucgacaccaaacuagaacaaccucaaucaauacuaaucgaacacaagggcacuauaauaggcaagcaaaacgacacaugcacagcaaaagccucaugcuggcucgaaucggucaaguccuucuucuacggacucaaaaacaugcucggguccguauucggcagcuuuuucguaggcauccuccuauuccucgcaccauucguacuccucguacuguucuuuauguucggcuggaagauccuauucugcuucaaaugcugccgcagaacucgaggacucuucaaauacagacacuucaaagacgaugaagaaaccggcuaccgacgcauaauagagcgucucaacagcaaaaaggggaaaaacagacuccuugacggagagcgccucgcggacagaaaaauagccgaacucuuuuccaccaaaacccacaucggc

SEQ ID NO: 15571 - RNA, 2916 nt, Artificial Sequence
  derived and/or modified CDS sequence (opt11) from CCHFV(Mamon, Artificial)__KX013478.1__Gn-4aa-Gc
uccgaagaaccgggagacgauugcaucucacgaacgcaacuacugcgaacagagaccgccgaaauccacgacgacaacuauggaggcccgggagauaaaaucacaaucugcaacggauccacuaucgucgaccaacgacugggcuccgaacucggcuguuacacgaucaaccgcguuaagagcuucaaacucugcgagaacagcgccaccggcaaaacgugcgaaaucgacucaacgccggucaaauguagacagggauuuugccuaaaaauaacacaagaaggccgcggccacguaaaacuaucccggggcagcgaaguggucucagacgcaugcgauucauccugcgaaguaaugauuccgaaaggcaccggcgauauccuagucgacugcuccggaggucaacaacauuuccuaaaagacaaccucaucgaccucggcugcccacacauuccacugcucggaaagauggcaauauacaucuguagaauguccaaccacccacguaccaccgucgcauuucucuucugguucucauucggcuacgucaucacaugcaucuucugcaaagcccuauucuacucccucauaauuaucggaacacucggaaagaaaaucaaacaauaccgcgaacuaaaaccacagaccugcaccauuugcgaaacggcaccagucaacgccaucgacgccgaaaugcacgauuugaauugcagcuacaacaucugccccuacugcgccagccgacucacuucagacggacucgcccgccacgucccccaaugcccuaaaaggaaggaaaaaguggaggaaaccgaacucuaccuaaaccuagaacgaaucccauggauaguacgcaaacuccuacaggucucagaaucuacaggcguagcccuaaaacgauccuccuggcucauagucuuacucguucuccugacgguaagccuuucccccguucaaagcgcgccagucggacgcaaaccacuuuuucuagacagcaucgucaaaggaaugaaaaaccuacucaacucgaccagccucgaaaccucacuauccaucgaagccccauggggcgccaucaacguccaaagcaccuucaaacccaccgucagcacagcaaauauagcacuaagcuggucaagcguggaacaccgggguaacaaaauccucguuacgggccgauccgagucaaucaugaaacuagaagaaagaaccggcgucuccugggaccucggcgucgaggacgccucugaaucgaaacugcucaccgucucaaucauggaccucucccaaauguacagcccuguauucgaauaccucuccggggaccgccaagucgaggaauggccaaaagcuacauguacgggugacugccccgagagaugcggcugcacaagcucaacgugccuacacaaagaauggccucacucgcgcaacuggcgaugcaacccaacaugguguuggggcguggggacaggcuguaccugcugcggcguagacguaaaggaucucuucacagaucacauguucguaaaauggaagguagaauacaucaaaacggaagcaaucguaugcguagaacuaacaagccaagagcgccaauguucccuaauagaagcaggaacacgguucaaccuaggcccaguuaccauaacccuaagcgaaccccgaaacauccagcaaaaacuaccgcccgaaauaauuacacuacaccccaaagucgaggaaggcuucuucgaucucaugcacguccaaaaaguccuaagcgccagcacugucuguaaacuccaguccugcacccacggaauccccggcgaccuacaaguuuaccacauaggcaaccuccuaaaaggcgaccgaguaaauggccaccuaauccauaagauagaaccacauuuuaauacguccuggaugucuugggacggcugugacuuagacuacuacugcaacaugggcgauuggcccuccugcacuuacaccggcguaacccagcacaaccacgcugcauucgucaaccuccuaaacauagaaacagacuacaccaaaaccuuucacuuccacucaaaacgugucaccgcucacggcgacacuccacaacuggaccucaaagcccgacccaccuacggggccggagagauuaccgugcucgucgagguagcugacauggaguuacacaccaaaaagguggaaaucuccggucuuaaauucgcauccuuagccuguacaggaugcuacgccugcuccucuggaaucucaugcaaaguccgcauacauguugacgaaccugacgagcugaccguacacguaaaaucuucagacccggacgugguagccgcuagcaccucucucauggcccgaaaacuugaguucggcaccgacuccaccuucaaagcauucucugccaugcccaaaaccucccucugcuucuacaucgucgaacgggaauacugcaaguccugcucagaagaagacacccaaaaaugcguugacacaaaacuagaacaaccccagucuauccucauugaacacaaaggcaccaucaucgguaaacaaaacgacacaugcaccgccaaaaccucaugcuggcucgaaucagucaaaucuuucuucuacggucucaaaaauaugcucggcagcguuuucgggaauuucuucaucggcauacuccuauuccuagcccccuucguccuccucguccuauucuucauguucggauggaaaauccuauuuugcuucaaaugcugccgucgcaccagaggacuccucaaauaccgccaccucaaggacgacgaagaaaccggguaccgacgcaucauagagcgccucaacaauaagaaagggaaaaaucgccuacucgacggagaacgacuagccgaccgcaagaucgccgaacuauucagcacaaaaacacacaucggu

SEQ ID NO: 15572 - RNA, 2916 nt, Artificial Sequence
  derived and/or modified CDS sequence (opt11) from CCHFV(Min, Artificial)__KX013481.1__Gn-4aa-Gc
ucggaagaacccggugacgacugcauuagccgaacccaacuuuuaagaaccgagacagccgaaauucaugacgacaacuacgggggcccuggggacaaaaucacaaucugcaacggcuccaccauaguagaccaacgccuaggcagcgaacuagggugcuauaccaucaaccgggucaaaucuuucaaacucugugaaaacucagccacaggaaaaaccugcgaaauagacuccacccccgucaaaugccgccaaggauucugccuaaagaucacccaagaaggccgaggccacgucaaacuaucacgcggguccgaaguaguccucgacgccugcgacuccuccugcgagguaaugauaccuaaaggcaccggggacauccucgucgacuguagcggcggccagcaacacuuccugaaagacaaccugaucgaccuaggcugcccgcacauuccccuccuaggcaaaauggccaucuacauuugcagaaugagcaaccacccgcgcacuacaauggcauuccucuucugguucucauuuggcuaugucaucacaugcauauuuugcaaggcccuguucuacucgcuaauaaucaucggcacacucggcaagaaaauaaaacaguacagagaacucaaaccccaaaccugcaccauaugcgaaaccgcccccgucaaugcgauagacgccgagaugcacgaucucaacuguuccuacaauaucugccccuacugcgcaucacgccugacgucagacggacuugcacgacaugucccccaaugccccaaacgaaaagagaaagucgaagaaacugagcuauaccucaaccucgaacgcauuccguggauaguccgcaaauuacugcagguaucagaauccaccggcgucgcucucaaacgcuccucaugguuaauuguucuccucguacuacuaacugucagccuaaguccaguccaauccgccccagucgggcgaaaaccccuauuccuggauuccaucgucaagggcacgaaaaaccuccugaacucuaccucacucgagacuucacuauccaucgaggcacccuggggagcaauaaauguacagucuacguucaaacccacagucuccaccgcgaacauagcgcuaucuuggucuucuguggaacaucgugggaacaaaauacugguaacaggacguagcgaaaguauuaugaaacuugaggaaaggacgggcguaucaugggaccucggcgucgaagacgcaagcgaaagcaagcuccucaccgucagcaucauggaucucucccaaauguacucccccgucuucgaauaucugagcggagaccgacaagucgaagaauggccgaaagcaaccugcaccggagacugccccgaacgaugcgguugcacaucaucaaccugccuccauaaggaauggccgcacagccguaacuggcgaugcaaccccaccuggugcuggggcguaggcacaggcugcaccuguugcggagucgacgucaaggaccucuucaccgaccacauguucgucaaguggaaggucgaauacaucaaaacagaagccaucguaugugucgaacuuaccucacaagaacgccaaugcucgcucauagaagccggcacacgcuucaaccugggacccguuacaaucacccuauccgagccccgaaauauacaacaaaaacugccgccagagauuaucacucugcacccaaaaguggaagaaggcuucuucgaucucaugcacguacaaaaaguccuuagcgccuccacaguaugcaagcuccaaagcugcacccacggcaucccuggcgaccuacaaguauaccacaucggcaaccuacucaaaggagaccgaauaaacggccaccucauacacaagaucgagccccacuucaacaccucauggaugagcugggacggaugcgaccucgacuacuauugcaacaugggcgacuggcccuccugcaccuacacgggagucacgcagcacaaccacgcagccuucgucaaccuguugaacaucgaaaccgacuacacaaaaaccuuccacuuccacuccaaacgaguaacagcccacggcgauacaccgcaacuagaccuaaaggcccgcccuaccuacggcgccggagagaucaccguacugguagaggucgcugacauggaacuacacaccaagaaagucgaaaucagcggccucaaauucgcaucacuagccugcacaggcugcuacgccuguagcucaggaaucuccugcaaagugcgcauacauguagacgaaccagacgaacuaacuguucacguuaaaagcucagacccagacgucguagcagccuccaccucccuaauggcacgaaaacuagaguucggaacggacucuaccuucaaagccuucucagccaugccaaaaaccagucugugcuucuacauagucgaacgcgaguauugcaaauccugcuccgaagaagauacccaaaaaugcgucgacacuaaacuggaacaaccacaaucgauccuuauagagcacaaaggcaccaucaucggcaaacagaacgacacuugcaccgccaaggcaucgugcuggcucgaaucagucaaauccuucuucuacgggcucaagaacaugcuuggcagcguauucgggaacuucuucauaggaauccuccucuuccuggccccguucguccuacucguccucuuuuucauguucggauggaaaauccucuucugcuuuaaaugcugcagacgcacccgcggccuacuuaaauaccgacaccuaaaggacgaugaagaaacgggguaucggcgcauuaucgagcgccuaaacaacaagaaaggcaaaaaccgacuucucgacggagaacgccucgcugaucgcaaaauagccgaacuuuucuccaccaaaacccacauuggc

SEQ ID NO: 15573 - RNA, 2916 nt, Artificial Sequence
  derived and/or modified CDS sequence (opt11) from CCHFV(Nakiwogo, Artificial)__KX013484.1__Gn-4aa-Gc
gcugaaggaguauccaacgacugcguaucgcgaacccagcucaucaaaaccgaagucgcugagauccacgaagacagcuacgguggccccggcgaaaagaucacuaucugcaacggcagcacaaucgucgaccaacgacuagguucugaauugggcugcuacacaaucaacagaguuaaaaccuacaaacuaugcgagaacucagccacugagaagggcugcgaaaucgacuccguucccgugaagugcaaacaaggcuucugccucaaggucacucaggagggucgcggccacgucaaacuaucccgcggaacagagaucguucucgacgucugcgauaccucuugcgaacucaugaucccaaaaggcaccggugauauccuuguagacugcuccggaggccaacagcauuuccuucaagacaaccucauagaccucggaugcccgaacgucccccuacucggcaaaauggccauauacaucugccgaaugagcaaccaccccaaaacuaccauggccuuccuauucugguucucauucggcuacgucauaaccugcgucgucugcaaaguucucuucuaccuacugaucgucauagguacacuaggaaagaaacuaaaacaguaccgagagcucaaaccccagaccugcaucguaugcgaauccauacccguaaacgucaucgacgcggaaaugcacgaacucaacugcaacuacaacaucugccccuacugcgcaagccgccuaacaagugacggacugguacgucaugucacacaaugcccgaaacgcaaagagaaagucgaagagacagaacuuuaccuaaaccuugaacggauccccuggcucgucaggcgacuacuacaggucucggaaagcacaggcauggcccucaaacgcuccugcuggaugacuacgcuacuaauccuauuaguugucucccucucuccgguccaguccgcgccagugggaagaaaaccccuauaccuugacucgauagccaaaggcaugaaaucacuucuuaacucuacgaaccucgaaacaagccuuagcaucgaagcaccauggggcgcgaucaacgugcaaucaacauucaaacccaccgugagcgcagccaacauagcccuuucauggucauccgucgagcaccgaggaaauaaaauacucgucucaggccgcagcgaaagcauuaugaaacucgaggaacgaaccgggauauccuggagccucggcgucgaagacgccagcgaguccaaaaccuuaacagucagcgugauggaccuaucacaaauguacagcccaguguucgaguaccuuuccggcgaucgccaagucgaagaauggcccaaggcaaccugcaccggagacugcccugaacgaugcggcugcacuuccuccacgugccuacacaaagaauggccccacagccggaacuggcgcugcaaccccaccuggugcugggguguaggcaccggcugcacaugcuguggccucgacguccgcgaccucuucacagacuacaugauggucaaauggaaagucgaauacguuaagacagaagccauuaugugcguagaacuaacuucacaagaacgacaaugcagccuaaucgaagcagguacacgauucaaucuaggaccaguaacuaucacccuaagcgagccccgaaauguacaacaacggcuaccaucggaaauagucacccugcacccaaaaauagaagaaggauucuucgaccucaugcacguacaaaaaguacuauucugcaaacauagucugcaagcaacauccugcacccauggcgucccaggagaccuucaaguuuaccacguaggcaaccugcucaaaggggacaaaguaaacgggcacuccauccacaagauagaaagccacuucaacacauccuggauguccugggacggcugcgaccuggacuauuucugcaacaugggagauuggccaucgugcaccuacacuggcgucacccaacacaaccgagccgccuuugucaacaugcugaacauagagaccgauuacaccaaaaccuuucacuuccacagcaaacgggucacggcccacggggacacgccacaguuagaccuuaaagcacgccccacuuacggagccggcgaagucaccguccuagucgaagucgcagaucucgagcuacacaccaagaaaauagaaguaucggggcuaaaauucgccagccuuaccugcucaggcuguuacgccugcucaaguggcaucagcugcaagguccgcauacacgugaacgaacccgacgaguucacaguccacgucaaguccaacgaccccgacgugguagcagccggcuccagccuaauggcccgcaaaaucgaacugggcgcagacuccacuuucaaagccuucuccucaaugcccaaaaacucauuaugcuucuacaucguagagagagacuacugcagcagcugcacagacgaugacacacagaaaugcguuaacacuaaauuagaacacccacaaagcauucucaucgaacacaagggcaccaucaucggcaaacaaaacgacacaugccccaccaaaaccuccugcugguuagaaucaguaaaaucauucuucuacggacucaaaaacaugcucggaggaauuuuuggcaacgucuuccuaggaaucuuccuauucuuagcaccauucgcccuccucauacuguucuucuucuucggcuggcgcuuacucuucugccugaaguguugucgaagaacccggggacucuuaaaauacaaacaacucaaggacgaagaagaggcaggcuacaagaaaaucaucgagcgccucaaugacaagaaagguaaaagccggcuuuucgacggugaacgccuagccgauaggaagaucgcagaacuguucucuacaaaaacccacaucgga

SEQ ID NO: 15574 - RNA, 2916 nt, Artificial Sequence
  derived and/or modified CDS sequence (opt11) from CCHFV(Saf, Artificial)__KX013487.1__Gn-4aa-Gc
agcgaggaaccaggagacgacugcaucucccggacccagcugcuccggaccgagacggccgagauccacgacgacaacuacggcggcccgggggacaagaucaccaucugcaacggcagcaccaucguggaccagcgccugggauccgagcuaggcugcuacaccaucaaccgcgucaagagcuucaagcucugcgaaaacuccgccacgggcaagacuugcgagaucgacagcacccccgugaagugccgccagggguucugcuugaagaucacgcaggagggcagagggcacgugaagcugagccgcgguagcgaggucgugcucgacgcaugcgacuccagcugcgaggugaugauccccaaggggacgggcgacauacuggucgacugcuccggcgggcaacaacacuaccugaaggacaaccucaucgaccugggcugcccccacaucccgcugcucgguaagauggccaucuacaucugccgaaugagcaaccacccccgaaccaccauggccuuucuguucugguucuccuucggauacgugaucacgugcaucuucugcaaggcccuguuuuacagccugaucauaaucggcacccuggggaagaagaucaagcaauaccgcgaacugaagccccagaccugcaccauaugcgagaccgccccagugaacgcgaucgacgcugagaugcaugaccucaacugcuccuacaacaucugcccuuacugugcuagccggcugacgagugacggccuggcucggcacgucccccagugccccaaacgcaaggagaagguugaggagacggagcuauaccuuaaccuggagcggauccccuggaucgugcgcaagcuccugcaggucagcgaguccacggggguggcgcugaagaggagcagcuggcucaucguguugcugguccuccugaccgugucccugagcccuguacagagcgcccccgucggucgcaagccauuauucagcgauuccaucguuaaggguaugaagaaccugcugaacuccacgucccucgagacuagcuuauccauagaggcccccuggggcgccaucaaugugcagagcaccuucaagccgaccgucuccacggccaacaucgcgcugucuugguccagcguagagcaccggggaaacaagauccucgugaccggccgauccgaaagcaucaugaagcuggaggagcggaccggagucuccugggaccuggggguggaggacgccagcgaguccaagcuccugaccgucagcaucauggaccugagccagauguacucccccgucuucgaauaccucagcggcgaccgccaaguggaggaguggcccaaggccacgugcacuggggacugccccgaacggugcggcugcaccuccagcacgugccugcauaaggaguggccgcauucccguaacuggaggugcaaccccaccuggugcuggggagucgggaccggcuguacuugcugcgggguggacguaaaagaccuguucaccgaccauauguucgucaaguggaagguggaauauaucaagaccgaggccaucgugugcgucgagcuuacaagccaagagagacagugcucccugaucgaggcgggaacccgcuucaaccuggggcccgugaccaucacacugagcgagccccggaacauccagcagaaacucccgccagagaucaucacgcugcaucccaaaguggaggaggguuucuucgaccugaugcacguacagaaagugcucuccgcgagcaccgugugcaagcugcaguccugcacccacggcauccccggggaccugcaggucuaccacaucggaaaccuccugaagggggaccgcguaaacggccaccugauccacaagaucgagccgcacuucaacaccagcuggauguccugggacggcugcgaccucgacuacuacugcaacaugggggacuggcccagcuguacguacaccggcgugacccagcacaaccacgccgccuucguuaaccuacugaacaucgaaaccgacuauaugaagaccuuucacuuccacucaaagcgagucaccgcccacggugauacgccccaguuagacuugaaggcccgcccgaccuacggcgccggggagaucacagugcuggucgagguggccgacauggagcuccauaccaagaagguggagaucagcggccugaaauucgucucccuggccugcaccggaugcuacgccugcagcucugguaucuccugcaagguucggauucacguggacgagccugacgagcucaccguccacgucaagucuuccgacccagaugugguggccgcgagcacgucgcugauggcccgcaagcuggaguucggcaccgacagcaccuucaaggccuucuccgccaugcccaaaacaagccucugcuuuuauaucguagaacgggaguacugcaaauccugcagcgaggaggacacgcagaaaugcguggacaccaaacuugagcagccgcaguccauccugaucgaacacaaggguaccaucaucggcaagcagaacgacacgugcaccgcgaaggccagcugcuggcucgaguccguuaagagcuucuucuacgggcugaagaauaugcugggcuccgucuucgguaacuucuucaucgggauccuccuguuccuggcacccuucguucuccugguccuguucuucauguucggcuggaaaauucucuucugcuuuaagugcugccgccggacccgggggcugcugaaguaccggcaccucaaggacgacgaggagaccggcuaccgccggauuaucgagcgccugaacaacaagaaagggaagaaccggcugcucgacggcgagcgccuggccgaccguaaaaucgccgagcuuuucagcaccaagacgcacauaggg

SEQ ID NO: 15575 - RNA, 2916 nt, Artificial Sequence
  derived and/or modified CDS sequence (opt11) from CCHFV(Ast199, Artificial)__KX056051.1__Gn-4aa-Gc
agcgaagaacccggcgacgacugcaucucucgcacacaacuccuaaaaaccgagaccgcagagauccacgacgauaacuacggaggacccggagacaaaaucaccauaugcaacggauccaccaucgucgaucaacggcugggcucagaacucgggugcuacaccaucaacagggucaagucuuuuaaguugugcgaaaauucagcaaccggcaagaccugcgaaauugacuccacccccguaaaaugccgacagggcuucugcuuaaaaauaacccaagaaggccgaggccauguaaaauugucccguggauccgaagucguccucgaugcuugcgacucaucaugcgagaucaugauacccaaaggcaccggcgacauccuuguagacugcucuggagggcaacaacacuuccugaaagacaaccucaucgaccugggaugcccacauauuccucucuuaggcaaaauggccaucuacaucugccggaugagcaaccacccccgcaccaccauggccuuccuauucugguuuuccuucggcuacgucauaacaugcaucuucugcaaagcccucuucuacuccuuaauaaucaucggcacgcucggaaagaaaauaaaacaguacagggaacugaaaccacaaacuugcacgaucugcgaaacagcgccagucaacgcgaucgacgcagaaaugcacgaccuuaacugcucauacaacaucugcccguacugcgcaucccgucucaccucggacggccucgcacgacacgucacccagugcccuaaacggaaggagaaagucgaagaaacagaacuauaccucaacuuagaaaggauacccuggaucgugaggaaacuccuucagguaagcgaaagcaccggcgucgcccuaaaaagaugcuccuggcucaucgugcuccugguccuccuaaccgugucccuuuccccagugcaauccgcaccgguaggacggaaaccccucuuccuugacuccauugucaagggcaugaaaaaccuccuaaacucgacaagccucgaaaccucccuauccauagaagcccccuggggagccaucaacguucaauccaccuucaagccaacaguaucaacagccaacaucgcacuauccuggagcuccgucgagcaccgcggaaacaagauccuagucacuggccggucagagucaaucaugaagcuagaagaacgcacaggcgugucaugggaucucggcguugaagaugcaucggaaagcaaacugcuaaccgucagcaucauggaccucucgcagauguacagccccguauuugaauaccugagcggugaccggcaaguugaagaauggccuaaagcuaccugcaccggggacugccccgaacgcugcggaugcacaucgucuacgugccuccacaaggaauggccucacucccgcaacuggcguugcaaccccaccuggugcuggggagucggaacgggcuguaccugcugcggcguagacgucaaggaccucuucaccgaccacauguuuauaaaauggaaaguagaguauaucaaaaccgaggcaauagugugcguagaacucaccucccaagaacgccaaugcucacucauagaggccggcaccagauucaaccuaggaccagucaccaucacccugucagaaccccgcaacauacaacaaaaacuuccacccgaaauaauaacacuacauccuaaaauugaggaaggcuucuucgaccuuaugcauguccaaaaaguacucuccgccuccacugucuguaaacuccaaucaugcacccacggaauacccggcgaccuucaaauauaccacauaggcaaccuccuaaaaggagaccgccuaaacggacaccuuauccauaagauagaaccccacuucaacaccaguuggauguccugggauggcugcgaucucgacuacuacugcaacaugggcgacuggccaagcuguaccuauaccggaguaacccaacauaaccacgccgcauucgucaaucuccuaaauaucgaaacagacuacaccaaaacauuccacuuccacucuaagagaguuacggcccacggagacacaccacaacuagaccucaaagcccgaccaacauacggagccggcgaaauaaccguccuugucgaagucgcagauauggaacuccacacgaagaaaguagaagucucaggccucaaauuugccucacucgccugcaccggcuguuaugccugcuccagcggcauuuccugcaagguccgcauccacguagacgagcccgacgaacucaccguccaugugaaauccucagacccagaugucgucgccgccucgacguccuuaauggcccggaaacucgaguucggcacagacucgacauucaaagccuucucggcuaugcccaagaccuccuuguguuucuacaucgucgaaagggaguacugcaaguccugcuccgaggacgacaccaagaaaugcguagacacgaaacuagaacaaccacaaagcauacucaucgaacauaaaggcaccaucaucggcaaacaaaacgacacuuguacagcaaaagcguccuguuggcucgaauccgucaaauccuucuucuacggcuuaaagaacaugcucggcucgguauucggaaauuucuucgucggaauccuacuauuccuagccccguucguccuccucguacuauucuucaucuuuggcuggaagauccuguucugcuuuaaauguugccggcgaacacgaggacucuucaaguaccgccaccucaaggacgacgaggaaaccggcuauagaaaaaucauagaacgucuuaacucgaagaaaggcaagaaccgacugcuagacggagagaggcucgcggaccgaaaaauagcagaacucuucagcaccaagacccacaucggu

SEQ ID NO: 15576 - RNA, 2916 nt, Artificial Sequence
  derived and/or modified CDS sequence (opt11) from CCHFV(Ast149, Artificial)__KX056054.1__Gn-4aa-Gc
agcgaagaaccaggagacgacugcauaucccggacucagcuacucaaaaccgaaacagcagagauccacgacgacaacuacggaggaccaggagacaagaucaccaucugcaacgguucaacaaucguagaucagaggcuaggauccgaacuaggcuguuacacgaucaaccgaguaaaaucauuuaaacugugcgaaaacagcgccacaggaaaaaccugcgagaucgacagcacccccgucaaaugcaggcagggauucugucucaaaauaacacaagaagggcggggucacgugaaacuaucccgcgguagcgaagucguccuugacgcaugcgacucgucaugcgaaauaaugaucccaaaaggcaccggcgacauccucgucgacugcucaggaggccaacagcacuuccucaaagacaaucuaauagaccucggcugcccacacaucccucuacucggcaaaauggccauauacaucugccgaauguccaaucacccccgaacaacaauggccuuccuauucugguucucguucggguacgugaucacaugcaucuuuugcaaagcccuuuucuacagccucauuaucauuggaacacuaggaaagaaaauuaaacaauaccgcgaauuaaaaccgcagacgugcaccauaugcgaaacugccccagucaacgcaaucgaugccgaaaugcacgaccucaacugcuccuacaauaucugcccguauugcgcaucacgccucacauccgacggccuagcacggcacguaacucagugcccgaaacgcaaggaaaaagucgaagaaacagaacucuaccugaaccuagaacgcauaccguggauagucaggaaacuacuccaagugagcgagucgacaggcguagcccucaaacgaucgaguuggcuuaucguucugcuaguccuccuuaccguaucucuuucccccguacagagcgccccagucggccgcaaaccacucuucuuagacagcaucgucaaaggcaugaagaaccuccugaacucaacaagccuugaaacuucgcuuuccaucgaagcccccuggggcgccaucaacguacaaagcacauucaagcccaccgucaguaccgcgaacauagcacuaagcuggucauccguggagcacagagguaacaagauucuuguaaccgggcgcagcgaguccauuaugaagcucgaggaacgcaccggaguauccugggaccuaggcgucgaagacgccagcgaaagcaagcuccuaaccgugagcaucauggaccucucucaaauguacuccccagucuucgaguaucuauccggagaccgccaagucgaagaauggcccaaggccacguguaccggcgacugcccggagcgcugcgggugcaccucaaguaccugccugcacaaagaauggccacauagccgcaacuggagaugcaacccgacauggugcuggggaguaggaaccggcugcacuuguugcggagucgacguaaaagaccuuuucaccgaccacauguucaucaaauggaaggucgaauacaucaagaccgaagcuaucgucugcgucgagcuaaccagccaagagcggcagugcucacuuaucgaagcgggaacacgcuuuaaccucggcccggucacaaucacccucucagaaccacguaacauacagcaaaagcuaccaccagaaauaauuacgcuucaccccaaaaucgaagaaggcuucuucgaccuaaugcacgugcaaaaaguucuauccgccuccacaguaugcaaacuacaaucaugcacucacggaauccccggcgaccuccaaauuuaccacauaggcaaucuccuuaaaggcgaccgguuaaacggccaccucauccacaaaaucgaaccccacuucaauacaucauggaugucgugggacggcugugaucucgacuacuacugcaacaugggcgacuggcccucaugcacauacacgggaguaacacaacacaaccacgccgccuucgucaaccuacucaacauugagacagacuacaccaaaacauuccacuuccacucaaaacgcguuacagcacacggcgacacaccccaacuggaccucaaagcccgacccaccuacggagccggagagaucaccguccucgucgaagucgcugacauggaacuacacacgaagaaagucgaagucuccggacucaaauucgcgagccuagccugcacaggaugcuacgccugcucauccggaaucucguguaaaguacgaauccacgucgacgaaccagacgaacuuacggugcacguaaaaucauccgaccccgaugucgucgccgcauccacaucacucauggcccgcaaacucgaauuuggcaccgacuccaccuucaaagccuucuccgccaugccaaaaaccagccucugcuucuacauugucgaacgcgaauacuguaaaucaugcucugaggacgacaccaagaaaugcguagacaccaaacuagaacaaccccaauccauacucauagaacacaaaggaacuaucaucggcaaacagaacgacacgugcaccgccaaagccagcugcuggcuagagucagucaagucauucuuuuacggacucaaaaacaugcucggcucaguguucgguaauuucuucgucggaauacuccucuuccucgccccguucguccuccuagcccucuucuucaucuucggcuggaaaauacucuucugcuucaaaugcugccgacgcacaagaggucucuucaaauaccgccaccugaaagacgacgaagagaccggauacagaaaaauaauagaacgccucaacucgaagaaaggcaaaaaccgacuacucgacggggaaagacuugccgaccgcaaaaucgcagaacuauucagcacaaaaacacacaucggc

SEQ ID NO: 15577 - RNA, 2916 nt, Artificial Sequence
  derived and/or modified CDS sequence (opt11) from CCHFV(Ast137, Artificial)__KX056057.1__Gn-4aa-Gc
agcgaggagcccggcgacgacugcaucucccgcacacagcugcucaagaccgagacagcugagauacaugaugacaacuaugggggaccgggggacaagaucacuaucugcaauggcucuaccaucguggaccagaggcugggguccgagcugggcugcuacaccaucaaccgcgucaagagcuucaagcucugcgagaacucugccacgggcaagaccugcgagaucgauaguacccccgugaaaugccggcagggguucugccugaagaucacccaggagggccgcgggcacgucaaacugucgcggggcagcgaaguugugcucgacgcgugugauuccagcugcgagaucaugauccccaaggggacgggagacauccugguggacugcuccgggggacaacaacacuuuuuaaaagacaaucucaucgacuugggcugcccccacaucccgcugcucgggaagauggccauacacaucugccgaaugucaaaccacccccggaccaccauggcuuuccuguucugguuuuccuucggcuacgucaucacgugcaucuucugcaaggcgcuguucuauucgcucaucaucaucggaacgcuggggaagaagauuaagcaguaccgcgagcuuaagccucagaccugcaccaucugcgagaccgcacccgugaacgcgaucgacgccgagaugcacgaccucaacugcucauacaacaucuguccguacugcgccagccgguugacguccgauggucuggccagacacgugacccagugccccaaacggaaggagaaggucgaggaaacugagcuauaccugaaccuugaacgcaucccauggaucguacgaaaacuccuccaggugucugaguccaccggugucgcgcuaaagcgcagcagcuggcucaucgugcugcuggugcuccugacggugucccugagccccgugcaguccgcgccggugggccggaagccccucuuccuggacagcaucgucaaggggaccaagaaucugcucaacuccacuucacuggagaccucccugagcaucgaggcccccuggggcgcgauaaacguucaguccacguucaagcccaccguaagcaccgccaacauugcgcucuccuggagcuccgucgagcaccgcggaaacaagauccucgugaccgggcggagcgaguccaucaugaagcuggaggagcgcacgggagugagcugggaccucggggucgaggacgccuccgagagcaagcugcuaaccguguccaucauggaccucagccagauguacagcccugucuucgaguaccugaguggcgaccgucaaguggaggaauggcccaaggccaccuguaccggggacugccccgagcguugcggcugcaccagcucuaccugccugcauaaagaauggccccacagccggaacuggcgcugcaacccgaccuggugcuggggcguggggacuggcugcacgugcugcggggucgacgucaaggaccucuucacggaccacauguucauuaaauggaagguggaguacaucaagaccgaggccaucgucuguguggaguugaccucccaggagcgccagugcagccugaucgaggccggcacccgguucaaccuggggcccgugacgaucacucuguccgagccccgcaacauccagcagaagcugcccccugagaucaucacccugcaccccaagaucgaggaaggcuucuucgacuuaaugcacguccaaaagguucugagcgcgucaaccgugugcaagcugcagagcugcacgcacggcauccccggugaccuccaaauauaccauaucggcaaccugcuuaaaggggacagacucaacggccaccugauccacaagaucgagccccacuuuaacaccuccuggaugagcugggacggcugcgaccuggauuacuauugcaacaugggggacuggccguccugcacauauaccggcgucacgcagcauaaccacgccgccuucgugaaucuccugaauaucgagaccgauuacaccaagaccuuccacuuccacagcaaacgcguaacggcccacggggacacgccacagcuggaccucaaggcccggcccacauauggagcgggagagaucaccguccugguggagguggccgacauggagcugcacacaaagaaggucgaggugucaggccucaaguucgccagccuggcuugcaccggcugcuacgccugcuccucugggaucagcugcaaggugaggauccacgucgaugagccggacgagcugacugugcacgugaaaucuagcgaccccgacgucguugcggccuccaccagccugauggcccggaagcuggaguucggcacggacuccaccuucaaggccuucagcgcgaugcccaagaccucccugugcuucuacauaguagagcgcgaguacugcaagagcugcagcgaggacgacaccaagaagugcguugacacuaagcuagagcagccgcagucgauccugaucgagcacaaggggaccaucaucggcaagcagaacgauaccugcaccgccaaggccuccugcuggcuggagagcgugaaguccuucuucuacgggcucaagaacaugcugggcagugucuucggcaacuuuuucgucgggauccuccuguuccuggccccguucgugcugcucgucuuauucuucauauucgguuggaagauccuguucugcuuuaagugcugccggcgcacgcgaggacucuucaaauaccgccaccugaaagacgacgaagagaccggguaccggaagaucaucgagcgccuuaacuccaagaaggggaagaaccggcugcuggacggcgagcgccuggccgaccggaagauagcggaguuauucagcaccaaaacccacaucggc

SEQ ID NO: 15578 - RNA, 2916 nt, Artificial Sequence
  derived and/or modified CDS sequence (opt11) from CCHFV(Ast133, Artificial)__KX056060.1__Gn-4aa-Gc
ucagaggaaccagacgacgacugcaucucccguacucagcuccuuaaaacagaaaccgccgaaauacacgacgacaacuacgguggccccggcgacaaaauaacgauauguaacggguccacgaucguagaucagcgccucggauccgagcuaggaugcuacacaauuaaccgcgucaaauccuucaaacuaugugaaaacucggccaccggcaaaaccugcgaaauagauucaacccccguaaaaugcagacaaggcuucugcuugaaaaucacucaagaaggacgaggccacgucaagcucucaaggggcuccgaggucguacuagacgcgugcgacagcuccugcgaaaucaugauccccaaaggcaccggcgacauccucguggacuguuccgggggccagcaacacuuucucaaagacaaccugauagaucucggcugcccacacaucccccuccucggaaaaauggccaucuacaucugcagaauguccaaccacccgcgcaccaccauggcauuccuauucugguucagcuucggcuacgucauaaccugcaucuucugcaaggcccucuucuaccuucuaauaauuauaggcacacuugggaaaaagauaaaacaauacagagaacucaaaccccaaacuugcacaauaugcgaaaccgccccaguaaacgccaucgacgcggagaugcacgaccuaaacugcuccuacaacauaugccccuacugcgccucccgccucacaagcgacggacuugcaagacauguaacucagugcccgaagcgcaaagaaaaggucgaggaaacagaacuauaccuaaaccuagaacgcauccccuggauaguccgaaaauuacuacaagucucggaguccacaggagucgcccucaaacgaucuagcuggcuaauagugcuccuaguccuacugaccgugagccucucccccguacaauccgccccagucggaagaaaaccccuguucucagacagcauagucaaaggaaugaagaaccuccucaauuccacaucccucgaaaccucccuaucgauugaagccccauggggagccaucaauguccaaucaaccuucaaacccacgguguccacggcaaacaucgcccucuccuggucguccgucgaacaccgagggaacaaaaucuuagugacaggcagauccgaaagcauaaugaaacuagaagaacgcacaggcgugagcugggaccucggcguagaggacgccucagaaaguaaacuccuaacggucuccaucauggaucuaucccaaauguauucccccguauucgaauaccuguccggagacagacaaguagaagaauggccaaaagcaaccugcacaggagauugcccagagcgcugcggcugcaccagcucuacaugccuacacaaagaauggccccacucaagaaacuggcgaugcaaccccaccuggugcuggggaguaggcaccggguguaccugcugcggcguggacguaaaagaucuauucaccgaccacauguucaucaaauggaaggucgaauacaucaagacagaagcaauagucuguguggaacucacaucccaagaaagacaauguagccucaucgaagcgggcacacgcuucaaccugggccccgucaccaucacucucagcgagccacgcaacauacaacaaaaacucccgcccgaaauaaucacccuacaucccaagauagaggaaggguucuucgaccuaaugcacguacagaaaguccucagcgcauccacagucugcaagcuccaaagcuguacucacggcaucccgggagaccuacagaucuaccacauagguaaccuccucaagggcgacagggugaacggccaucuuauacacaaaaucgaaccucacuucaauacaucauggaugagcugggacggaugcgaccucgacuacuacugcaacaugggagacuggccgagcugcaccuacacaggugucacccaacauaaccacgccgccuucguaaaccuccuaaacaucgaaacagauuacaccaaaacauuccacuuccacuccaaacgagugacggcccacggcgacaccccacaacuggaccuaaaggccaggcccacguacggcgccggugaaauaacaguccucguagaggucgcagacauggagcuacacaccaagaagguggaaaucagcggacucaaauucgcaagccuaacaugcaccgguugcuacgcaugcuccagcggcauaagcugcaaggucagaauccacguagacgaacccgacgaacuaacgguccacgucaaaucaucagacccagacguagucgccgccucgacaucacucauggcuaggaaacuagaguucggcacugacucaacauucaaagccuucagcgccaugccuaaaaccucucucugcuucuacaucguggaacgcgaauacugcaaauccugcucggaagacgacaccaagaaauguguagauacaaaacucgaacaaccacaaagcauccugaucgaacacaaagguaccauaaucggcaaacaaaacgacacaugcaccgcaaaagccucgugcuggcucgagagcgugaaaucguucuucuacggccucaaaaacaugcucggcucggucuucggcagcuucuucgucggcauauuacuuuuccucgcacccuucguccuucucgugcuauucuucauguucggauggaaaauacucuucugcuucaaaugcugccgacgaacacgugggcuuuuuaaauaccgacaccuuaaagacgacgaagaaacaggcuaucgccgaauaaucgagcgacucaacaguaagaaagguaaaaacagauuauuagacggggagcgccucgcggaucgaaaaaucgcagaauuauucagcagcaaaacucacaucggc

SEQ ID NO: 15579 - RNA, 2916 nt, Artificial Sequence
  derived and/or modified CDS sequence (opt11) from CCHFV(SK/2015/human, Artificial)__KX458183.1__Gn-4aa-Gc
ucagaagaguccggggacgacugcaucaguaggacccgacuccuccgcaccgagacggccgaaauccacggcgacucauacgggggccccggugacaaaauaacgaucuguaacgggaguaccaucgucgaccaacgacuaggcucagaaaugggaugcuacacaaucaaccgcgucaaauccuucaaacucugugaaaacuccgccaccgguaaauccugcgaaauagacuccaucccaguccgcugccgccaaggcuacugccucaaaaucacccaagaaggucgagggcacguaaaacuaagccgcggcagcgaagucguccucgacgcuugcgacucgucaugcgagguuaugauccccaaaggcaccggggauauccuagucgauugcuccgguggacagcaacacuuccuaaaagacaaccuaaucgaccucggaugccccaacaucccccuacuaggaaaaauggccaucuacauaugucgcaugagcaaccacccaaaaaccacuauggcauuccuauucugguucuccuuuggcuacgucaucacauguauucuauguaaggcuauauucuaccuucugauaauuguuggcaccuuggggaaacgcuucaaacaauaucgagaguuaaagccucaaacaugcaccauaugcgaaaccaccccugcaaacgccaucgacgccgagaugcacgaccugaacugcuccuauaccaucugcccguacugcgcaucccgccuaacaucagacggccucgcccgacacguaacacaaugccccaaacgcaaggaaaaaguagaggagacggaacuauaccucaaccuggagcgaauacccugggucguacggaagcuacugcaaguaucagaaucaacaggcguggccuuaaaaagaucuuccuggcuuauuguacuccucguacucuucaccgugagccucucacccguccaaagcgcuccuaucggcagacgcccacucuuccuggacuccauaguccgcggaaugaaaaacuugcugaacagcaccucccucgagaccucccugucaauagaagcgccauggggagccauaaauguccaauccaccuacaaaccuacagucucaaccgcuaacaucgcccuaucgugguccagcgucgaacaccgcgggaacaagauccucgucucgggcagaagcgaaagcaucaugaaacuagaagaacgaaccggggucagcugggaccuuggggucgaagacgccuccgaguccaagcuacucaccguauccgucauggaucuuagccaaauguacuccccagucuucgaguaccucucgggcgaccgacaagucgaagaauggccgaaagcgaccugcaccggcgacugcccagaacgcugcgggugcacaaccagcacaugccuccacaaagaauggccucacagccguaacuggcgaugcaacccaaccuggugcuggggcgucggcacgggcuguaccugcugcggacuagacgucaaggaccuauucaccgacuacauguucguaaaauggaaagucgaauacaucaaaaccgaagcaauuguuugcgucgagcuaacgagccaaggccgacagugcucgcuaaucgaggcagguacucgcuucaaccuuggaucugucaccaucacgcucagcgaaccccgcaacauccaacacaaacuucccccugaaaucauaacgcuacacccaagaaucgaagaaggcuucuucgaccuaaugcacguccaaaaaguccugucagcauccacagucugcaaacuacaaucaugcacacacggaguccccggagaucugcagguauaccacaucggaaaccuccucaaaggagacaaagucaacggucaccuaauccacaaaauagagccgcacuucaacacuucauggaugagcugggauggcugcgaucuugacuauuacugcaacaugggcgacuggccaagcugcaccuacacuggagucacgcagcauaaccacgccuccuucguaaaccuucuaaacaucgaaacagacuacaccaaaaacuuccacuuccacagcaaaagaguuacggcacacggcgacaccccacagcucgaucuaaaggcccgcccaaccuacggcgcuggcgaaaucaccguccuggucgaagucgcugacauggaacuccacacuaaaaagaucgaaaucuccgggcugaaauuugccucauuaacaugcaccggcuguuaugccugcuccagcggaaucuccugcaagguacgcauucacgucgacgaacccgacgagcucaccguacacguuaaauccgacgacccggacguagucgcagccucauccagcuuaauggcccgcaaacuggaguucggcaccgacucuacauuuaaggcauucucggccaugcccaaaacaucccucugcuuuuauaucgucgaacgagaauauugcaaaagcugcagcaaggaagacacccagaagugugucaacacaaagcucgagcagccccagucaauacucaucgaacacagaggcaccaucaucggcaaacagaacaacacuugcauagccaaagccucuugcuggcucgaaaguguaaagucauucuucuacggacuuaagaacaugcuauccggaauuuucggcaaccuguuccuaggaauauuccuauuccucgcacccuucauauugcuaauccucuucuuuauguuuggguggcgcauacucuuuugcuucaaaugcugccgacggacccgcggucuguucaaauaccgccaccucaaagacgacgaagaaaccggcuacagacgcauaaucgagcgccugaacaauaaaaaggguaaaaacaaacuacuugacggagaacgucucgccgacagacgcauagccgaacucuucagcaccaagacacacaucggc

SEQ ID NO: 15580 - RNA, 2916 nt, Artificial Sequence
  derived and/or modified CDS sequence (opt11) from CCHFV(YL16070, Artificial)__KY354081.1__Gn-4aa-Gc
gcagagggcggaucauccgacugcauaucacgaacccagcuaguaaaaaccgagguagcggaaauccacgaggacucauacggcggcccaggcgagaaaaucacgauaugcaacggguccacaaucgucgaccaacgacuaggcuccgaacuuggcuguuacacaaucaaucgagucaaaagcuacaagcuaugugaaaauagcgccuccggaaaauccugcgaaauagacucuauccccgucaagugcaaacaaggauucugccugaaaaucacccaagaaggacgcggccacguaaaacuaagccgcggcacggaaaucguacucgacgucugcgacuccuccugugaacucaugauccccaaaggcacaggagacauccucgucgacugcaguggaggccaacaacacuuucuacaaaacaaccugauagaucucgggugccccaacgucccccucuuaggaaaaauggcaauauacgucugccgcaugucuaaccaccccaagaccacaauggccuuccucuucugguucuccuucggauacguaauaacaugcaucgucugccgaguacucuucuaccuccuaaucgccaucggcacaguaggaaagaaacuuaaacaauaccgagaacucaagccccagaccugcaucguaugcgaaucaguacccguuaacgccaucgacgcagaaaugcacgaacuaaacugcuccuauaauaucugccccuacugcgccucccgccuuuccaccgacggauuaauacgacacgucacccaaugccccaagcgccgggagaaggucgaagagaccgaacuuuuccucaaccuagaacgcaucccauggcuagugcgaaaacugcuccaaguuucggaaucgacggggauggcucuaaaacgcucaugcuggaugauuacacuccucauucuacuucucguguccaugucgccgguccaaucugccccagucggacgcaaaccacucuuccuagacuccauagcaaaaggaaugaaaagccugcuuaacagcaccucccuugagaccucgcugucuauagaggcaccuuggggcgcgauaaacguccaaagcaccuucaaaccuaccgucuccgccgcaaacauugcccuauccuggucaagcguugaacacagaggaaacaagauccucgucucaggucgcagcgaguccaucaugaagcuggaagaacgaaccgggguauccuggaaccugggcguagaagacgccuccgaguccaaaacccucaccgucagcguaauggaccuaucacaaauguacagccccguauucgaguaccuuagcggcgaccgacaagucgaagaauggcccaaggcaacaugcacgggagauugccccgagcguugcgguugcaccucaagcacgugccuucacaaagaauggccacauucacgaaacuggcggugcaaccccacauggugcuggggcguaggcacaggcuguaccugcugcggccucgacguaaaagauuucuucaccgacuacaugcucguuaaauggaaaguggaguacaucaaaacagaggcgaucguuugcguggagcuuacgucccaagagaggcaauguucgcucaucgaagccggcacgcgcuucaaccucggacccgucaccauuacacuaucggaaccucgcaacguccaacaacgacuuccacccgagauagucacccugcauccuaaaaucgaagaaggguucuucgacuuaaugcacguacagaaaauccuaucagccucaacagucugcaaacuccaaucgugcacccacggcgucccaggcgacuuccaaguauaucacgucggcaaucuccucagaggcgacaaagucaacggccacagcauacauaaaauugagccccacuucaacaccuccuggaugucgugggauggcugcgaucuggacuacuucuguaacaugggcgacuggccaucgugcacauacacaggagugacccaacacaaccgggcagccuucauaaacaugcucaacauagaaacagacuacaccaagaccuuccacuuccauuccaaacgaguaacagcccauggcgacaccccucaacuagaccuaaaagcgcgucccgccuacggugcaggagaagucacgguccuugucgagguggccgaccuugaacuucacacaaagaaacuagaagucuccggccucaaaauugccucacucacaugcucaggaugcuaugccugcucgagcggaaucucaugcaaaguucgcauccacguuaacgaacccgaugaguucaccguacacguccgcuccucugaccccgacgucguagcagccggauccucccugauggcacgaaaaaucgaguucggagcggacucaaccuucaaagccuucuccucgaugccaaaagacucccucugcuucuacaucguagaaaaagacuacugcagcuccugcaccgacgacgauacccagaaaugcgucaacaccaaacuugaccacccacaaagcauccuuauugaacauaaagggaccaucauagggaaacaaaacgauaccugcuccacaaaaaccucaugcuggcucaaauccuucaaaggguucuucuacgggcuuaaaaacaugcucuccggcaucuucgggaacguauuccucggaauccuccuauucuuagccccauuuguacuccuaauauucuucuucuucuucggcuggcgccuccuauucugucuaaaaugcugcaagaaaaccaaaggacuccuaaaguacaaacaccucaaggacaaagaagaagccggcuacaaaaagaucauagagcggcucaaugggaaaaagggaaaaucucaacucuucgacggcgaaagacucgcaaaccggaaaauagccgaacucuucuccacgaaaauccacaucgga

SEQ ID NO: 15581 - RNA, 2916 nt, Artificial Sequence
  derived and/or modified CDS sequence (opt11) from CCHFV(Oman_812956, Artificial)__KY362518.1__Gn-4aa-Gc
agcgaggaguccggcgaggacugcaucagccgcacccagcugcuccguaccgagacggccgagauccacggggacaacuacggcgggcccggcgacaagaucaccaucugcaacggguccaccaucguggaccagcgccuggggagcgagcugggcugcuacaccaucaaccgggugaaguccuucaagcucugcgagaacagcgccacggggaaguccugcgagaucgacaacaccccugugaaguguaagcaaggcuuuugccugaagaucacccaggaggggcgcggccacgugaagcugagccgggacuccgaggucgugcucgacgcgugcgacagcuccugcgagaucaugauucccaaggggaccggcgacauccugguggacugcagcggcgggcaacagcacuuccugaaagauaaccucaucgaccuaggcugccccaacaucccccugcucgggaagauggccaucuacaucugccgcauguccaaccacccgaaaacgaccauggcguuccuguucugguucagcuucggcuacgucaucacgugcauccugugcaaggugaucuucuaccuccugaucguggucggaacccuggggaagaaguucaagcaguaccgggagcucaagccccagaccugcaccaucugcgagacaacccccgugaacgccaucgacgccgagaugcacgaccugaacugcuccuacaacaucugccccuacugcgcgagccgccugacguccgacggacucgcccggcacgugaugcagugcccgaagcgcaaggagaagaucgaggagaccgagcucuaucugaaccucgagcggauccccugggucguacgcaaguuacuccaggugagcgaguccaccggggucgcccugaagcggagcuccuggcugaucguccugcucgugcugcugaccgucucccucagccccgugcaguccgccccaaucggccgcaagccgcuguucuucgacagcaucgcgaaggggaugaagaaccugcugaacuccacgagccuggaaaccucccugagcaucgaggcccccuggggcgccaucaacgugcaguccaccuucaagcccaccgucucgacggccaacaucgcccucuccuggagcuccguggagcaccggggcaacaagauccuggugagcgggcgcuccgagagcaucaugaagcuggaggagcgaaccggcaucuccugggaccucgggguggaggacgcgagcgaguccaagcugcugaccgugagcgucauggaccucagccagauguacucccccguguucgaguaccugagcggcgaccgccagguggaggaguggccaaaggcgaccugcacgggggacugccccgagcguuguggcugcaccuccagcacgugccugcacaaggaguggccccacucccgcaacuggcggugcaaccccacuuggugcuggggcgucgggaccggcugcacgugcugcggucucgacgugaaagaccuguucaccgacuacauguucgugaaguggaaggucgaguacaucaagacagaggccaucgugugcguggagcugaccagccaggagcgccagugcucccugaucgaggccggcacccgcuucaaccucgggccggucaccaucacccugagcgagccccggaacauccagcagaagcugccgcccgagaucgugacccuccacccccgcaucgaggagggcuucuucgaccuaaugcacgugcagaagguccucuccgccagcacggugugcaagcuccaguccugcacccacggcgugcccggggaccugcagguauaccacaucggcaaccugcucaagggggacaaggugaacggccaccugauccacaagguggagccccacuucaacaccagcuggauguccugggacggcugcgaccuggacuacuacugcaacaugggggacuggcccagcugcaccuacacgggcgucacccaacacaaccacgccgccuucgugaaccuccugaacaucgagaccgacuacaccaagaacuuccacuuccacuccaagcgggugacggcccacggggacaccccgcagcuggaccucaaggcccgccccaacuacggcgccggggagaucaccguccuaguggagguggcggacauggagcugcacaccaagaaaaucgagaucagcggccucaaguucgccucccugacgugcaccggcugcuacgccugcagcagcgggaucuccugcaagguucggauccacguggacgagcccgacgagcugaccgugcacgucaaguccgaggacccggacauaguggccgccuccucgucccucauggcgcgcaagcuggaguucggcaccgacagcacguucaaggccuucuccgccaugcccaagaccagccugugcuucuacaucguggagcgggaguauugcaaguccugcagcaaagaggacacccagaagugugucaacgccaagcucgagcgcccccaguccauccugaucgagcacaaggggaccaucaucggcaagcagaacgacacgugcaccgcgaaggccagcugcuggcuggaguccgucaagucguucuucuacgggcucaagaacaugcugucuggcaucuucggaaacguguucaucggaaucuuucuguuccucgcccccuuuaucuugcugauccucuucuucauguucggcuggcggauccuguucugcuucaagugcugccgccggacccgagggcuguucaaguaccggcaccucaaggacgacgaggagaccggcuaccgcaagaucaucgagcggcugaacaacaagaaggggaagaauaagcugcucgacggcgagcgccuggccgaccggaaaaucgccgagcuguucagcacgaagacccacaucggc

SEQ ID NO: 15582 - RNA, 2916 nt, Artificial Sequence
  derived and/or modified CDS sequence (opt11) from CCHFV(UCCR4405, Artificial)__KY484029.1__Gn-4aa-Gc
agcgaagaaccgggcgacgacugcaucucccgcacacaauuacuaaagacggaaaccgccgaaauacacgacgacaauuacgggggcccaggcgacaagauaacaaucugcaacggaagcacaaucguagaccagcgccucggcuccgagcuaggaugcuacacaaucaaccgcgucaaguccuucaagcuaugcgaaaacuccgccacagggaaaacaugcgaaauugacuccacgcccguuaaaugccgccaaggguucugucuaaagaucacccaagaaggacgcggacauguaaaacucucccgcggcucggaaguaguccucgacgcaugcgauucaucgugcgaaguuaugauccccaaaggaaccggcgacauucucguggacuguucaggcggccaacaacacuuccugaaagacaaucucaucgaccucggcugcccccacauaccccuacucggaaagauggccaucuauauaugcaggauguccaaccacccacgaaccaccauggcuuuccuauucugguucuccuucggcuacgugauuaccugcaucuucugcaaagcacuuuucuacucacucauaaucaucgguacacucggaaagaaaaucaaacaauaccgagaacuuaaaccccagacaugcacaaucugcgaaaccgcacccguaaacgcaaucgacgccgaaaugcacgaccuaaaaugcucauacaacaucugcccauacugcgcuuccagacucaccagcgauggccuagcaagacacgucacccaaugccccaaacgcaaagaaaaggucgaagaaaccgaacuauaccuuaaccucgagagaauaccauggauaguacgcaagcuacuccaagucuccgaauccacuggcgucgcacuaaagcgcagcucauggcuaaucguccuccuagugcuccucaccgucagccuuagccccguccagagcgcccccgucggacggaaaccucuuuuccucgacagcaccgucaagggaaugaaaaaccuccuaaacuccacaucccuggagacgucccuauccaucgaggcccccuggggugccaucaacguccaaucaacauucaaaccaaccguguccacugcaaacauagcccucucauggucgagcgucgaacaccgaggcaacaagauacucgugacaggacgaagcgaauccaucaugaaacucgaggaacggaccggagucagcugggaccucggcguagaggacgcuagugagagcaaacucuuaacagucagcauaauggaccugucccagauguacucucccguauucgaauaccuauccggggaccgucaaguagaagaauggccgaaagcaaccugcaccggagacugcccagaacguugcggcugcacaagcuccacaugccuucacaaagaauggccacacucccgcaacuggcggugcaaccccacauggugcuggggagucggcaccggcugcacaugcugcggaguagacgucaaagaccucuucaccgaccauauguuugucaaauggaaaguagaauacauaaaaaccgaggccaucgugugcgucgagcuaaccagccaagaacgacaaugcucccuaaucgaagccggcacccgcuucaaccugggcccugucacaauaacccucuccgaaccccgaaacauucaacaaaaauugccgcccgagauaauaacuuuacauccaaaaauagaagaagguuucuucgaccuaaugcacguucaaaaaguuuuaucugccuccaccguaugcaaacuacaaagcugcacccacggaaucccaggggaccugcaaauauaucacauuggcaaccuccuaaaaggcgaccgcgucaacggccaccucauacacaaaauugaaccccacuucaacacaucauggaugagcugggauggcugcgaccucgacuacuacuguaacauggggaacuggcccucaugcaccuacaccggcguaacccaacacaaccacgccgcuuuugucaaccuccuuaauauagaaacagacuacaccaaaaccuuccacuuccacucuaaacgcguaacggcacacggcgacaccccacaacuggaccuaaaggccaggccaaccuauggcgccggcgaaaucaccguccuagucgaagucgcagacauggaacuacauacgaagaaaguugagaucuccggccugaaauucgccucgcucgucuguacuggaugcuacgccugcucaucaggaaucuccugcaaagucaggauccacguugaugagcccgacgagcuaaccguacacgugaaaucaagcgacccugacgucgucgccgcuucgaccucacuuauggcacgaaagcucgaguucggcacggacuccauauucaaagccuucagcgccaugcccaagaccagccucugcuuuuacauuguggaacgcgaguacugcaaaucaugcuccgaagacgacaccaagaaaugcguagacaccaaacuggaacaaccgcagucaauacucaucgaacauaagggcaccaucaucggcaagcaaaacgacacauguaccgccaaagcauccugcuggcuagaguccgucaagagcuucuucuacggccucaaaaacaugcugggauccguauucggcaacuucuuugucggcauccuccucuucuuagcaccauucguacuauuaguacuauucuucauguucggauggaagauccucuucugcuucaaaugcugccgucgaacacgaggccucuucaaauacagacaccuaaaagaugacgaagaaacaggcuaucgaagaauuaucgaacgccucaauuccaagaaaggcaaaaaccggcuacucgacggagagcggcucgcagaucgcaagaucgcugaacucuucagcacuaagacacacauaggc

SEQ ID NO: 15583 - RNA, 2916 nt, Artificial Sequence
  derived and/or modified CDS sequence (opt11) from CCHFV(UCCR4401, Artificial)__KY484035.1__Gn-4aa-Gc
uccgaagaaccuucggacgacugcauuucacgcacucagcuacuacgaaccgagaccgccgaaauccacggagacaacuauggcggacccggcgacaagauaaccauaugcaacgguucaaccaucguagaccaacgccuaggaucugaacucggcuguuacaccaucaaccguguacgauccuucaaacucugcgaaaacagcgccacgggcaaaaacugcgaaaucgacuccgugcccgugaaaugccgccagggcuacugccuccgaaucacacaagaaggccgagggcacgucaaacucagcagggguuccgaaguuguccucgacgcaugcgacacauccugcgaaaucaugauccccaaagggaccggagacauccucgucgacugcucuggaggucagcaacacuuccucaaagauaaucuaauagaccucggcugcccuaaaauaccacuucuuggcaaaauggcaauauacaucugccgcauguccaaucaccccaagaccacuauggccuuccuguucugguucuccuucggauacguaaucacgugcauacuaugcaaggcaauuuucuacuuacucaucauagugggcacccuaggcaaacgacucaagcaguaucgagaauuaaagccccagacaugcacaaucugugaaaccacaccagucaacgccaucgaugccgagaugcacgaccuaaacugcucauacaacauuugcccuuacugugcuucccgccucacaucagacggccuggcgcgucacguaauccaaugcccaaaacgcaaagaaaagguugaagagacugagcuuuaccuuaaccuugaacgcauccccugggucguacgaaaacuccugcaagucuccgaaucaaccggcgucgcacuaaaaagaucguccugguuaauaguauuacucguccuauucaccgucucgcuaucccccguccaaucagcaccaaucgggcgaaaaccacucuuccuugacucuaccgcuaagggcaugaaaaaccuccucaacuccacuucacucgagaccucacucagcaucgaagcgccauggggagcaaucaacguccaauccacauacaaaccaacaguuuccacagcaaauauagcccucuccuggucaucagucgaacacaggggcaacaaaauccuagucucaggccgcuccgaaagcaucaugaaacuagaagaacgaacuggaaucuccugggaccucggggucgaggaugccuccgaaucaaaacuucucacgguaucagucauggaucucucccagauguacucaccagucuuugaguaccuaagcggagaccgccaagucgaagaguggcccaaagccacaugcacuggagacugccccgaacgcugcggaugcacaucgucgaccugccuacauaaagaauggccccacucccguaacuggagaugcaaccccacuuggugcuggggaguaggcaccggcuguaccugcugcggccuugacguuaaggaccuauucaccgacuacauguucgugaaguggaaagucgaguacauaaaaacagaagccaucguaugcgucgaacuuacuucucaagaacgccaaugcuccuuaauagaagccggcacgagauucaaccuaggccccguaaccaucacacuuucggaacccagaaacauccagcaaaagcucccuccugaaauaaucacccuccacccccgaaucgaagaaggguucuucgaccuuaugcacguacaaaaaguacuaagcgcauccacaguuugcaaacugcaaucauguacccacggaguuccgggagaccuucaaguuuaccacaucggcaaccuacuaaaaggugacaaagucaauggccaccugauacacaaaauagaaccccacuucaacaccagcuggauguccugggauggaugcgaccucgacuacuacugcaacaugggcgacuggcccagcugcaccuacacaggcguuacccaacacaaccaugccuccuucguaaaccuacucaacauagaaacugacuacaccaaaaacuuucacuuccacuccaagagaguaacagcccacggcgacaccccgcaauuagaccuuaaagcacgacccaccuacggagcaggagaaaucaccguacucgucgaggucgcagacauggaacuccacaccaagaaaauugagaucucaggccucaaauucgccucacuugccugcacuggcugcuacgccugcucaucagguauaucaugcaaaguccgcauacacguagacgaaccugacgagcucacaguacacguaaaaagcgaugacccggacguagucgcagccucguccagcuugauggcccgaaagcuagaauuuggcacagauucaaccuucaaagccuucuccgccaugccaaagaccagccuuugcuucuacaucgucgaacgcgagcacugcaaaucaugcucagaggaggacaccaagaaaugcgucaacaccaaacuagagcaaccucaaucuauccucaucgaacacaaagguaccaucaucggcaaacaaaacaguaccugcaccgccaaggcauccugcuggcucgaauccgucaaauccuucuucuacggccucaagaacaugcucuccggcaucuucggcaaugucuucaugggaaucuuccucuuccuugccccauucauccugcugauccuuuucuucauguucggcuggcgcauacuuuucugcuucaagugcugccgucgaacccgaggccucuucaaauaucggcaccucaaggacgacgaagaaaccgguuaccgacgcaucaucgaaaaacucaacaacaagaaaggcaagaauaaacugcucgacggggaacgacucgccgaccgccgcauugccgaacucuucucuacaaaaacacacaucggc

SEQ ID NO: 15584 - RNA, 2916 nt, Artificial Sequence
  derived and/or modified CDS sequence (opt11) from CCHFV(UCCR4448, Artificial)__KY484042.1__Gn-4aa-Gc
agcgaggagaccuccgacgacugcaucagccgcacccagcugcuccggacggagaccgccgagauccacggcgacaacuacggagggcccggggacaagaucaccaucugcaacggguccacaaucguggaccagcgccuggggagcgagcucggcugcuacacgaucaaccgggucaaguccuucaagcucugcgagaacagcgccaccggcaaguccugcgagaucgacagcgugccggugaagugccgccagggguacugccugcggauaacccaggaggggcgcgggcacgucaagcugucccggggguccgagguaguacucgacgcgugcgacaccuccugcgagaucaugauccccaaggggacgggagacauccuggucgacugcagcggcgggcagcagcacuuccugaaggacaaccucaucgaccugggcugccccaagaucccccugcucgggaagauggccaucuacauaugccgcauguccaaccacccgaagaccaccauggccuuccuguucugguucaguuucggcuacgugaucacgugcauccugugcaaggccaucuucuaccuccugaucaucaucggcacccuggguaagcgguucaagcaguaccgcgagcucaagccccagaccugcaccaucugcgagaccacgcccgugaacgccaucgacgcggagaugcacgaccugaacugcuccuauaacaucugucccuacugcgccagccggcugaccuccgacggccucgcccgccacgucacccagugcccgaagcggaaggagaagguggaggagaccgagcuguaccugaaucucgagcgcauccccugggugguucggaagcugcuccaggugagcgaguccacggggguggcccugaagcgcagcagcuggcugaucguccugcucgugcuguucaccaucucccugagccccgugcaguccgcgcccaucagccggaagccccucuuccuggacuccaucgucaagggcaugaagaaccugcucaacagcaccucccuugagaccagccuguccaucgaggcccccuggggcgccaucaacgugcagagcacguacaagcccaccguguccaccgccaacaucgcccucagcugguccagcgucgaacaccgcgggaacaagauccugguguccggccggagcgaguccaucaugaagcuggaggagaagaccgggaucagcugggaccucggcguggaggaugcguccgagagcaagcugcugacggucagcgugauggaccucucccagauguacagccccgucuucgaguaccuguccggggaccgccagguggaggaguggccgaaggcgacuugcaccggcgacugucccgagcggugcggauguaccagcuccacgugccugcacaaggaguggccacacagccggaacuggcgcugcaaccccaccuggugcuggggcgugggcaccgggugcacgugcugcggccucgacgucaaggaccuguucaccgacuacauguucgugaaguggaagguggaguacaucaagaccgaggccaucgucugcguggagcugaccucccaggagcggcagugcagccugaucgaggccgggacacgcuucaaccucggcccggugaccaucacgcuguccgagccccggaacauccagcagaagcugccgcccgagaucaucacccuccacccccgcaucgaggagggguucuucgaccugaugcacguccagaaggugcugagcgccucuaccgugugcaagcuccaaaguugcacccacgggguccccggcgaucuccagguguaccacaucgggaaccugcugaagggcgacaaggugaacggacaccugauccacaagaucgagccccacuucaacacguccuggaugagcugggacggcugcgaccuggacuacuacugcaacaugggcgacuggcccuccugcaccuacaccggggucacccagcacaaccacgccagcuucgugaaccuccugaacaucgagacggacuacaccaagaacuuccacuuccacuccaagcgggugaccgcccacggcgacaccccgcagcuggaccuaaaggcccgccccacguacggggccggcgagaucaccguccugguggagguggccgacauggagcugcacaccaagaagaucgagaucagcgggcucaaguucgcgagccugaccuguacgggcugcuacgccugcuccagcggcaucucaugcaagguccgcauccacguggacgagcccgacgagcugaccgugcacgucaagagcgacgacccggacgugguggcggccuccagcucccucauggcccgcaaacuugaguucgggaccgacagcaccuucaaggcguucuccgccaugcccaagacgagccugugcuucuacaucgucgagcgggagcacugcaaguccugcagcgaggaggacaccaagaagugcgugaacaccaagcucgagcagccgcagucaauccugaucgagcacaagggcaccaucaucgggaagcagaacagcacaugcaccgccaaggccuccugcuggcuggagagcgugaaguccuucuucuacggccucaagaacaugcugagcgggaucuucggcaacgucuucaucggcaucuuccuguuccucgcgcccuuuauucugcugauccucuucuucauguucggguggaagauccuuuucugcuucaagugcugccgccggacccgcggccuguucaaguaccggcaccucaaggacgacgaagagaccggguaccgccggaucaucgagcgccugaacaacaagaagggcaagaacaagcugcucgacggggaaauccuggccgaccggcgcaucgccgagcuguucuccacgaagacccacaucggg

SEQ ID NO: 15585 - RNA, 2916 nt, Artificial Sequence
  derived and/or modified CDS sequence (opt11) from CCHFV(SPU 45/88, Artificial)__KJ682809.1__Gn-4aa-Gc
uccgaagagagcuccgacgacugccuaagccgcacacagcuacuucgcacugaaaacaccgagauccacucagacaacuauggcggccccggcgauaaaauuaccauaugcaacggcaguacgaucguagaccagcgccucggcucagagcuaggcugcuauacaaucaacagagugaaaucguucaagcucugcgaaaacucggcgaccggcaaaagcugcgaaaucgauuccacccccgugcgaugccgacaaggcuucugucugaaaauaacccaagaaggcagagggcacguaaaacugucuagaggaucagaagucgugcucgacgcaugcgacagcuccugcgaaaucaugauccccaaaggcacaggcgacauccucgucgacuguagcgguggccaacagcacuuccuaaaagacaacuuggucgaccucggguguccaaacaucccucuccuuggaaagauggccauuuacaucugccgaaugucgaaccacccgaaaaccacaaugggcuucuuauucugguucuccuucggcuacgucauaaccugcauccuaugcaaagucaucuucuaccuccucaucgucguaggaaccuugggcaagaaauuuaaacaauaccgggaacucaaaccccaaaccugcacgaucugugaaaccacgcccguuaacgcaaucgacgccgagaugcacgaccuaaacugcagcuacaacauaugccccuacugcgcaagccggcuaacaucagacgggcuugcccggcauguuaugcaaugcccaaaacgaaaagaaaagaucgaagaaaccgaauuauaccucaacuuagaacgcauaccauggauaguacggaaacuccuccaaguaagcgaauccacaggcgucgcucucaaacgauccucuuggcucgucguccuccucguauuacucaccgucagccucagcccuguucagagcgcccccauuggccgcaagcccuuauuccuugacagcauuguuaaagggaagaaaaaccuccucaacucaaccagucuagaaaccucccugucaaucgaagcaccauggggagccauaaacguacaaucaaccuuuaagccgacugugucagccgcuaacauugcccuauccugguccuccgucgaacacagaggcaacaagauccuaguauccggccgauccgaaucaaucaugaagcucgaggaacgcaccggcauaucaugggaccuaggcguggaagaugccagcgaauccaagcuccugaccgucucagucauggaccuuucccaaauguacagcccaguauucgaauaccugucuggugaccgacaaguagaagaauggccuaaagcuacaugcacaggcgacugccccgagagauguggauguaccucguccaccugucuacacaaagaauggccacauucacgcaacuggcgauguaacccaaccuggugcuggggcgucggcacaggcugcaccuguugugggcuagaugucaaagaccucuuuacggacuacauguucgucaaauggaaaguagauuacaucaaaaccgaggcgaucgucugcgucgaacucaccucacaagaacgccaaugcucccucauagaggcuggcacccgauuuaaccugggcccugucaccaucacacucuccgaacccagaaauauccaacagaaacucccaccugagaucgucacacuacaccccagaaucgaagaagguuucuucgaccucaugcacguccagaauguccuauccgccagcacuguaugcaaacuccaauccugcacacacggcgucccaggcgaccuacaaaucuaccauauuggcaaucuccugaagggcgacaagguuaacgggcaccucauccacaaaaucgaaccccauuucaacaccucuuggaugucgugggacggcugugaccuagacuacuacugcaacaugggcgacuggcccagcugcuccuacacaggcgugacccagcacaaccacgcggcguucgucaacaugcugaacaucgagaccgacuacaccaaaaacuuccacuuccacuccaaaagagucacagcucacggcgacacaccccagcuagaccuuaaagcucggccgaccuauggagccggugagaucaccguccucguagaagucgccgacauggaacuacacaccaagaaaaucgaaaucuccggccugaaauuugcuucccugacauguaccggcugcuacgcgugcucauccggcaucagcugcaaaguccgcauccacguagacgaacccgacgaacucacagugcacguaaaaucagaagacccggacaucgucgccgcauccagcucccucauggcgcgaaaacuagaauuuggaacagacucaacauucaaagcauucucugcaaugccaaaaacuucacugugcuucuacaucgucgagcgagaauacugcaaauccugcagcaaagaagacacccagaaaugcgugaacacaaaacuugaacaaccccaauccauacuuaucgaacacaagggcacaaucaucggcaagcaaaaugacacaugcaccgccaaagcaucaugcuggcuagaguccguaaagagcuucuucuacggccugaaaaacaugcucucaggcaucuucgggaacguuuucaucgguauccuccuguuucuugccccauucaucaugcucauccucuucuucauguucggcuggcguauccucuucugcuucaaaugcugcagacgcacccgcgggcuauucaaauaucgacaccuuaaagacgacgaagaaauagguuacagaaaaaucaucgaacgacucaauaacaaaaaggggaaaaacaagcuccucgacggcgagcgccucgccgaccgcaaaaucgcggaacucuucuccacaaaaacacauauugga

SEQ ID NO: 15586 - RNA, 2916 nt, Artificial Sequence
  derived and/or modified CDS sequence (opt11) from CCHFV(3010, Artificial)__DQ019222.1__Gn-4aa-Gc
gcggaaggaguaucaaacgacuguguaagccgaacgcaacuaauaaaaaccgaagucgccgaaauucacgaagacuccuauggugggccuggggagaaaauuaccauaugcaacgguagcaccaucgucgaccagagacucggaucggaacugggaugcuacacaauaaaccgagugaagacauacaagcucugcgaaaacagcgccacagaaaaaggcugcgagauagacagcguacccgucaaaugcaaacaaggcuuuugccuaaaggucacacaggaaggaagagggcacguaaaacucucccgagguaccgaaauaguccucgacguaugcgacacuucgugcgagcucaugauccccaagggaaccggcgacauccuuguggauugcuccggagggcagcaacacuuccuacaagacaaccuaauagaucucggaugcccaaacguaccccuucugggcaaaauggccaucuacaucugccguaugucaaaccaccccaagacaacuauggccuuccucuucugguucucauucggauacgucauaacauguauugucugcaagguccucuuuuaccuccugauaguaauuggaacccuaucaaagaagcucaaacaauaucgcgaguuaaaaccacagacuugcaucgucugcgaaucaacacccgucaacgcaaucgacgccgaaaugcacgaacuaaacugcaacuacaacauaugccccuacugcgccucccgacuaacauccgacggccuuguccgccacguaaaccaaugcccuaagcgcaaagaaaaggucgaggaaacggaacuauaccuaaacuuagagcguauccccuggcucgucagaagacuccugcaaguguccgaauccaccggcauggcccuaaagcgcucuugcuggaugacaacucuucuaauacuccuagucguaagccugucccccguccaauccgcccccgucggccgacgcccacuauuccuagacagcauugucaaaggcaugaagaaccuacuaaacucuacuucccucgaaacaucgcuauccauagaagcacccuggggagcuaucaacguccaauccaccuacaagcccaccguaagcaccgcaaacauagcacuaucauggucaucagucgagcaccgcggaaacaaaguccuaguuuccggcagauccgaaagcauaaugaagcucgaagagagaaccggcaucagcugggaccuuggagucgaagaugcuuccgaaucaaagcuccuaacaguguccgugauggaccucucgcagauguacucgcccguauuugaauaccucuccggugauaggcaaguagaggaauggccgaaggccaccuguacgggcgacugcccagagcgcugcggcugcaccuccuccacaugccuucacaaagaauggccucauucccgcaacuggcgaugcaaccccaccugguguuggggcguaggcacgggcugcacgugcugcggccuagacguaaaagaccucuucacagacuacauguucguaaaauggaaagucgaauacaucaaaaccgaagcaaucguaugcguggaacucaccucucaagaaagacaaugcucacucaucgaagcgggaacgcgguucaaccuaggaagcgucaccaucacccucagcgaaccacggaacauacagcagaaacuaccgccggaaauaaucacacugcaccccaaaaucgaagaaggauuuuucgaccucaugcacguccaaaaagugcucucagcaagcacaguauguaaacuccaaagcugcacacacggcgugcccggugaccugcaggucuaccauaucggcaaccuccucaaaggagaccgagucaacggccaccuuauccacaagaucgaacagcacuucaauaccucguggaugucaugggacggaugcgaccucgauuacuacuguaacaugggggacuggccauccugcacguacacgggcguaacacagcacaaccacgcgaguuucguaaaccuucucaacaucgaaaccgacuacaccaaaaccuuccacuuccacagcaaaagagucaccgcccacggagacacaccccaacucgaccuaaaagcgagacccaccuauggggccggggaaguaacaguccuaguagagguagcagacauggaguuacacaccaagaaaauagaaauauccggacugaaauucgcaggacuaaccuguaccgguugcuaugcaugcagcagcggcaucucaugcaaaguccgcauacacguagacgaacccgacgaacucaccguccacgucaaaucagacgaccccgacgucgucgccgcgagcagcucacucauggccaggaagcucgaauuuggcaccgacucaaccuuuaaagccuuuuccgcaaugcccaaaaccucccucugcuucuacaucgucgagcgcgaauacuguaagucuugcuccaaagaagacacgcaaaaaugcgucaauacgaaacucgaacaaccucaaucgauucugaucgagcauaagggcaccauaauaggaaaacagaacaacacgugcaccgccaaagccucaugcuggcucgagaguguuaaaucguucuucuacggccucaaaaacaugcuuggaggcaucuucgggaaugucuucaucggaaucuuuacauucuuaaccccauuuauccuccucauccucuucuucauguuuggcuggcgcauacuguucugcuucaaauguugcagacgaacccgcggguuauucaaauaccggcaccuuaaagacgacgaggaaacaggcuaccgcaaaauuaucgaacgacucaacaacaagaaagggaaaaaucgccuacuggacggagaacgccuugccgaucggaaaauugcugaacucuuuagcacgaaaacccacaucggc

SEQ ID NO: 15587 - RNA, 972 nt, Artificial Sequence
  derived and/or modified CDS sequence (opt11) from CCHFV(10200)__U39455.2__Gn
uccgaagaacccuccgacgacugcgucucccgaacccaacuccuccgcaccgaaaccgccgaaauccacggggacaacuacggcggcccaggcgacaaaaucaccaucugcaacggcagcacgaucgucgaccaacgccucggcuccgagcucggaugcuacaccaucaaccgcguucgcucauucaagcucugcgaaaacucagccaccggcaaaaacugcgaaaucgacuccguccccgucaaaugccgccagggauacugccugcgaaucacccaagaaggccgcggccacguaaaacucucccgcggcucagaaguaguacucgacgccugcgacaccucaugcgaaaucaugauccccaaaggcacaggagauauccucgucgacugcuccggaggccaacaacacuuccucaaagacaaccucauagaccuaggcugcccuaaaaucccacuccucgggaaaauggccauauacaucugccgaauguccaaccaccccaaaaccacaauggccuuccucuucugguucuccuucggcuacguaauaaccugcauccucugcaaagccaucuucuaccuucucaucaucgucggcacccuaggacgccgccuaaaacaauaccgugaacucaaaccccaaaccugcaccauaugcgaaacuacccccgucaacgccauagacgccgaaaugcacgaccuaaacugcuccuacaacaucugccccuacugcgccucccgccuaaccucagacggacuagcucgccaugucauccaaugccccaaacgcaaagaaaaagucgaagaaaccgaacuauaccucaaccuugaacgcauccccugggucguccgaaaacuacuacaagucuccgaaucaacuggcgucgcccucaaacgaucguccuggcucaucguccuccuaguccucuucaccgucucacucucccccguccaauccgccccaaucggc

SEQ ID NO: 15588 - RNA, 972 nt, Artificial Sequence
  derived and/or modified CDS sequence (opt11) from CCHFV(IbAr10200)__AF467768.2__Gn
uccgaagaacccuccgacgacugcaucuccagaacccaacuccuccgaaccgaaaccgccgaaauccacggcgacaacuacggaggccccggcgacaaaaucacgaucugcaacggaagcacaaucguagaccaacgccucggcuccgaacuuggcuguuacacaaucaaccgcguccgcuccuucaaacucugcgaaaauagcgcaaccggcaaaaacugcgaaaucgacuccguccccgucaaaugccgccaaggcuacugccuccgaaucacccaagaaggccgaggccacgucaaacucagccggggcuccgaagucguccucgacgcaugcgacaccucaugcgagauaaugaucccaaaaggcaccggcgacauccucgucgacugcucaggcggccaacaacacuuccucaaagacaaccuaaucgaccucggcugcccaaaaaucccccuccucggaaaaauggccauauacauaugcagaaugucaaaccacccaaaaaccaccauggcauuccuauucugguucucauucggcuacguaauaaccugcauccucugcaaagccaucuucuaccuacuaaucaucgucggcacccucggcaaacgccucaaacaauaccgcgagcuuaaaccccaaaccugcaccaucugcgaaaccacacccgucaacgccaucgacgccgaaaugcacgaccuaaauugcagcuacaauaucugcccuuacugcgcaucccgacucaccucagacggccucgcgcgccaugucauccaaugcccaaaacgcaaagaaaaagucgaagaaaccgaacucuaccucaaccucgaaagaaucccauggguagucagaaaacuacuccaagucuccgaaucaaccggcguagcccucaagcgcucaagcuggcuuaucguacugcucguccucuucaccgucucacucucacccguccaauccgcccccauaggc

SEQ ID NO: 15589 - RNA, 972 nt, Artificial Sequence
  derived and/or modified CDS sequence (opt11) from CCHFV(Turkey-Kelkit06)__GQ337054.1__Gn
uccgaagaacccggagacgacugcaucagccgcacccaacuacuacgcaccgaaaccgccgaaauccacgacgacaacuacgguggcccuggcgacaaaaucaccaucugcaacggcucaaccaucgucgaccaacgacucggcuccgaacucggcugcuacacaaucaaccgcguaaaaucuuucaaacucugcaaaaacuccgccaccggcaaaaccugcgaagucgacucaacacccgucaaaugccgccaaggcuucugccuaaaaaucacacaagaaggccgcggccacgucaaacuuucacgaggcucggaagucguccucgacgccugcgacuccucaugcgaagucaugaucccaaaaggcacaggcgacauccucgucgacugcuccggcggccaacaacacuuccuaaaagauaaccucaucgaccucggcugcccccacauaccccugcuaggccgcauggccaucuacauaugccgaaugucgaaccaccccagaaccaccauggccuuccuguucugguucuccuucggcuacgucauaaccugcaucuucugcaaagcacucuucuacucccucaucaucaucggaacacucggaaagaaaaucaagcaauaccgcgaacuaaaaccccaaaccugcaccaucugcgaaaccgcccccguaaacgccaucgacgccgaaaugcacgaccucaacugcagcuacaacauaugccccuacugcgcuucacgccucacaucugacggccuagcccgucacguaacccaaugccccaaacgcaaagaaaaagucgaagaaaccgaacuuuaccucaaccuugaacguaucccauggauuguccgcaaacuccuccaagucuccgaaucaaccggagucgcacucaaacgcuccuccuggcuaauaguccugcuuguccucuuaaccguaucccucucccccguccaauccgcccccguagga

SEQ ID NO: 15590 - RNA, 972 nt, Artificial Sequence
  derived and/or modified CDS sequence (opt11) from CCHFV(SR3)__AJ538199.1__Gn
uccgaagaauccggcgacgacugcaucucacguacccaacuccuccgcaccgaaaccgccgaaguacacggcgacaacuacggaggacccggcgacaaaaucacaaucugcaacggcagcaccgucgucgaccaacgccucggguccgaacucggcugcuacacaauaaaccgcguccgauccuucaaacucugcgaaaacuccgccacaggcaaauccugugaaaucgacucaaucccaguuaaaugcaaacaaggcuacugccuaaaaauuacacaagagggccgaggacacgucaaacucucacgcggcucagaagucguccucgacgucugcgacagcuccugcgaagucaugauccccaaaggaaccggagacauccucgucgacugcagcggcggccaacaacacuuccuaaaagacaaccucgucgaccuaggcugccccaaaaucccccuccuagguaaaauggccaucuacaucugccgcauguccaaccacccaaaaaccaccauggccuuccuauucugguucucuuucggauacgucauaaccugcauccucugcaaagcuaucuuuuuccuacuaauaaucuucggcacccucgguaaacgcuucaaacaauaccgcgaacuuaaaccccaaaccugcaccaucugcgaaaccacacccgucaacgccaucgacgccgaaaugcacgaccuuaacugcuccuacaacaucugccccuacugcgccucccgccucaccuccgacggccucgcccgccacguaacacaaugcccccgccgcaaagagaaagucgaagaaaccgaacuauaccucaaccucgaacgcauccccugggucguccgaaaacuccuccaagucuccgaaucaaccggcaccgugcuaaaacgcuccuccuggcucaucguccuccucguccuauucacagucucacuuuccccaguccaaagcgccccaaucgga

SEQ ID NO: 15591 - RNA, 972 nt, Artificial Sequence
  derived and/or modified CDS sequence (opt11) from CCHFV(UCCR4413)__KY484038.1__Gn
uccgaauccuccgccuccggcugcaucucccgcacccagaugaucaaaucugagaccgcagaaauccacgacgacauauaugguggacccggcgaaaaacuaaccaucugcaacggcaccacagucgucgaccaacgacucggcuccgagcuaggauguuacaccaucaaccguaucaaaacauacaaacuaugcgaaaacuccgugaaagaaaaaaccugcgaaaucgacucaguccccgucaaaugccgacaaggccuaugccucaaaaucacucaagaaggccgcggccacguaaaacucucccggggcuccgaaaucguccuugacaucugcgacuccagcugcgaacuuaugauccccaaaggcaccggcgacauccucgucgacugcucaggcggccaacaacacuuccuacaagacaaccucguagaccucggcugcccaaacaucccccuccuuggcaaagucgccauauacaucugccgcauguccaaccacccaaaaaccaccauggccuuccuauucugguucucauucggcuacgucaucaccugcauccuaugcaaaauccucuucuaccuccuaaucauuaccggcacacucggcaaaaaacucaaacaauaccgcgaacucaaaccccaaaccugcaccaucugcgaauccacccccgucaacgcaaucgacgcagaaaugcaugaccuaaacugcucauacaacaucugccccuacugcgccucacgccucacuuccgacggccucauccgacacgucaaccuaugcccaaaacgcaaagaaaaaguagaagaaaccgaacuauaccucaaccucgaacgcauccccugguuuguccgcaaacuccuacaggucucagaauccaccggcguagcccucaaacguagcuccuggcuccucauccucgucauccuccuuaccgucuccaugucccccguccaauccgcacccauaaac

SEQ ID NO: 15592 - RNA, 972 nt, Artificial Sequence
  derived and/or modified CDS sequence (opt11) from CCHFV(66019)__AB069669.1__Gn
uccgaagaauccggugaugacugcaucucccguacccaacuacuccgcacagaaaccgccgaaguccacggcgauaauuacggcggaccaggcgacaaaauaaccaucugcaacggcucaaccaucgucgaccaacgacuaggauccgaacucggcugcuacaccaucaaccgcgucaaauccuucaaacucugcgaaaacuccggcaccggcaaaucaugcaaaauagacaacacccccgucaaaugccgucaaggcuucugccucaaaauaacccaagaaggccgcggccacguaaaacucucccgcggcuccgaagucguccucgacgccugcgacucuuccugcgaaaucaugauacccaaaggcaccggcgacauccuagucgacugcucuggaggccaacaacacuuccucaaggacaaccucgucgaccuaggcugccccaacaucccucuccuaggaaaaauggccauauacaucugccgcauguccaaccacccaaaaaccacaauggcauuccuauucugguucucauucggauacgucauaaccugcaucuucugcaaaaucauauucuaccuacucaucgucgucggcacacucggcaagaaauucaaacaauaccgcgaacucaaaccccaaacuugcacaaucugcgaaaccacacccaccaacgccaucgacgcagaaaugcacgaccucaaaugcuccuacaauaucugcccuuacugcgcaucccgccucaccuccgacggccuagcccgccacguaacccaaugccccaaacgcaaagaaaaagucgaagaaaccgaacucuaccuuaaccucgaacgaauccccuggaucgucagaaaacuccuccaagucucagaaucaaccggcgucgcccucaaacgcuccuccuggcucaucguacuccucguacuccucacagucucucucucccccguccaauccgcccccaucggc

SEQ ID NO: 15593 - RNA, 972 nt, Artificial Sequence
  derived and/or modified CDS sequence (opt11) from CCHFV(7001)__AB069670.1__Gn
gccgaaggcggcuccucagacugcaucucccgcacccaacucgucaaaaccgaaguugccgaaauccacgaagacuccuacggcggccccggagagaaaaucaccaucugcaacggcuccacaaucgucgaccaacgucucggcuccgaacuaggaugcuacacaaucaaccgaguccgcucuuacaaacucugcgaaaacagcgccucaggcaaauccugcgaaauagacuccauccccguaaaaugcaagcaaggcuucugccucaaaaucacccaagagggccguggccacguaaaacuaucccgcggcaccgaaaucguccuagacgucugcgacuccucaugcgaacuaaugaucccaaaaggcaccggcgacauacucguugacugcaguggcggccaacaacacuuccuucaaaacaaccuuaucgaccucggcugccccaacguuccccuccucggcaaaauggccaucuacgucugcagaaugucaaaccaccccaaaaccacaauggccuuccucuucugguucuccuucggcuacgucaucacaugcaucgccugccgcguacuauucuaucuacucauagccaucggcacagucggaaagaaacuuaaacaguaccgcgaacucaaaccacaaaccugcaucguaugcgaaucugucccagucaacgccaucgacgccgagaugcacgaacucaacugcagcuacaacaucugccccuacugcgccucccgccucuccaccgacggacucauccgccacgucacacaaugcccaaaacgccgugaaaaagucgaagaaaccgaacucuuccuaaaccuagaacgcaucccauggcucguccgcaaacuccuacaagucuccgaauccaccggaauggcccucaaacgcuccugcuggaugaucacacuccugauccuccuccuagucagcaucucccccguccaaagcgcgcccguagga

SEQ ID NO: 15594 - RNA, 972 nt, Artificial Sequence
  derived and/or modified CDS sequence (opt11) from CCHFV(75024)__AB069671.1__Gn
uccgaagaguccggugacgacugcaucucacguacccaacuacuccgaaccgaaacagccgagauccacggcgacaacuacggcggccccggcgacaaaaucacaaucugcaacggcuccaccaucgucgaccaacgccucggcuccgaaaugggcugcuacaccaucaaccgcguaaaaucauucaaacucugcgaaaacuccgccaccggcaaauccugcgaaaucgacagcauccccgucaaaugccgccaaggcuacugccucaaaauaacccaagaaggacgcggccacgucaaacuuucccgcggcuccgaaguaguacuagacgccugcgacuccucuugcgaagucaugauccccaaaggaacaggagacauccucguagacugcuccggcggucagcaacacuuccucaaagacaaccucauagaccucggcugccccagcauaccccuccucggcaaaauggccaucuacaucugccgaauguccaaccacccaaaaaccaccauggccuuccucuucugguucucauucggauaugucauaaccugcauccucugcaaagccaucuuuuaccugcucaucaucguaggcacccucggcaaaagauucaaacaauaccgcgaacucaaaccacaaaccugcaccaucugcgaaacaacacccgccaacgccauagacgccgaaaugcacgaccucaacugcuccuacaacauaugccccuacugcgccucccgccuaaccuccgacggccucgcccgacaugucacccaaugccccaaacgcaaagaaaaagucgaagaaaccgaacucuaccucaaccucgagcgcaucccuuggguaguccgcaaacuccuccaagucuccgaaucaacaggugucgcacucaaaagauccuccuggcucaucguccugcucguccucuucgccaucucccucuccccgguccaaagcgcccccaucggc

SEQ ID NO: 15595 - RNA, 972 nt, Artificial Sequence
  derived and/or modified CDS sequence (opt11) from CCHFV(7803)__AB069672.1__Gn
uccgaagaauccggcgacgacugcaucucccgcacccaacuccuacgaaccgaaaccgccgaaauccacggcgacaacuacggcggacccggcgacaaaauuaccaucugcaacggauccacaaucgucgaccaacgccucggcuccgaaaugggcugcuacacaaucaaccgcgucaaauccuucaagcucugcgaaaacagcgccaccggaaaauccugcgaaaucgacuccaucccagucaaaugccgccaaggcuacugccucaaaaucacacaagagggccgcggccacgucaaacucucacgaggcuccgaaguaauacucgacgccugcgacucauccugcgaagucaugauccccaaaggcaccggcgacauccucgucgacugcuccggcggacaacaacacuuccuaaaagacaaccucaucgaccucggaugccccucaaucccacugcucggcaaaauggccaucuacaucugccgcaugucuaaccaccccaaaacaaccauggccuuccuauucugguucuccuucggcuaugucaucacuugcauacucugcaaagccaucuucuaccuccugaucaucgucggcacccucgguaaacgcuucaaacaauaccgagaacucaaaccccaaaccugcaccauaugugaaacaacacccgccaacgccaucgacgccgaaaugcacgaccucaacugcucauacaacauaugccccuacugugccucccgccuaacauccgacggccuagcccgccacguaacccaaugcccaaaacgcaaagaaaaggucgaagaaaccgaacucuaccucaaccucgaacgcauccccuggguaguccgcaaacuccuccaagucuccgaaagcaccggggucgcccucaaacgauccuccuggcucaucguccuccucguccucuucgccaucagccucucccccguccaaucagcccccaucucc

SEQ ID NO: 15596 - RNA, 972 nt, Artificial Sequence
  derived and/or modified CDS sequence (opt11) from CCHFV(79121)__AB069673.1__Gn
gccgaaggaggcucaucagacugcaucucacgcacacaacucgucaaaacagaagucgccgaaauccacgaagacuccuacggcggccccggcgagaaaaucaccaucugcaacggcuccacaaucguagaccaaggccucggcuccgaacucggaugcuacacaaucaaccgcguccgcuccuacaaacuaugcgaaaacuccgcauccggcaaauccugcgaaaucgacucuauccccgucaaaugcaaacaaggcuucugccucaaaauaacccaagaaggccgcggccacgucaaacucucccgcggcaccgaaaucguccucgacgucugcgacuccucaugcgaacucaugaucccaaaaggcaccggcgacauccucgucgacugcucaggaggccaacaacacuuccuccaaaacaaccuuauagaccuaggaugcccaaauguaccccuccugggaaaaauggccauauacgucugcagaaugagcaaucaccccaaaacaaccauggccuuccucuucugguucucauucggcuacgucauaaccugcaucgccugccgcguccucuucuaccuccucaucgccaucggaaccgucggcaagaaacucaaacaauaccgcgaacucaaaccccaaacaugcaucgucugcgaauccguacccguaaacgccaucgacgccgaaaugcacgaacucaacugcuccuacaacaucugccccuacugcgcuucccgccucucgacagacggacuaauccgccacgucacacaaugccccaaacgacgcgaaaaagucgaagaaaccgaacuauuccucaaccucgaacgcauacccuggcucgucagaaaacuacuucaaguauccgaaucuacaggcauggcacucaaacgcuccugcuggaugaucacccuccucauacuccuccuuguauccaucucacccguccaauccgcccccgucggc

SEQ ID NO: 15597 - RNA, 972 nt, Artificial Sequence
  derived and/or modified CDS sequence (opt11) from CCHFV(8402)__AB069674.1__Gn
uccgaagaauccggcgacgacugcaucucccgcacccaacuccuccgcaccgaaaccgccgaaauacacaacgacaacuacggcggccccggcgacaaaaucaccaucugcaacggcuccaccguagucgaucaacgacuaggcuccgaacucggcugcuacacaaucaaccgcgucaaauccuucaaacucugcgaaaacuccgccaccggcaaauccugcgaaaucgacuccacccccgucaaaugucgccaaggcuucugccucaaaaucacccaagaaggccgcggacacgucaaacuaucccgcggauccgaagucguccucgacgcaugcgacuccuccugcgaaauaaugaucccaaaaggcaccggcgacauccuagucgacugcuccggaggccaacaacacuuccuaaaagacaaccucaucgaccucggcugccccaacaucccccuacucggcaaaauggcaaucuacaucugccgcauguccaaccacccaaaaaccacaauggccuuccuauucugguucuccuucggcuacgucguaaccugcauccucugcaaagucaucuucuaccuccucaucgucguuggcacccucggcaagaaauuuaaacaauaccgcgaacucaaaccccaaaccugcacaauaugcgaaaccacccccguaaacgccaucgacgcagaaaugcacgaccucaacugcagcuacaacauaugccccuacugcgccucccgccuaaccucagacggacucgcccgccacguuaugcaaugccccaaacgcaaagagaaaaucgaagaaaccgaacuauaccucaacuuagaaagaaucccuugggucgucagaaaacuucuccaggucucugaaucaacaggcgucgcccucaaacgcucauccuggcucguuguacuccugguacuccucaccguuucccucucccccguccaauccgcacccaucggc

SEQ ID NO: 15598 - RNA, 972 nt, Artificial Sequence
  derived and/or modified CDS sequence (opt11) from CCHFV(88166)__AB069675.1__Gn
uccgaagaauccggcgacgacugcaucucccgcacccaacuccuccgcaccgaaaccgccgaaauccacuccgacaacuacggcggccccggcgacaaaauaacaaucugcaacggcagcaccgucgucgaccaacgacucggcuccgaacucggcugcuacaccaucaaccgcgucaaauccuucaaacuuugcgaaaacuccgccacuggcaaauccugcgaaaucgacucaaccccagucaaaugccgccaaggcuucugccuaaaaauaacccaagaaggacgcggccacgucaaacucucccgcggauccgaaguaguccucgaugcaugcgacuccuccugcgaaauaaugaucccaaaaggcaccggagacauccuagucgacugcuccggaggccagcaacacuuccucaaagacaaccucauagaccucggcugccccaacauaccccuccucggcaaaauggccaucuacaucugccgcauguccaaccaccccaaaaccaccaugggcuuccuauucugguucucguucgguuacgucguaaccugcauacucugcaaagucaucuucuaccuacuaaucgucguaggcacccugggaaagaaauucaaacaauaccgcgaacucaaaccccaaaccugcaccaucugcgaaaccacacccgucaacgcaaucgacgccgaaaugcaugaccucaacugcuccuacaacaucugccccuacugcgccagcagacugacauccgauggccucgcccgccacgucaugcaaugccccaaacgcaaagagaaaaucgaagaaaccgaacuguaccucaaccucgaacgaauccccugggucguccgcaaacuccuccaagucuccgaaucaaccggcgucgcccuaaaacgcucauccuggcucgucguccuccuaguccuccuaaccgucagccucucacccguucaaucagcccccauaggc

SEQ ID NO: 15599 - RNA, 972 nt, Artificial Sequence
  derived and/or modified CDS sequence (opt11) from CCHFV(BA88166)__AF338470.1__Gn
uccgaagaauccggcgacgacugcaucucacgaacccaacuccuacgcacagaaaccgccgaaauccacucagacaacuacgguggucccggagacaaaaucaccaucugcaacggcagcacagucguagaccaacgccucggcagcgaacucggcugcuacaccaucaaccgcgucaaauccuucaaacuaugcgaaaacuccgcaacaggcaaaucaugcgaaaucgacuccacccccguaaaaugucgacaaggcuucugccucaaaauaacccaagaaggccgaggccacgugaaacucucucgcggcucagaggucguacucgacgccugcgacuccucaugcgaaaucaugauccccaaaggcaccggcgacauccucgucgacugcuccggcggacaacaacacuuccucaaagacaaccucaucgaccucggaugccccaacaucccacuccucggcaaaauggccaucuacaucugccgcaugucaaaccaccccaaaaccaccaugggauuccuauucugguucuccuuuggauacgucgucacaugcauccucugcaaaggaaucuucuaccuccucaucgucguagguacccuagguaaaaaauucaaacaauaccgcgaacucaaaccccaaaccugcaccauuugcgaaaccacccccgucaacgccaucgacgccgaaaugcacgaccucaacugcuccuacaacaucugccccuacugcgccucccgacuaaccucagacggccucgcacgccacgucaugcaaugcccaaaacgcaaagagaaaauagaggaaaccgaacuauaccucaaccuagaaagaauccccugggucguccgcaaacuccuacaagucuccgaaucuaccggcgucgcccucaaacgcuccuccuggcucgucguccuacucguccuccucaccgucucccuauccccuguccaaucagcccccaucggc

SEQ ID NO: 15600 - RNA, 972 nt, Artificial Sequence
  derived and/or modified CDS sequence (opt11) from CCHFV(BA66019)__AF350448.1__Gn
agcgaagaaucaggagacgacugcauaucccgcacccaacuacuacgcaccgaaacagccgaaguccacggcgacaacuacggcggcccuggagacaaaaucaccauaugcaacggaucaacaauagucgaccaacgccucggcuccgaacucggcugcuacaccaucaaccguguaaaaucauucaaacucugcgaaaacuccggcaccggaaaaucgugcaaaaucgacaaacaccccguaaaaugccgccaaggcuucugccuaaaaaucacccaagaaggccgcggccacguaaaacucucccgcggcuccgaagucguccuugacgcuugcgacucaagcugcgaaaucaugauccccaaaggaaccggcgacauacucgucgacugcuccggcgggcaacaacacuuccucaaagacaaccucgucgaccucggcugccccaacaucccccuccucggaaaaauggcaaucuacaucugccgcauguccaaccacccaaaaacaaccauggccuuccucuucugguucuccuucggcuacgucauaaccugcaucuucugcaagaucaucuucuaccuccuaaucguagucggaacucucggcaagaaauucaaacaauaccgagaacucaaaccccagaccugcaccaucugcgaaaccaccccaacuaacgccaucgacgccgaaaugcacgaccucaaaugcuccuacaacauaugccccuacugcgccucaagacuuaccuccgacggccucgcccgccacguaacccaaugccccaaacgcaaagaaaaagucgaagaaaccgagcucuaccucaaccuagaacgcaucccauggaucguccgaaaacuacuccaagucucagaauccaccggcguagcccuaaaacgcuccuccuggcucaucguccuccucguccuccuaaccgucucccucucacccguacaauccgcccccaucggc

SEQ ID NO: 15601 - RNA, 972 nt, Artificial Sequence
  derived and/or modified CDS sequence (opt11) from CCHFV(BA8402)__AF350449.1__Gn
uccgaagaaucgggagacgacugcaucucccgcacccaacuccuucgcaccgaaaccgccgaaauccacaacgacaacuacggcggacccggcgacaaaaucaccaucuguaacggaucaaccgucguggaccaacgccuaggcagcgaacucggcugcuacaccaucaaccgaguaaacuccuucaaccucugcgaaaacaccgcaacaggcaaauccugcgaaaucgacuccaccccugucaaaugccgccaaggcuucugccucaaaaucacccaagaaggccgaggccacguaaaacuuucccgcggcuccgaagucguacucgaugccugcgaauccuccugcgaaaucaugauccccaaaggcaccggcgacauccucguagacugcuccggcggccaacaacacuuccucaaagacaaccucaucgaccucggcugcccaaacaucccacuccuuggaaaaauggccaucuacaucugccgcauguccaaccaccccaaaaccaccauggcauuccucuucugguucuccuucggauacgucgucaccugcauccucugcaaagucauauucuaccuacuaaucgucgucggcacucucggcaaaaaauucaaacaauaccgcgaacuaaaaccccaaaccugcaccaucugcgaaaccacccccguaaacgccaucgaugcagaaaugcacgaccucaacugcuccuacaacauuugccccuacugcgccucccgcccaacauccgacggucuagcccgccacguaaugcaaugccccaaacgcaaagaaaaaaucgaagaaaccgcccucuaccucaaucuugaacgcauccccugggucguccgcaaacuacuucaaguaucugaaagcaccggcgucgcccucaaaagguccuccuggcucguaguacuccuaguccuacucacaguaucccuaucccccguccaauccgcccccauaggc

SEQ ID NO: 15602 - RNA, 972 nt, Artificial Sequence
  derived and/or modified CDS sequence (opt11) from CCHFV(Matin)__AF467769.2__Gn
uccgaagaaagcggcgacgacugcaucucccgaacccaacuccuccgcaccgaaacagcagaaauccacuccgacagcuacggcggccccggcgacaaaaucaccaucugcaacggcagcaccgucgucgaccaacgcuuaggcucugaacucggcugcuacaccaucaacagagucaaauccuucaaacucugcgaaaacagcgcuaccggaaaaucaugcgaaaucgacuccacgcccguaaaaugccgccaaggcuucugccucaaaauaacccaggaaggccgcggccacgucaaacuaucacgcggcuccgaagucguccucgacgccugcgacuccuccugcgaaaucaugauccccaaaggcaccggcgacauccucguagacugcuccggcggccaacaacacuuccucaaagacaaccucaucgaucuaggcugccccaacaucccccuccucggcaaaauggcaaucuacauaugccgcauguccaaccaccccaaaaccaccauggucuuccucuucugguucuccuucggauacgucaucacaugcauacuaugcaaaguaaucuucuaccuccuaaucgucgucggcacacucggcaaaaaguucaaacaauaccgagaacuaaaaccccaaaccugcaccaucugcgaaaccaccccagucaacgccaucgacgccgaaaugcacgaccucaacugcagcuacaacaucugccccuacugcgcaucacgucuaaccuccgacggacucgcccgacacgucaugcaaugccccaaacgaaaagagaaaaucgaagaaaccgaacuauaccucaaccuugaacgcauccccugggucgugcgcaaacuccuccaagucuccgaauccaccggagucgcccucaagcgcuccuccuggcuaguaguccuccucguacuacuaaccgucucccugagcccaguacaauccgcacccaucgga

SEQ ID NO: 15603 - RNA, 972 nt, Artificial Sequence
  derived and/or modified CDS sequence (opt11) from CCHFV(Baghdad 12)__AJ538197.2__Gn
uccgaagaaucaggagacgacugcaucucacgcacccgacuccuccgcaccgaaaccgccgaaauccacggcgacuccuacgguggacccggcgacaaaaucacaaucugcaacggcucaaccauagucgaccaacgccucggcuccgaaaugggaugcuacaccaucaaccgcgucaaauccuucaaacucugcgaaaacuccgccaccggcaaauccugcaaaauagacuccauaccagucaaaugccgccaaggcuacugccucaaaauaacccaagaaggacgcggccacgucaaacuuucacgcggcuccgaagucguccucgacgcuugcgacuccucuugcgaagucaugauccccaaaggcaccggcgacauccucgucgacugcucaggcggccaacaacacuuccucaaagacaaccucaucgaccuaggcugccccaacaucccacuccucggcaaaauggccaucuacauaugccgcaugagcaaccaccccaaaaccacuauggccuuccucuucugguucuccuucggcuacgucauuaccugcauccucugcaaagccaucuucuaccuacuaaucaucgucgggacacuaggcaaacgcuucaaacaauaccgcgaacuuaagccccaaaccugcaccauaugcgaaacaacccccgucaacgccaucgacgccgaaaugcacgaccuaaacugcuccuacaacaucugccccuacugcgcaagccgccucaccuccgacggacucgcccgccacgucacccaaugccccaaacgaaaagaaaaagucgaagaaaccgaacuauaccucaaccucgaacgaaucccaugggucguccguaaacuccuacaggucucagaauccaccggcgucgcccucaaacgcagcucguggcucaucguccuccucguccuccuagcugucuccuccucccccguucaauccgccccuaucggc

SEQ ID NO: 15604 - RNA, 972 nt, Artificial Sequence
  derived and/or modified CDS sequence (opt11) from CCHFV(VLG/TI29414)__AY179961.1__Gn
ucagaagagcccggcgacgacugcaucucacgcacacaacuccuccgagccgaaccagcagaaauccaugacgacaacuacggcggcccaggcgacaaaaucaccaucugcaacggcuccaccauuguagaccaacgccucggcuccgaacucggcugcuacacaaucaaccgcgucaaauccuucaaacucugugaaaacagcgcaaccggaaaaaccugcgaaaucgacuccacccccgucaaaugccgccaaggcuucugucuaaaaaucacccaagagggacgcggacacgucaaacuaagccgcggcuccgaagucguccuagacgccugcgauagcuccugcgaaguaaugauacccaaaggcaccggagacauccucgucgacugcuccggcggccaacaacacuuccucaaagacaaccuaaucgaccuaggcugcccccacaucccacuccucggcaaaauggccaucuacaucugccgcauguccaaccacccccgcaccacuauggcauuccucuucugguucuccuucggcuacguaaucaccugcaucuucugcaaagcccucuucuacucacucaucaucaucggaacacucggcaaaaaaaucaaacaauaccgagaacucaaaccccaaacaugcaccaucugcgaaaccgcacccgucaacgccaucgacgccgagaugcacgaccuaaacugcagcuacaacaucugcccguacugcgcaucacgccucaccucagacggacuagcacgccacguaccccaaugucccaaacgcaaagaaaaagucgaagaaaccgaacuauaccucaaccucgaacgcauaccauggaacguccgaaaacuacuccaagucuccgaauccaccggcgucgcccuaaaacgcuccagcuggcuuaucguccuccucguccuccuaaccgucucccuaagcccaguccaaagcgcccccgucggc

SEQ ID NO: 15605 - RNA, 972 nt, Artificial Sequence
  derived and/or modified CDS sequence (opt11) from CCHFV(TADJ/HU8966)__AY179962.1__Gn
uccgaagaaagcggcgacgacugcauaagcagaacucaacuccuacgcaccgaaaccgccgaaauccacggcgacgacuacggcggacccggcgacaaaaucaccauaugcaacggcuccaccaucguagaccagcgccucggcuccgaacuaggcugcuacaccauaaaccgagucaaaucauucaaacucugcgaaaacuccgccacaggcaaaaacugcgaaaucgacuccguccccgucaaaugccgccaaggcuacugccucaaaaucacccaagaaggacgaggccacgucaaacucagccgcggcuccgaagucguccucgacgccugcgacuccucaugcgaagucaugauacccaaagggacaggcgacauauccgucgacugcuccggaggccaacaacacuuccucaaagauaaccucaucgaccucggcugccccaaaaucccacuacucggcaaaauggcaaucuacaucugccgaauguccaaccaccccaaaaccaccauggcauuccucuucugguucucauucggcuacgucaucacgagaauccucugcaaagcgaucuucuaccuucuaaucaucguaggaacccucggcaaacgauucaaacaauaccgcgaacucaaaccccaaacaugcaccaucugcgagacaacccccgccaacgccaucgacgccgaaaugcacgaccucaacugcagcuacaacauaugccccuacugcgcaucccgccucaccuccgacggucucgcacgccacgucacccaaugccccaaacgaaaagaacgcgucgaagaaacagaacucuaccuaaaccuagaacggauccccuggaucguccgcaaacuacuccaagucuccgaauccacaggagucgcccucaaacgcuccagcuggcucaucguccuccuaguccucuucaccguaagccucagccccguccaauccgcacccaucggc

SEQ ID NO: 15606 - RNA, 972 nt, Artificial Sequence
  derived and/or modified CDS sequence (opt11) from CCHFV(Hodzha)__AY223476.1__Gn
ucugaagaauccggcgacgacugcaucucacgaacccaacuccuccgcaccgaaaccgccgaaauccacggcgacgacuacggcggccccggcgacaaaaucaccaucugcaacggcucaacaauugucgaccaacgccucggcucagaacuaggaugcuacacaaucaaccgagucaaaucauucaaacucugcaaaaacuccgcaaccggcaaaucaugcgaaaucgacuccacacccgucaaaugccgccaaggauacugccucaaaaucacccaagaaggccgaggccacgucaaacuaucccgaggcuccgaaguaguccucgacgccugcgacuccuccugcgaagucaugauccccaaaggaaccggcgacauucucgucgacugcagcggaggccaacaacacuuccucaaagacaaccuuauagaccuaggcugcccccggaucccccuacucggcaaaauggccaucuacaucugcagaauguccaaccaccccaaaaccacuauggccuuccucuucugguucuccuucggcuacgucauaaccugcauccucugcaaagccauuuucuaccuccuaaucauagucggaacacucggcaaacgauucaaacaauaccgagaacuaaaaccccaaacaugcacuaucugcgaaaccacccccgcaaacgccauagacgcagaaaugcacgaccucaacugcucguacaacaucugcccguacugcgcaagccgccucacauccgacggccucgcccgccacgucacccaaugccccaaacgcaaagaaaaaguagaagaaaccgaacuuuaccuaaaccucgaacgcauccccuggauaguccgcaaacuacuccaaguaucagaauccaccggcgucgcccucaaaagauccucauggcucaucguccuccucguacuauuugccgucucucuaucccccguucaaucagccccaaucggc

SEQ ID NO: 15607 - RNA, 972 nt, Artificial Sequence
  derived and/or modified CDS sequence (opt11) from CCHFV(Kosovo/9553/2001)__AY675511.1__Gn
uccgaagaaccaggcgacgacugcauaagccgcacccaacuccuucgcaccgaaaccgccgaaauccacgacgacaacuacggaggccccggcgacaaaaucaccaucugcaacggcagcaccaucgucgaccaacgccucggaucagaacuaggcugcuacaccaucaaccguguaaaaucauucaaacucugcgaaaacuccgccacaggaaaaaccugcgaaauagacuccaccccaguaaaaugccgccaaggcuucugccugaaaaucacccaagaaggcagaggccacgucaaacuaucacgcggcuccgaagucguccucgacgccugcgacagcuccugcgaagucaugauccccaaaggcacaggcgacauacucgucgacugcagcggaggacaacaacacuuccuaaaagacaaucucaucgaccucggcugcccacacaucccccugcucggcaaaauggccaucuacaucgcccgaaugucaaaccaccccaaaaccacaauggccuuccuauucugguucucccuaggauacguaauaaccugcauccucugcaaagcccucuucuacucccuaaucaucaucggcacccucggcaagaaaaucaaacaauaccgagagcucaaaccccaaaccugcacaauaugcgaaaccgcacccguaaacgcaaucgacgccgaaaugcacgaccuuaacugcuccuacaacauaugccccuacugcgccucccgccuaaccuccgacggccuagcccgccacgucaaacaaugccccaaacgcaaagaaaaggucgaggaaaccgaacucuaccuaaaccuggaacgcaucccgugggucguccgcaaacuccuccaagucucagaauccaccggaguagcacucaaacgcucauccuggcuaauaguccuacucguacuccucaccgucucuuuaucacccguccagagcgcccccguagga

SEQ ID NO: 15608 - RNA, 972 nt, Artificial Sequence
  derived and/or modified CDS sequence (opt11) from CCHFV(SPU41/84)__AY900142.1__Gn
uccgaagaauccucagacgacugcauaucccgcacccaacuccuacgcaccgaaaccgccgaaauccacggcgacaacuacggcggcccaggcgacaaaaucaccaucugcaacggcuccacagucgucgaccaacgccucggcuccgaacuaggcugcuacaccauaaaccgcgucaaaacauucaaacucugcgaaaacucagccaccggcaaaagcugcgaaaucgacuccguccccgucaaaugccgccaaggcuacugccucaagauuacccaagaaggacgaggccacgucaaacucucacgcgguuccgaagucguccucgaugcaugcgacacaucaugcgaagucaugauccccaaaggcaccggagacauccucgucgacugcucaggaggccaacaacacuuccuaaaagacaaccuaauagacuuaggcugccccaaaaucccacuacuaggcaaaauggccaucuacaucugccgcauguccaaccaccccaaaacaaccauggccuuccuuuucugguucucauucggcuacgucaucacaugcaucaucugcaaagucaucuuuuaccuccucaucaucgucggcacucuuggcaaacgcuucaaacaauaccgagaacucaaaccccagacaugcaccauaugcgaaaccacccccgucaacgcaaucgacgcagaaaugcacgaccucaacugcucauacaacauaugcccuuacugcgcaucacgccuaacaucggacggccuagcccgccacgucacccaaugccccaaacguaaagaaaaagucgaagaaacugagcuauaccucaaccucgaacgcauacccugggucguccguaaacuacuccaagucuccgaaucaaccggcgucgcccucaaacgguccuccuggcucgucguacuccuaguccuccucaccgucucacucucccccguccaauccgcucccauaucc

SEQ ID NO: 15609 - RNA, 972 nt, Artificial Sequence
  derived and/or modified CDS sequence (opt11) from CCHFV(UG3010)__AY900143.1__Gn
gcugaaggagucuccaacgacugcgucucccgaacccaacucauaaaaacagaaguagccgaaauccacgaagacuccuacggcggcccaggcgaaaaaaucaccaucugcaacggcuccaccaucgucgaccaacgccucggcuccgaacucggcugcuacacaaucaaccgcgucaaaaccuacaaacucugcgaaaacuccgccaccgaaaaaggcugcgaaaucgacuccguccccgucaaaugcaaacaaggcuucugccuaaaagucacccaagaaggccgcggacacguaaaacucagccgcggcaccgagauaguccuggacgucugcgacaccuccugcgaacucaugaucccgaaaggcaccggagacauccucgucgacugcucaggcggacaacaacacuuccuucaagacaaccucaucgaccucggaugccccaacguaccccuccuaggcaaaauggccaucuacauaugccgaaugucaaaucaccccaaaaccaccauggccuuccucuucugguucuccuucggcuacgucaucaccugcaucgucugcaaaguacucuucuaccuccucauaguaaucggcacccuuagcaaaaaacugaaacaauaccgcgaacuaaaaccccaaaccuguaucgucugcgaauccaccccagucaacgcaaucgacgccgaaaugcacgaacuaaacugcaacuacaacaucugccccuacugcgccucccgccucaccucagacggccucguccgucaugucaaccaaugccccaaacgcaaagaaaaaguugaagaaaccgaacucuaccuaaaccucgagcgcauccccuggcucguccgccgccuacuccaagucuccgaguccaccggcauggcccucaaacgcuccugcuggaugaccacucuacuaauccuccucgucgucuccuuaucccccguccaauccgccccagucgga

SEQ ID NO: 15610 - RNA, 972 nt, Artificial Sequence
  derived and/or modified CDS sequence (opt11) from CCHFV(Hy13)__AY900145.1__Gn
uccgaagaauccggcgacgacuguaucuccagaacccaacuaucccgcaccgaaacagcugaaauccacuccgacaacuacggcggccccggcgacaaaaucaccaucugcaacgguuccacaaucguagaccaacgccuaggcuccgaacucggcugcuacaccaucaaccgugucaaauccuucaaacucugcgaaaacucggccaccggaaaauccugcgaaaucgacuccacacccaucaaaugccgucaaggcuucugccucaaaaucacccaagaaggccgcggccaugucaaacugucccgcggauccgaagucguccucgacgccugcgacagcuccugcgaaaucaugauaccuaaaggcaccggugacauccucgucgacugcucaggaggccaacaacacuuccucaaagacaaccucauagaccucggcugccccaacaucccccuacucggcaaaauggccaucuacaucugccgcauguccaaccaccccaaaaccaccauggccuuccuauucugguucuccuucggauacgucaucacaugcauccucugcaaagucaucuucuaccuucucauagucgucggcacacucggcaagaaauucaaacaauaccgcgaacucaaaccccaaaccugcaccaucugcgaaacaacacccgucaaugccaucgacgccgaaaugcacgaccucaacugcagcuacaacauaugccccuacugcgccucccgccuaacauccgacggccucgcacgccacgucaugcaaugccccaaacgaaaagaaaaagucgaagaaaccgaacucuaccucaaccucgaaagaauccccugggucguccgaaaacuacuacaagucagcgaauccaccggcgucgcacucaaacgcuccuccuggcuagucguccuccuaguccuacuaaccgucucacucucccccguccaauccgcacccaucggc

SEQ ID NO: 15611 - RNA, 972 nt, Artificial Sequence
  derived and/or modified CDS sequence (opt11) from CCHFV(Semunya)__DQ094832.1__Gn
gcagaaggcguuucaaacgacugcgucucacgcacccaacucauaaaaaccgaagucgccgaaauccacgaagacuccuacggaggccccggcgagaagaucacaaucugcaacggaagcaccaucgucgaccaacgccucggcuccgaacucggcugcuacaccaucaaccgugucaaaacauacaaacucugcgaaaacuccgccaccgaaaaagggugcgaaaucgacuccguccccgucaaaugcaaacaaggcuucugccucaaagucacccaagaagggcgaggacacgucaagcucucccgaggcaccgaaaucguccuagacgucugcgauaccuccugcgaacucaugaucccgaaaggcaccggcgacauacucgucgacugcuccggaggccaacaacacuuccuccaagacaaccucaucgaccuaggcugcccaaacgucccccuccuaggcaaaauggccaucuacaucugcagaauguccaaccacccaaaaaccacaauggcauuccucuucugguucuccuucggauacguaauaaccugcgucgucugcaaaguccucuucuaccuacucaucgucaucggcacacucggcaagaaacucaaacaauaccgcgaacucaaaccacaaacaugcaucguaugcgaaagcauaccagucaacgccauagacgccgaaaugcacgaacucaacugcaacuacaacaucugccccuacugcgccucacgccucaccuccgacggacucguccgccacgucacccaaugccccaaacgaaaagaaaaagucgaagaaaccgaacucuaccugaaccuagaacgaaucccauggcucguccgacgccuacuccaagucuccgaaagcacaggcauggcccucaaacgcagcugcuggaugaccacccuucucauccuccuaguaguaagccucucccccguccaguccgcacccgucgga

SEQ ID NO: 15612 - RNA, 972 nt, Artificial Sequence
  derived and/or modified CDS sequence (opt11) from CCHFV(SPU128/81/7)__DQ157174.1__Gn
uccgaagaaccauccgacgacugcaucagccgaacacagcuccugagaaccgaaaccgccgaaauccacggcgacaacuacggaggccccggagacaaaaucaccaucugcaacggcuccaccaucgucgaccaaagacucggaucagaacuaggcugcuacacuaucaaccgagucaaauccuucaaacucugcgaaaacagcgccaccggcaaaucaugcgaaaucgaaagcguccccgucaaaugccgccaaggcuacugccuccgaaucacccaagaaggucgcggacacgucaaacuaucccgaggcucugaagucguccucgacgccugcgacacaucaugcgaaaucaugauccccaaaggcacuggcgacauccucgucgacugcuccggaggccagcaacacuuccuaaaagacaaccuaaucgaccucggcugccccaaaauaccccuccucgggaagauggccaucuacaucugccgcauguccaaccaccccaaaacaacaauggcauuccuauucugguucucguucggcuacgucauaaccugcauccuaugcaaagcaaucuucuaccuucucaucaucaucggcacccucggcaaaagauucaaacaauaccgcgagcucaaaccccaaaccugcaccauaugcgagaccaccccagucaacgccaucgaugcagaaaugcacgaccucaacugcuccuauaacaucugcccauacugcgccucacgacucaccuccgacggccuagcccgccacgucacacaaugccccaaacgcaaagaaaaagucgaagaaaccgaacuguaccucaaccuugaaagaauacccugggucguccgcaaacuacuccaagucuccgaaucaaccggcgucgcacucaaacgcucauccuggcuaaucgucuuacucguccucuucaccguaagccucucacccguccaauccgcccccauaggc

SEQ ID NO: 15613 - RNA, 972 nt, Artificial Sequence
  derived and/or modified CDS sequence (opt11) from CCHFV(ROS/HUVLV-100)__DQ206448.1__Gn
uccgaagaaccaggcgacgacugcaucucaagaacccaacuccuccgcaccgaaaccgccgaaauccacgacgacaacuacggcggacccggcgacaaaaucaccauaugcaacggcucaaccaucgucgaccaacgacucggcagcgaacucggcugcuacaccaucaaccgcgucaaaucauucaaacuuugcgaaaacuccgccacaggcaaaaccugcgaaaucgacuccacccccgucaaaugccgacaaggcuucugccucaaaaucacccaagaaggacgaggccacgucaaacucucccgcggcuccgaaguaguacucgacgccugcgacuccagcugcgaagucaugauccccaaaggcaccggcgacauccucgucgacugcucaggcggccaacaacacuuccucaaggacaaccucaucgaccucggaugcccccacaucccccuucucggcaaaauggccaucuacaucugccgaaugucaaaccacccccgcaccaccauggccuuccucuuuugguucucauucggcuacgucauaaccugcaucuucugcaaagcacuauucuacucacucaucaucaucggcacccucggcaagaaaaucaaacaauaccgagaacucaaaccacaaaccugcaccaucugcgaaaccgcccccgucaacgccauagacgccgaaaugcacgaccucaacugcagcuacaacaucugccccuacugcgccucucgacuaaccuccgacggccucgcccgccacguaccacaaugccccaaacgaaaagaaaaaguagaagaaaccgaacuauaccuaaaccuagaacgcaucccauggaucguccgaaaacuacuccaagucuccgaaagcaccggcguagcacuaaaacgauccucauggcuaaucguccuucucguccuacucaccguaucccuaucccccguccaaucagcccccgucgga

SEQ ID NO: 15614 - RNA, 972 nt, Artificial Sequence
  derived and/or modified CDS sequence (opt11) from CCHFV(AP92)__DQ211625.1__Gn
uccgagggaggcgacggaggcugcaucucccgaacccaacucauaaaaaccgagaccgcagaaguacacggugacgacuacggaggcccaggcgaaaaaaucaccaucugcaacggcucaaccauagucgaccaacgccucggcucagaacucggcugcuacacaaucaaucgcaucaaauccuucaaacucugcgaaaacuccgcccaaggcaaaaacugcgaaauagacuccgcacccguccaaugccgccaaggguacugccuaaaaaucucccaagaaggccgaggccacguaaaacucucccgcggcuccgaaaucguacucgacguaugcgacacaagcugcgaaaucaugauccccaaaggcaccggcgacauccuaguagacugcuccggcggccaacagcacuuucuacaaagcaaccuagucgaccucgggugcccaaacaucccgcuacuaggcaaaauggcaaucuacaucugccgcauguccaaccacccaaaaaccaccauggccuuccucuucugguucagcuucggcuacgucaucaccugcauccucugcaaaacccucuucuacauccuaaucauaaucggcacccucggcaaaaaacucaaacaauaccgcgaacucaaaccccaaaccugcaccaucugcgaauccguccccguaaacgccaucgacgccgaaaugcacgaccucaacugcagcuacaacauuugccccuacugcgcaucccgacucaccuccgaaggccucacccgacacgucaaccaaugcccaaaacgaaaagaaaaagucgaagaaacagaacucuaccucaaccuagaaagaauacccuggaucguacgaaaacuacuccaagucuccgaaucaaccggaguagcacucaaacgcuccucauggaugaucguccuccuaauacuccugauagucucaaugucccccguccaauccgcccccauaucc

SEQ ID NO: 15615 - RNA, 972 nt, Artificial Sequence
  derived and/or modified CDS sequence (opt11) from CCHFV(ArD8194)__DQ211626.1__Gn
gccgaaggaggcuccaacgacugcguaucccguacccaacucguaaaaacagaagucgcagaaauccacgaagacuccuacggcgggcccggcgagaaaaucacaaucugcaacggauccacuaucgucgaccaacgccuaggcucagaacuaggcugcuacaccaucaaccgcguccgaaccuacaaacuaugcgaaaacagcgccaccgaaaaauccugcgaaaucgacuccguccccguaaaaugcaaacaaggcuucugccuaaaaaucacccaagaaggccgcggccacguaaaacuaagcagaggcacagaaaucguccucgacgucugcgacacuuccugcgaacucaugaucccaaaaggcaccggagacauccuagucgacugcagcggcggccaacaacacuuccuccaagacaaccugauugaccucggcugccccaacaucccccuccuaggacgaacagcaauauacgucugccgcauguccaaccacccaaaaacaaccauggccuuccucuucugguucuccuucggcuacgucauaaccugcgucgucugcaaaguccuauucuaccuccuaaucgucaucggcacccuuggaaaacgccucaaacaauaccgugaacuaaaaccacaaaccugcaucgucugcgaauccauccccgucaacgccaucgacgccgaaaugcacgaccuaaacugcaacuacaacauaugccccuacugcgccucacgccucaccucagacggccuuguacgccaugucacccaaugccccaagcgcaaagaaaaagucgaagaaaccgaauuguaccucaaccuagaacgcauccccuggcucguccgcaaacuccuccaagucucugaaucaacaggcgucgcucucaaacgcucaugcuggaugaucacacuacucauacuccucacagucuccaugagccccguccaauccgcucccgucggc

SEQ ID NO: 15616 - RNA, 972 nt, Artificial Sequence
  derived and/or modified CDS sequence (opt11) from CCHFV(ArD15786)__DQ211627.1__Gn
gccgaaggcggcucaaacgacugcguaucccgaacccagcucgucaaaacagaagucaccgaaauacacgaagacuccuacggcggccccggcgagaaaauuacaaucugcaacggcuccacaaucgucgaccaacgccucggcuccgaacuaggaugcuacacaaucaaccgcguacgaacauacaaacucugcgaaaacuccgcaaccgaaaaaucaugcgaaaucgacagcguacccgucaaaugcaaacaaggcuucugccuaaaaaucacacaagaaggccgaggccacgucaaacuaucacgaggcacagaaaucguccucgacgucugcgacacaucaugcgaacucaugauccccaaaggaaccggcgacauccuaguggacugcagcggaggccaacaacacuuccuccaggacaaccuaauagaccuaggcugcccaaacaucccacuccucggacaaaccgccaucuacgucugccgcauguccaaccaccccaaaaccacgauggccuuccucuucugguucuccuucggcuacgucaucacaugcgucgucugcaaaguccuauucuaccuccuaaucgucaucggcacacucggaaaacgccuaaaacaauaccgcgaacucaaaccccaaaccuguaucguaugcgaauccauccccgucaacgccaucgacgccgagaugcacgaccucaacugcaacuacaacaucugcccauacugcgccucccgccuaaccucagacggccucguccgccacgucacacaaugccccaaacgaaaggaaaaagucgaagaaaccgaacucuaccuaaaccucgaacgaauccccuggcuaguacgcaagcuccuccaagucucagaauccaccggcgucgcccucaaacgcagcugcuggauuaucacccuccucauacuccuaaccguaagcaugucccccguccaauccgcacccguaggc

SEQ ID NO: 15617 - RNA, 972 nt, Artificial Sequence
  derived and/or modified CDS sequence (opt11) from CCHFV(ArD39554)__DQ211628.1__Gn
ucagaaagcaauaacaacgacugcgucucacgcacccaacucaucaaaacugaaaacgccgaaauccacggcgacgacuacggcggccccggcgaaaagaucaccauaugcaacggcuccacuaucgucgaacaaagacuaggcucugaacucggaugcuacaccaucaaccgcaucaaauccuucaaacucugcgaaaacuccgccuccggcaaaggcugcgaaaucgacucaacaccaguuaaaugcaaacaaggauucugccucaaaaucacccaagaaggccgcggccacgucaaacuaucgcgcggcuccgaaaucauucucgacguaugcgacuccuccugcgaaaugaugaucccaaaaggcuccggcgacauacucguagacugcagcggcggccaacaacacuuccuacaagacaaccuaguagaccucggaugccccaacgucccacuccucggaaaaauggcaaucuacaucugccguauguccaaccacccaaaaaccaccauggccuuccuauucugguucucauucggauacguaauaaccuguaucuucugcaaaguaaucuucuacguccucaucaucaucggcacccucggcaaacgcauaaaacaauaccgcgaacucaaaccacaaaccugcacaauaugcgaagcaacacccguaaacgccaucgacgccgaaaugcacgaccuaaacugcuccuacaacauaugccccuacugcgcuucccgacucaccuccgaaggccucguccgccacguaacccaaugccccaaacgcaaagagaaaaucgaagaaaccgaacucuaccuuaaccuagaacgcauacccugguucguccgaaaacuccuccaagucucagaauccaccggagucgcccuaaaacgcuccuccuggcucgucacccuccucguccuccuaaccgucucccucucacccguccaaucagcccccaucggc

SEQ ID NO: 15618 - RNA, 972 nt, Artificial Sequence
  derived and/or modified CDS sequence (opt11) from CCHFV(Drosdov)__DQ211630.1__Gn
ucugaagaacccggcgacgacugcaucucacgcacccaacuccucaagacagaaaccgccgaaauccacgacgacaacuacggcggccccggcgacaaaauaaccaucugcaacggcucuaccaucgucgaccaacgucucggcucagaacuuggcugcuacacaaucaaccgcgucaaaucauuuaaacucugcgaaaacuccgccacaggcaaaaccugcgaaaucgacagcacccccgucaaaugccgccaaggcuucugucucaaaauaacccaagaaggccgcggacacgucaaacuaucccgaggcuccgaagucguccuagacgcaugcgacucaucaugcgaagucaugaucccaaaaggaaccggcgacauccuagucgacugcagcggcggccaacaacacuuccucaaagacaaccuaaucgaccuaggcugcccacauaucccgcuccucggcaagauggcaaucuacaucugccgaauguccaaccacccccgaacaaccauggcauuccucuucugguucuccuucggcuacgucauaaccugcaucuucugcaaagcccucuucuacucccuaaucauaauaggcacacuaggaaagaaaaucaaacaauaccgcgaacucaaaccucaaacaugcaccaucugcgaaaccgccccagucaacgccauagacgcagaaaugcacgaccucaaaugcuccuacaacaucugcccauacugcgccagccgccucacaucagacggccuagcccgccacgucacccaaugccccaaacgcaaagaaaaagucgaagaaaccgagcucuaccuaaaccucgaacgcauccccuggaucguccgaaaacuccuccaagucuccgaauccaccggcgucgcccucaaaagauccucauggcuuauaguccuccucguacuccuuaccgucucccucucccccguccaauccgcccccguaggc

SEQ ID NO: 15619 - RNA, 972 nt, Artificial Sequence
  derived and/or modified CDS sequence (opt11) from CCHFV(Oman)__DQ211632.1__Gn
uccgaagaaagcggcgaagacugcaucucccgaacccaacuacuccgcaccgaaacagccgaaauccacggcgacaacuacggcgguccaggcgacaaaaucaccaucugcaacggcuccaccaucgucgaccaacgccucggcucagaacugggcugcuacacaaucaaccgugucaagucauuuaaacuaugcgaaaacuccgccaccggaaaauccugcgaaaucgacaacaccccagucaaaugcaagcaaggauucugccucaaaaucacccaagaaggccguggccacgucaaacucucccgagacucagaagucguccuagacgccugcgacuccuccugcgaaaucaugaucccaaaaggaaccggcgacauccucguagacugcuccggcggccaacaacacuuccucaaagacaaccucaucgaccuaggaugccccaauauaccccuccucggcaaaauggccaucuacauaugccgaauguccaaccaccccaaaaccacaauggcauuccuauucugguucuccuucggcuacgucauaaccugcauccuuugcaaaguaauauucuaccuccucaucgucgucggcacccuaggcaagaaauucaaacaauacagagaacuaaaaccccaaaccugcaccaucugcgaaaccacccccgucaacgccaucgacgcggaaaugcacgaccuaaacugcucauacaacaucugccccuacugcgccucccgccuaaccuccgacggccuugcccgccacgucaugcaaugccccaaacgcaaagagaaaaucgaagaaaccgaacucuaccucaaccucgaacgcauucccugggucguacgaaaacuccuacaagucuccgaauccaccggcgucgcccucaaacgcuccuccuggcuaauaguacuccuaguccuacuaaccgucucccucucccccguccaaucagccccaaucggu

SEQ ID NO: 15620 - RNA, 972 nt, Artificial Sequence
  derived and/or modified CDS sequence (opt11) from CCHFV(SPU97/85)__DQ211633.1__Gn
ucagaagaaagcgacggcgacugcaucagccgaacccaacuacuccgcaccgaaaccgccgaaauacacuccgacaacuacggcggccccggcgacaaaaucaccaucugcaacggcucaacaaucgucgaccaacgccucggcuccgaacucggcugcuacaccaucaaccgcgucaaauccuucaaacuaugcgaaaacuccgccacaggaaaauccugcgaaaucgacucaacccccgucaaaugccgccaaggcuucugccuaaaaauaacccaagaaggccgcggccacgucaaacuaucccgaggcucagaaauaguccucgacgccugcgacuccuccugcgaaaucaugauccccaaaggcacgggagacauccucgucgacugcuccggaggacaacaacacuuccucaaagacaaccucauagaccucggcugccccaacaucccccuccucggacgaauggccaucuacaucugccgcauguccaaccaccccaaaacuaccauggccuuccuauucugguucucauucggcuacgucauaaccugcauccucugcaaagucaucuucuaccuccucauuguagcaggcaccgucggcaaaaaauucaaacaauaccgugaacuacgaccacaaaccugcaccauaugcgaaaccacacccgucaacgcaaucgacgccgaaaugcacgaccucaacugcucauacaacaucugccccuacugcgccagccgccuaaccuccgauggccuagcccgccacgucaugcaaugccccaaacgaaaagaaaaaaucgaagaaacagaacucuaccuaaaccucgaacgcaucccauggguaguccguaaacuacuccaagucucagaaucaaccggcgucgcacucaaacgcagcuccuggcucaccguccuccucguccuccuaaucgucucacugucccccguccaauccgcacccaucgga

SEQ ID NO: 15621 - RNA, 972 nt, Artificial Sequence
  derived and/or modified CDS sequence (opt11) from CCHFV(SPU103/87)__DQ211634.1__Gn
ucagaagaauccucagacgacugcauaucccgcacacaacuccuccgaaccgaaaccgccgaaauccacggcgacaauuacggcggcccaggagacaaaaucacaaucugcaacggcuccaccaucgucgaccaacgacugggcuccgaacucggaugcuacacaaucaacagagucaaaaccuucaaacucugcgaaaacucagccaccggcaaaucaugcgaaaucgacuccgucccagucaaaugccgccaaggauacugccucaagaucacccaagaaggccgaggccacguaaaacuaucccgaggcuccgaagucguacuugacgcaugcgacaccucaugcgaagucaugauacccaagggcaccggcgacauccucgucgacuguucaggcggccaacaacacuuccucaaagacaaccucaucgaccucggaugcccuaaaauaccccuccucggaaaaauggcaaucuacaucugccgcaugagcaaccaccccaaaaccacuauggcguuccucuucugguucuccuucggcuacgucauaaccugcguccucugcaaagccaucuucuaccuccuaaucaucgucggcacccucggcaaacgccucaaacaauaccgagaacucaaaccccaaacaugcaccaucugcgaaaccacccccgucaacgccaucgacgccgaaaugcacgaccucaacugcuccuauaacaucugucccuacugcgccucacgccuaaccucggacggccucgcccgccacgucacccaaugcccaaaacgcaaagaaaaagucgaagaaaccgaacucuaccuaaaccucgaacgcauccccuggguaguccgccgccuccuccaagucagcgaauccaccggcgucgcacucaaacgauccuccuggcucauaguccuccucguacucuucaccgucucccugucccccguccaauccgcccccaucagc

SEQ ID NO: 15622 - RNA, 972 nt, Artificial Sequence
  derived and/or modified CDS sequence (opt11) from CCHFV(SPU415/85)__DQ211635.1__Gn
ucugaagaaucugacggcgacugcaucucacgcacccaacuccugcgcaccgaaaccaccgaaauccacuccgacaacuacggaggcccaggcgacaaaaucaccaucuguaacggcagcacaaucgucgaccaacgccugggcuccgaacucggcugcuacacaauaaaccgcgucaaaucauucaaacucugcgaaaacuccgcaaccggcaaaagcugcgaaaucgacagcacccccgucaaaugccgccaaggcuuuugccuaaaaaucacccaagaaggucgcggccacguaaaacucucacgcggcucagaaaucguccucgacgccugcgacuccaacugcgaaaucaugauaccaaaaggaaccggagacauccucgucgacugcuccggcggccaacaacacuuccucaaagacaaccucaucgacuuaggcugcccaaacaucccccuccucggcaaaauggccaucuacauaugccgaauguccaaccaccccaaaaccacaauggccuuccuguucugguucuccuucggcuacguuaucaccugcauccucugcaaagucaucuucuaccuccucaucguagccggcaccgucggaaaaaaauucaaacaauaccgcgaacucagaccacaaaccugcaccaucugcgagaccauccccgucaacgccaucgacgcagaaaugcacgaccucaacuguuccuacaacaucugcccauacugcgccucgcgacugaccucagacggacucgcccgccacgucaugcaaugucccaaacgcaaagaaaaagucgaagaaaccgaacucuaccuaaaccuagaacgcauacccugggucguccggaaacuccuccaagucucagaaucaaccggagucgcacucaaacgauccuccuggcucacaguccuccucguccuacuaaucgucucacugucacccguccaauccgcccccaucggc

SEQ ID NO: 15623 - RNA, 972 nt, Artificial Sequence
  derived and/or modified CDS sequence (opt11) from CCHFV(Turkey200310849)__DQ211636.1__Gn
ucugaagaacccggcgacgacugcauaucccgcacacaacuccuccgcaccgaaaccgccgaaauccacgacgacaacuacggaggccccggcgacaaaaucacaaucugcaacggcagcaccaucgucgaccaacgccuaggcucagaacucggaugcuacacgaucaaccgcguaaaauccuucaaacuaugcgaaaacuccgccaccggcaaaaccugcgaagucgacuccacccccgucaaaugccgccaaggauucugccucaaaaucacccaagaaggacgcggacacgucaaacuaucccgcggcucugaagucguccucgacgccugcgacuccuccugcgaagucaugauacccaaaggaaccggcgacauccucgucgacugcuccgguggccaacaacacuuccucaaagacaaccucaucgaccucggcugcccccacauuccccuacucggcaaaauggccaucuacaucugccgcaugucaaaccacccacgcaccaccauggccuuccuuuucugguucuccuucggauacgucauaaccugcaucuccugcaaagcacucuucuacucccucaucaucaucggcacccucggcaagaaaaucaaacaauaccgcgaacucaaaccucaaaccuguacuaucugcgaaaccgccccagucaacgcaauagacgccgaaaugcacgaccugaacugcagcuacaacaucugccccuacugcgccucccgccucaccuccgacggccucgcccgccacgucacacaaugccccaaacgcaaagaaaaagucgaagaaaccgaacucuaccucaaccucgaacgcaucccauggaucguccgaaaacuccuccaagucuccgaaucaaccggagucgcccucaaacgcuccucauggcucaucguacuccuaguccuccucaccguaucacucucccccguccaaucagcccccguagga

SEQ ID NO: 15624 - RNA, 972 nt, Artificial Sequence
  derived and/or modified CDS sequence (opt11) from CCHFV(Kosova Hoti)__EU037902.1__Gn
uccgaagaacccggcgacgacugcaucagccgcacccaacuccuccgaaccgaaacagcagaaauccacgacgacaacuacggcggccccggcgacaaaaucacaaucugcaacggcuccacuaucgucgaccaacgccuaggcucagaacucggcugcuacaccaucaaucgcgucaaaucauucaaacuuugcgaaaacuccgccaccggcaaaaccugcgaaaucgacuccacccccguaaaaugucgccagggcuucugccucaaaaucacacaaaaaggccgcggacacgucaaacuuucccgaggcuccgaagucguccucgacgccugcgacagcaacugcgaagucaugauccccaaaggcaccggcgauauccucgucgacugcuccggaggccaacaacacuuccucaaagacaaccugaucgaccucggaugcccacacaucccccuacucggcaaaauggcaaucuacauaugccgcauguccaaccacccaaaaaccaccauggccuuccucuucugguucuccuucggcuacguaaucacaugcauauucugcaaagcccucuucuacucccucaucauaaucggcacccucggcaagaaaauuaaacaauaccgcgaacuaaaaccccaaaccugcaccaucugcgaaaccgccccagucaacgccaucgacgcagaaaugcacgaccuaaacugcucauacaacaucugcccauacugcgccucacgccucaccuccgacggccucgcccgccacguaaaacaaugccccaaacgaaaagaaaaagucgaagaaaccgaacucuaccucaaccucgaacgcauccccugggucguccgcaaacuacuccaagucuccgaaucaaccggcgucgcccucaaacgaucauccuggcucauaguccuccucguccuccucaccguaucccucuccccaguccaaagcgccccagucggc

SEQ ID NO: 15625 - RNA, 972 nt, Artificial Sequence
  derived and/or modified CDS sequence (opt11) from CCHFV(YL04057)__FJ562094.1__Gn
gccgaaggcgguucaucagacugcaucucccgaacccaacucgucaaaaccgaagucgccgaaauccacgaagacucauacggcggccccggcgagaaaaucacaauaugcaacggauccaccaucgucgaccagcgccucggccgcgaacucggcugcuacacaaucaaccgaguccgcuccuacaaacucugcgaaaacucugcauccggaaaauccugcgaaauagacuccaucccugucaaaugcaaacaaggcuucugccuaaaaaucacccaagaaggccgcggacacgucaaacuaucccgaggcaccgaaauaguccucgacgucugcgacucauccugcgaacucaugauccccaaaggcacaggugacauccuaguagacugcuccggcggacaacaacacuuccuccaaaacaaccuuaucgaccucggaugccccaacgucccccuccucggcaaaauggccauauaugucugccgcauguccaaccaccccaaaaccacaauggccuuccucuucugguucuccuucggcuacguaaucacuugcaucgccugccgcguccucuucuaccuccuuaucgccauaggcaccgucggcaagaaacucaaacaauaccgcgaacucaaaccccaaaccugcauaguaugcgaauccgucccagucaacgccaucgacgccgaaaugcacgaacucaacugcucauacaacaucugccccuacugcgccucacgucucagcacagacggccucauccgccacgucacacaaugccccaaaagacgagaaaaaguagaagaaaccgaacuauuccuaaaccuagaacgcaucccuuggcucguacgaaaacuccuccaagucuccgaauccacaggcauggcccuaaaacgcuccugcuggaugauaacccuccucauccuacuccucguaagcaucuccccaguccaaagcgcccccgucggc

SEQ ID NO: 15626 - RNA, 972 nt, Artificial Sequence
  derived and/or modified CDS sequence (opt11) from CCHFV(V42/81)__GU477490.1__Gn
uccaaagaaccuggcgacgacugcaucagccgcacucaacucaugcgcaccgaaaccgccgaaauacacgacgacaacuacggcggacccggagacaaaaucaccaucugcaacggaucuaccaucgucgaccaacgacucggcuccgaacucgguugcuacaccaucaaucgcguuaaauccuucaaacucugcgaaaacuccgcaaccggaaaggccugugaaguagacagcacccccguaaaaugccgccaaggcuucugccuaaaaaucacacaagaaggccgcggacacgucaaacuaucccgcggcuccgaaguuguccucgacgccugcgacagcuccugcgaagucaugaucccaaaaggcacaggcgacauccuagucgacugcagcggaggccaacaacacuuucuaaaagacaaccucaucgaccucgaaugcccccacauacccuuacuuggcaaacucgccaucuacaucugccgcaugucuaaucacccccgcacuaccauggcauuccucuucugguucggcuucggcuacgucauaaccugcauccucugcaaagcccucuucuacucacuaaucaucauaggaacccuaggcaaaaagaucaaacaauaccgcgaacuaaaaccacaaacaugcacaaucugcgaaaccgcccccgucaacgccauagacgccgaaaugcacgaccucaacugcucauacaauaucugccccuacugcgccucgagacucaccuccgacggacucgcccgacacguaacccaaugccccaaacgcaaagaaaaagucgaagaaaccgaacuauaccuaaaccucgaacgaaucccauggauaguccgcaaacuccuucaaguauccgaauccaccggcgucguacucaaacgcuccucuuggcucaucguccuccucguccuccucacagucucccucucccccguccaauccgcccccguaggc

SEQ ID NO: 15627 - RNA, 972 nt, Artificial Sequence
  derived and/or modified CDS sequence (opt11) from CCHFV(Afg09-2990)__HM452306.1__Gn
ucagaagaauccggcgacgacugcaucuccagaacacaacuccuacgaacagaaaccgcagaaguccacggagacaacuacggcggccccggcgacaaaaucaccauuugcaacggcagcaccgucgucgaccaacgccuuggcucagaacucggaugcuacaccaucaaccgcguccgcagcuucaaacucugcgaaaacucagccaccggcaaauccugcgaaaucgacuccauucccgucaaaugcaaacaaggcuacugccucaaaaucacccaagaaggccgcggccacgucaaacuaucacgcggcucagagguaguccucgacgucugcgacuccuccugcgaaguaaugauccccaaaggaaccggcgacauccucgucgacugcucaggcggccaacagcacuaccucaaagacaaccucgucgaccuaggaugccccaaaauaccccuccucggcaaaauggcuaucuacaucugccgaaugucaaaccaccccaaaaccaccauggccuuccucuucugguucucauucggauacguaauaaccugcauccuaugcaaagcuauauucuuccuccuaaucaucuucggcacacuaggcaagagauucaagcaguaccgcgaacucaaaccacaaaccugcaccaucugcgaaaccaccccagucaacgccaucgacgcagaaaugcacgaccucaacugcuccuacaacauaugucccuacugcgccuccagacuaaccuccgacggccucgcccgacacgucacccaaugccccagacgcaaagaaaaagucgaagaaacagaacucuaccucaaccucgaacgcauacccuggguaguacgcaaacuccuacaagucuccgaauccaccggcaccguccuaaaacgcucauccuggcuaauaguccuacucguccucuucacugucagccucucacccguccaauccgcacccauaggc

SEQ ID NO: 15628 - RNA, 972 nt, Artificial Sequence
  derived and/or modified CDS sequence (opt11) from CCHFV(Sudan Al-Fulah 3-2008)__HQ378184.1__Gn
uccgaagaacccuccgacgacugcaucucccgaacccaacuacuccgaaccgaaacagccgaaauacacggcgacaacuacggcggccccggagacaaaaucaccaucugcaacggcagcacaaucguagaccagcgccucggauccgaacucggcugcuacaccaucaaccgcgucaaauccuucaaacucugcgaaaacuccgccaccggaaaaucaugcgucaucgacuccguccccgucaaaugccgccaaggcuacugccuacgaaucacccaagaaggacgcggacacgucaaacucucccgaggcucagaaguaguccuagacgcaugcgacaccuccugcgaaaucaugaucccuaaaggcaccggcgacauacucgucgacugcuccggcggacaacaacacuuccuaaaagacaaucucgucgaccucggcugccccaaaaucccccuccucggaaaaauggccaucuacaucugccgcauguccaaccaccccaaaacaacaauggccuuccucuucugguucucauucggcuacgucauaaccugcauccuaugcaaagccaucuucuaccuccucaucauaaucggcacccucgguaaaagauucagacaauaccgagaacucaaaccccagaccugcaccaucugcgaaaccacucccgucaacgccauagacgccgagaugcacgaccucaacugcuccuacaacaucugcccauacugcgccucccgccucaccucagacggccuagcccgccacgucacacaaugccccaaacgcaaggaaaaagucgaagaaaccgaacuauaccuaaaccucgaacgcaucccaugggucguacgcaaacuacuacaagucuccgaaagcaccggagucgcccuaaaacgcuccuccuggcucaucguccuccuaguccucuucacagucucacuuuccccaguacaauccgcccccaucgga

SEQ ID NO: 15629 - RNA, 972 nt, Artificial Sequence
  derived and/or modified CDS sequence (opt11) from CCHFV(Sudan AB1-2009)__HQ378187.1__Gn
uccgaagaacccucagacgacugcaucucccgcacucaacuccuacgcaccgaaaccgccgaaauccacggcgacaacuacggaggacccggcgacaaaauaaccaucuguaacggauccacaaucgucgaccaacgccucggcuccgaacucggcugcuacaccaucaaccgagucaagagcuucaaacucugcgaaaacuccgccaccggcaaaaacugugaaaucgacuccgucccagucaaaugccgccaaggcuacugccuccgaaucacacaagaaggccgaggccaugucaaauuaagucgcggauccgaaguaguccucgacgcaugcgacaccucuugcgaaaucaugauccccaaaggcaccggcgacauccucguagacugcuccggcggccaacaacacuuccucaaagacaaccucaucgaccucggcugccccaaaaucccccuccuaggcaaaauggccaucuacaucugccgaauguccaaccaccccaaaaccacuauggcauuccucuucugguucuccuucggcuaccucauaaccugcauccuaugcaaagccaucuuuuaccuacucaucaucaucggcacccucggcaaaagacucaaacaauaccgagaacuaaaaccccaaacaugcaccaucugcgagacaacccccgucaacgccaucgaugccgaaaugcacgaccucaacugcucauacaacaucugccccuacugcgccucacgccucacauccgacggacuagcccgccacgucauccaaugccccaaacgcaaagaaaaagucgaagaaaccgaacuuuaccucaaccucgaacgaauacccuggguaguccgcaaacuacuccaaguauccgaauccaccggagucgcacucaaacgcuccuccuggcucaucguccuacuuguucucuucaccgucucccucuccccaguccaaucagcccccauaggc

SEQ ID NO: 15630 - RNA, 972 nt, Artificial Sequence
  derived and/or modified CDS sequence (opt11) from CCHFV(NIVA 118595)__JN572083.1__Gn
uccgaagaauccggcgacgacugcaucucccgaacccaacuccuccgaacagaaaccgccgaaguccacggcgacaacuacggcggccccggcgacaaaaucaccaucugcaacggcuccaccgucgucgaccaacgccucggaucagaacucggcugcuacaccaucaaccgcgucaaauccuucaaacucugcgaaaacuccgcaaccggaaaauccugcgaaaucgacucaauccccguaaaaugccgacaaggcuacugccucaaaauaacacaagaaggacgaggccacgucaaauuaucccgcggcuccgaggucguccucgaugccugcgacagcagcugcgaagucaugauccccaaaggcaccggcgacauccuagucgacugcucaggcggacaacaacacuuccuuaaagacaaccucauagaccucggcugccccaaaauaccccuccuaggcaaaauggccauauacauaugccgcauguccaaccaccccaaaacuaccauggccuuccucuucugguucuccuucggcuacguaauuaccugcauccucugcaaagucaucuucuaccuccucaucaucuucggcacccucggcaaaagauucaaacaguaccgcgaacuaaaaccccaaaccugcaccaucugcgaaaccacgccagucaacgccaucgacgccgaaaugcacgaccuaaacugcuccuacaacaucugccccuacugcgccucacgccuaacaagcgacggccuugcccgccacguaacacaaugccccaaacgcaaagaaaaggucgaagaaaccgaacucuaccucaaccucgaacgcauccccugggucguacgcaaacuacuccaagucuccgaaucaaccggcaucgcccuuaaacgauccuccuggcucaucguccuccucguccucuucaccguaagcaucacccccguccaauccgcacccaucggc

SEQ ID NO: 15631 - RNA, 972 nt, Artificial Sequence
  derived and/or modified CDS sequence (opt11) from CCHFV(SCT ex Afghanistan)__KC344856.1__Gn
agugaagaauccggcgacgacugcauaagucgcacccaacuccuaagaaccgaaaccgcagagguccacaacgacaacuacggcggccccggcgacaaaaucaccauuugcaacggcuccaccaucgucgaccaacgccucggaucugaacucggcugcuacaccauaaaccgagucaaauccuucaaacuaugcgaaaacuccgcaaccggcaaaagcugcaaaaucgacuccacgcccgucaaaugccgccaaggcuucugccucaaaaucacccaagaaggccgcggccaugucaagcucucaaggggcuccgaagucguccucgacgcaugcgacucauccugcgaaaucaugauccccaaaggcaccggcgacauccucgucgacugcagcggcggccaacaacacuuccucaaagacaaccucaucgaccucggaugcccaaacauccccuuacuaggcaaaauggccaucuacaucugccgcauguccaaccaccccaaaacaaccauggccuuccuauucugguucuccuucggauacgucauuacaugcaucuucugcaaaguaaucuucuaccuccuaaucgucguaggcacacucggcaagaaauucaaacaauaccgagaacucaaaccccaaaccugcacuauaugcgaaacaaccccaaccaacgccaucgacgccgaaaugcacgaccucaacugcucauacaacauuugccccuacugcgccucccgccucaccagcgacggccucgcccgacacgucacccaaugccccaaacgcaaagaaaaaguagaagaaacagagcucuaccucaaccuagaacgcauccccuggaucguccgcaaacuccuccaagucucagaauccacaggcgucgcccucaaacgcucauccuggcucaucguccuccucguacuccucaccgucucccuaucacccguacaaucugcccccauagga

SEQ ID NO: 15632 - RNA, 972 nt, Artificial Sequence
  derived and/or modified CDS sequence (opt11) from CCHFV(Zahedan 2007)__KC867273.1__Gn
uccgaagagucgggcgacgacugcaucucacguacccaacuccuccgcaccgaaaccgccgaaguacacggagacaacuacggaggccccggcgacaaaaucacaaucugcaacggcuccaccguaguagaccaacgccucggcucugagcucggcugcuacaccaucaaccgaguccgcucauucaaacuaugcgaaaacuccgcaacaggcaaaucaugcgaaaucgacuccauccccguaaaaugcaaacaaggcuucugccuaaaaaucacccaagaaggccgcggccacgucaaacucucccgcggcuccgaagucguccucgacgucugcgacuccuccugcgaagucaugauccccaagggcaccggcgacauccucgucgacugcagcggcggccaacaacacuuccucaaagacaaccucgucgaccuaggaugccccaaaaucccccuccuaggcaaaauggccaucuacaucugccgaaugagcaaccaccccaaaaccaccauggcauuccucuuuugguucagcuucggcuacgucauaaccugcauccucugcaaagccaucuucuuccuccucaucaucuucggaacccuuggaaaacgcuucaaacaauaccgagaacuaaaaccacaaaccuguacaauaugcgaaacgacccccguaaacgccaucgacgccgaaaugcacgaccucaacugcuccuauaacauaugccccuacugcgccucccgacucacauccgacggccucgcccgccacguuacccaaugcccaagacguaaagaaaaagucgaagaaacagaacucuaccucaaccucgaaagaauccccuggguaguccgcaaacuccuacaaguaagcgaauccacaggcaccguccucaaacgcucauccuggcucaucguacuacucguacuauucacagucucccucucccccguccaaucagcccccauaggc

SEQ ID NO: 15633 - RNA, 972 nt, Artificial Sequence
  derived and/or modified CDS sequence (opt11) from CCHFV(SPU 44/08)__KJ682805.1__Gn
ucugaagaauccaacgacgacugccuaucacgcacccaacuccuccgcacugaaaacgccgaaauccacuccgauaacuacggcggccccggugauaaaaucaccaucuguaacggcuccaccaucgucgaccaacgccucggcucagaacucggcugcuacaccaucaaccgugucaaauccuucaaacucugcgaaaacuccgcaaccggcaaaucuugcgaaaucgacucaacccccguacgaugccgacaaggcuucugccuuaaaauaacccaagaaggacgcggccacguaaaacucucacgcggcucagaagucguccucgacgcaugcgacuccucaugcgagaucaugauccccaaaggaacaggagacauccucgucgacugcuccggcggccaacaacacuuccucaaagacaaccucgucgaccucggaugcccuaacauaccacuccucggaaaaauggccaucuacaucugccgcauguccaaccaucccaaaaccacaauggcauuccucuucugguuuuccuuuggauacguaauaaccugcauccuaugcaaagccaucuucuaccuccuuaucguagucggcacccucggcaagaaauucaaacaauaccgagaacucaaaccccaaaccugcaccauaugcgaaaccaaccccguuaacgccaucgacgccgaaaugcacgaccucaacugcuccuacaacaucugccccuacugcgccucccgccucaccucagacggccucgcccgccacgucaugcaaugccccaaacgcaaagagaaaaucgaagaaaccgaacucuaccuaaaccucgaacgaaucccaugggucguccggaaacuacuccaagucucugaaucaaccggcgucgcccuaaaacgaucauccuggcucguaauacuucucguacuccucaccgucucccuaucccccguccaauccgcccccaucagc

SEQ ID NO: 15634 - RNA, 972 nt, Artificial Sequence
  derived and/or modified CDS sequence (opt11) from CCHFV(SPU 383/87)__KJ682806.1__Gn
uccgaagaaucaaacgacgacugccuaucccgaacacaacuccuccgcaccgaaaacgccgaaauccacagcgacaacuacggcggacccggcgacaaaaucacaaucugcaacggcuccaccaucguagaccaacgccuaggcuccgaacucggcugcuacaccaucaaccgcguaaaauccuucaaacucugcgaaaacucagccacaggcaaaucgugcgaaaucgacuccacucccguccgcugccgucaaggauucugccucaaaaucacccaagaaggccgcggacacguaaaacucucacgcggcuccgaagucguccucgacgccugcgacucauccugcgaaaucaugauccccaaaggcacaggcgacauccuugucgacugcucaggcggacaacaacacuuccuuaaagacaaccuugucgaccucggcugcccaaacaucccccuucucggcaaaauggccaucuacaucugccgcauguccaaccaccccaaaacaacaauggcauuccucuucugguucucuuucggauacguaauaaccugcauccucugcaaaguaaucuucuaccuccucgucgucgucggcacccucggcaagaaauucaaacaauaccgcgaacucaaaccacaaaccugcaccauaugcgagaccaaccccgucaacgcaaucgacgccgaaaugcacgaccuaaacugcagcuacaacaucugccccuacugcgccucccgccucaccuccgacggccuagcacgccacguaauccaaugccccaaacgcaaagagaaaaucgaagaaaccgaauuauaccuaaaccuagaacgaaucccuugggucguccgcaaacuccuccaagucuccgaaucaacaggcgucgcccucaaacgcuccagcuggcucgucauccuccuaguacuacucaccgucagccucucccccguccaguccgcucccaucuca

SEQ ID NO: 15635 - RNA, 972 nt, Artificial Sequence
  derived and/or modified CDS sequence (opt11) from CCHFV(SPU 130/89)__KJ682807.1__Gn
uccgaagaacccaacuacgacugccucucccgcacccaacuccugcgcacagaaaacgccgaaauccacucagacaacuacggcggccccggcgacaaaaucaccaucugcaacggauccaccaucgucgaccaacgacucggcuccgaacucggcugcuacaccauaaaccgcgucaaauccuucaaacucugcgaaaacuccgccaccggcaaauccugcgaaaucgacucaacgcccguacgcugccgacaaggcuucugccucaaaaucacccaagaaggccgcggccacgucaaacucuccagaggcuccgaagucguccucgacgcaugcgacucuuccugcgaaaucaugauccccaaaggcaccggcgacauccucgucgacugcuccggcggccaacaacacuuccuaaaggacaaccuagucgaccuaggcugccccaacauaccccuccugggcaaaauggcaaucuacauaugccgaauguccaaccaccccaaaaccaccauggcauuccuauucugguucucauucggcuacgucauaaccugcauccuaugcaaagucaucuucuaccuacucaucguagucggcacacucggcaagaaauucaaacaguacagagaacucaaaccccaaaccugcaccaucugcgaaaccaaccccgucaacgccaucgacgccgaaaugcacgaccuaaacugcuccuacaacaucugccccuacugcgccucccgccuuaccuccgacggccucgcacgccacgucaugcaaugccccaaacgcaaagagaaaaucgaagaaaccgaacucuaccucaaccucgaacgcauccccugggucguccgcaaacuccuccaaguuuccgaaucuacaggcgucgcccuaaaacgcuccuccuggcucguuguccuccucguccuccucaccgucucccucucccccguccaaucagcccccaucucc

SEQ ID NO: 15636 - RNA, 972 nt, Artificial Sequence
  derived and/or modified CDS sequence (opt11) from CCHFV(SPU 497/88)__KJ682808.1__Gn
uccgaagaauccaacgacgacugccucagccgaacccaacuccuucgaaccgaaaacgccgaaauccacagcgacaacuacggcggccccggagacaaaaucaccaucugcaacggaagcaccauagucgaccaacgccuuggaucagaacucggcugcuacaccaucaaccgcguaaaaucauucaaacucugcgaaaacuccgccaccggcaaauccugcgaaaucgacagcacccccguacgcugccgacaaggcuucugccuaaaaaucacccaagaaggaaaaggccacgucaaacucucccgcggauccgaagucguccuugacgcaugcgacuccuccugcgaaaucaugauccccaaaggaaccggcgacauccucgucgacugcuccggcggccaacaacacuuccucaaagacaaccucgucgaccucggaugccccaacaucccacuccucggcaaaauggccauauacaucugccggauguccaaccaucccaaaacaaccaugguauuccucuucugguucucauucggcuacgucaucacaugcauccucugcaaagucaucuucuaccuccucauagucguaggcacccucggcaagaaauucaaacaauaccgcgaacucaaaccacaaaccuguaccauaugcgaaacaaaccccgucaacgccaucgacgccgaaaugcacgaccucaacugcuccuauaacauaugccccuacugugccucacgacuaaccucggacggccucgcccgccacgucaugcaaugccccaaacgcaaagagaaaaucgaagaaaccgaacucuaccucaaccucgaacgaauccccugggucguccgcaaacuccuacaggucuccgaauccaccggcgucgcccucaaacgauccuccuggcuagugauacuccuaguccuccucaccgucucccucuccccuguacaauccgcccccauaagc

SEQ ID NO: 15637 - RNA, 972 nt, Artificial Sequence
  derived and/or modified CDS sequence (opt11) from CCHFV(SPU 18/88)__KJ682810.1__Gn
ucagaagaaagcaacgacgacugccuaagccgcacccaacuacuccgaacagaaaacgccgaaauccacuccgacaacuacggcgguccaggagacaaaaucacaaucugcaacggcagcacaaucguagaccaacgccugggcucagaacuaggcugcuacacaaucaaccgcgucaaauccuucaaacucugcgaaaacuccgccacaggaaaauccugcgaaaucgacucaacacccguccgaugccgccaaggcuucugccucaaaauaacccaagaaggucgcggccacgucaaacucucccgaggcuccgaagucguccucgacgcuugcgacagcuccugcgaaaucaugauccccaaaggaaccggagacauccucguagacugcuccggcggccaacaacacuuccucaaagacaaccuugucgaccucgggugccccaacaucccccuccucggcaaaauggccaucuacauaugccguauguccaaccaccccaaaaccacaaugggauuccuauucugguucuccuucggcuacgucauuaccugcauccucugcaaagucaucuucuaccuacuaaucgucguaggcacccucggcaagaaauucaaacaauaccgcgaacuaaaaccccaaaccugcaccaucugcgaaaccaacccugucaacgccaucgacgccgaaaugcacgaccuaaacugcagcuauaacaucugcccauacugcgccucccgccucaccuccgacggacucgcccgccacgucaugcaaugcccaaaacgcaaagaaaagauagaagaaaccgaacucuaccuaaaccuagaacgaaucccaugggucguaagaaaacuacuacaagucucagaauccacaggcgucgcccucaaacgaucuucauggcuaguaauccuccuaguccuacuaaccgugucccuaucaccaguccaauccgccccaaucagc

SEQ ID NO: 15638 - RNA, 972 nt, Artificial Sequence
  derived and/or modified CDS sequence (opt11) from CCHFV(SPU 48/90)__KJ682813.1__Gn
ucagaagaacccagcgacgacugcaucucccgcacccaacuccuccgcaccgagaccgccgaaauccacggcgacaacuacggcggacccggcgacaaaaucaccauaugcaacggcucaacaauagucgaccagcgccucggcucagaacuaggcugcuacaccaucaaccgcgucaaauccuucaaacucugcgaaaacuccgccaccggcaaauccugcgucauagacucaguccccguuaaaugccgucaaggcuacugccuucgcauuacccaagaaggccgcggacacgucaaacucucccgcggcuccgaagucguacucgacgccugcgacaccucaugcgaaauaaugauccccaaaggcacaggagacauccucguagauugcuccggcggacaacaacacuuccucaaagacaaccucaucgaccucggcugcccaaaaauaccccuccucggcaaaauggccaucuacaucugccguauguccaaccaucccaccaccaccauggcauuccucuucugguucuccuucggcuacguaauaaccugcauccucugcaaagcaaucuucuaccuacucaucaucaucggcacacucggcaaacgcuucagacaauaccgagaacucaaaccccaaacaugcaccaucugcgaaaccacaccagucaacgccaucgacgccgaaaugcacgaccucaacugcuccuacaacaucugcccauacugcgccucccgccucaccucagacggccucgcccgacacgucacacaaugccccaaacgcaaagaaaaagucgaagaaaccgagcuauaccucaaccucgaacgcauccccugggucguccgcaaauuacuccaagucuccgaaucaacaggcguagcccuuaaacguucuucauggcucaucgugcuccucguccucuucaccgucucccucucccccguccaaucagcacccauaggc

SEQ ID NO: 15639 - RNA, 972 nt, Artificial Sequence
  derived and/or modified CDS sequence (opt11) from CCHFV(SPU 187/90)__KJ682814.1__Gn
uccgaggaacccucugacgacugcaucucccgcacccaacucuuacgcaccgaaaccgccgaaauccacggcgacaacuacggcggccccggcgauaaaauaaccaucugcaacggauccaccaucgucgaccaacgccucggcuccgaacucggcugcuacacaaucaaucgcguaaaauccuucaaacucugcgaaaacagcgccacgggcaaauccugcgaaaucgacuccguccccgucaaaugccgccaaggauacugccuccgcauaacccaagaaggccgcggccauguaaaacucucccgcggcucugaagucguccucgacgccugcgacaccucaugcgaaaucaugaucccaaaaggcaccggagacauccucgucgacugcagcggaggccaacaacacuuccucaaagacaaccuaaucgaccucggcugccccaaaaucccccuccuaggcaaaauggccaucuacaucugccggauguccaaccaccccaaaaccaccauggcauuccuguucugguuuuccuucggcuacgucauaaccugcauccuaugcaaagcaaucuucuaccuccucaucaucaucggcacccuagggaaaagauucaaacaauaccgcgaacucaaaccacaaaccugcaccaucugcgaaaccacccccguaaacgccaucgacgccgaaaugcacgaccucaacugcucauacaacaucugcccauacugcgccucccgacucaccuccgacggccucgcccgccacgucacccaaugccccaaacgcaaagaaaaagucgaagaaaccgaacuauaccuaaaccucgaacgcaucccuugggucguccgcaaacuccuacaagucucagaauccaccggugucgcccucaaacgaucuuccuggcucaucguccuccucguccuauucaccgucucccucuccccaguucaauccgcaccaaucggc

SEQ ID NO: 15640 - RNA, 972 nt, Artificial Sequence
  derived and/or modified CDS sequence (opt11) from CCHFV(Haskovo-V46/13)__KR092379.1__Gn
ucagaagaacuuggcgacgacugcaucagccgcacccaacuccuacgcaccgaaaccgccgaaauccacgacgacaacuacggcggcccaggcgacaaaaucaccauaugcaacggcuccaccaucgucgaccaacgacucgguuccgaacuaggaugcuacacgaucaaccgcggaaaaucguucaaacucugcgaaaacuccgccacagguaaaaccugcgaaaucgacuccacccccgucaaaugccgacaaggauucugccuaaaaauaacccaagaaggccguggccacgucaaacucucccgcggcagcgaagucguccucgacgccugcgacuccucaugcgaagucaugaucccuaaaggcaccggcgacauacucguagacugcuccggcggccaacaacacuuccucaaagacaaccuaaucgaccuaggcugcccccacaucccacuccucggaaaaauggccaucuacaucugccgcaugucaaaccacccccgcaccaccauggccuuccucuucugguucuccuucggauacgucauuaccugcaucuucugcaaagcacucuucuauucacucaucaucaucggcacacucggcaagaaaaucaaacaauaccgcgaacucaaaccccaaacaugcaccaucugcgaaaccacccccguaaacgccauagacgccgaaaugcacgaccucaacugcuccuacaacauuugccccuacugcgccucccgccucaccuccgacggccucgcccgccacgucacccaaugccccaaacgcaaggaaaaagucgaagaaaccgaacucuaccuaaaccucgaacgcaucccauggaucguccgcaaacuccuccaagucuccgaauccacaggugucgcccucaaacgauccuccuggcuaaucguccuacucguccuccucccagucucacucucccccguccaauccgccccagucggc

SEQ ID NO: 15641 - RNA, 972 nt, Artificial Sequence
  derived and/or modified CDS sequence (opt11) from CCHFV(24-R-2012)__KR814856.1__Gn
uccgaagaaccaggcgacgacugcaucucaagaacccaacuccuacgaaccgaaaccgccgaaauccacgacgacaacuacggcggacccggcgacaaaauaaccaucugcaacgguucaacaaucguagaccaacgccucggcagcgaacucggcugcuacaccaucaaccgcguaaaauccuucaaacuaugcgagaauuccgccacaggcaaaaccugcgaaaucgacaguaccccagucaaaugccgccagggauucugccucaaaauaacccaagaaggccgcggacacgucaaacucucccgcggcagcgaagucguccuagacgcuugcgacaccuccugcgaagucaugauccccaaaggcaccggcgacauccucgucgacugcuccggcggacaacaacauuuccucaaagacaaccucaucgaccucggaugcccccacaucccccuacuaggcaaaauggccauauacaucugccgaauguccaaucacccccgcaccaccauggcauuccucuucugguuuuccuucggcuacguaaucacaugcaucuucugcaaagcccucuucuacucccucaucaucauaggcacacucggcaaaaaaauaaaacaauaccgcgaacuaaaaccccaaaccugcaccaucugcgaaaccgccccagucaacgccauagacgccgaaaugcacgaccucaacugcuccuacaacaucugccccuacugcgccuccagacucacauccgacggacucgcccgccacgucccccaaugcccaaaacgcaaagaaaaagucgaagaaaccgagcucuaccuaaaccucgaacgcauccccuggauaguacgcaaacuacuacaagucagcgaauccaccggcgucgcccucaaacgcucauccuggcucaucguccuccuaguccuccucacagucucccucuccccaguccaauccgcccccgucgga

SEQ ID NO: 15642 - RNA, 972 nt, Artificial Sequence
  derived and/or modified CDS sequence (opt11) from CCHFV(36-ST-2014)__KR814857.1__Gn
agcgaagaacccggcgacgacugcaucucccgcacacaacuacuaaaaacagaaaccgccgaaauccaugacgacaacuacggaggccccggcgacaaaaucaccaucuguaacggcuccaccaucgucgaccaacgccucggcuccgaacucggcuguuacaccaucaaccgcgucaaaucauucaaacucugcgaaaacuccgccacagguaaaacaugcgaaaucgacuccacccccgucaaaugccgacaaggcuucugccucaaaaucacccaggaaggccgaggccacgucaaacucagccgcggaucugaagucguccucgacgccugcgacuccucuugcgaaaucaugauacccaaaggaaccggcgacauccuaguagacugcuccggaggccaacaacacuuccucaaagacaaccuaaucgaccuaggaugcccccacauaccacuccucggcaaaauggccaucuacaucugccgaauguccaaccacccccgcaccaccauggccuuccucuucugguucuccuucggcuacguuauaaccugcaucuucugcaaagcccucuucuacagccuaaucaucaucggcacccuaggcaagaaaaucaaacaauaccgcgaacuuaaaccccaaaccugcaccaucugcgaaaccgccccgguaaacgccaucgacgccgaaaugcaugaccucaacugcuccuacaacauaugccccuacugcgccucccgccucaccucagacggccucgcacgccacguaacccaaugcccaaaacgcaaagaaaaagucgaagaaaccgaacucuaccucaaccuugaacgcauccccuggaucguccgcaaacuccuccaagucucagaauccacaggcgucgcccuaaaacgcucaucuuggcuaaucguccuccucguucuccucaccgucagccuaucccccguccaauccgcacccguaggc

SEQ ID NO: 15643 - RNA, 972 nt, Artificial Sequence
  derived and/or modified CDS sequence (opt11) from CCHFV(44-ST-2010)__KR814859.1__Gn
ucagaagaaccaggagacgacugcauaucccgcacccaacuccuaaaaaccgaaaccgcugaaauccacgaugacaacuacggaggccccggcgacaaaaucaccaucugcaacggcucaaccauugucgaccaacgacucggcucagaacuuggcugcuacaccauaaaccgcgucaaauccuucaaacucugcgaaaacuccgccaccggcaaaaccugcgaaaucgacagcacacccgucaaaugccgccagggcuucugccucaaaaucacccaagaaggccgcggccacguaaaacucucccgcggcuccgaagucguccucgacgcuugcgacagcucaugcgaaaucaugauacccaaaggcaccggcgacauccucgucgacugcuccggcggacaacaacacuuccuaaaagacaaucucaucgaccucggcugcccacacaucccccuccucggaaaaauggccauauacaucugccgaauguccaaccacccccgcaccacaauggcauuucuacucugguucuccuucggcuacgucauaacaugcaucuucugcaaagcacucuuuuacucccucaucaucaucggcacccuaggaaaaaaaaucaaacaauaccgcgaacuaaaaccacaaaccugcaccauaugcgaaaccgcccccgucaacgcaauagacgcagaaaugcacgaccucaacuguuccuacaacauaugccccuacugcgcaucccgccucacuucagacggccucgcccgccacgucacccaaugccccaaacgcaaagaaaaaguagaagaaaccgaacucuaccucaaccuagaacgcauccccuggauagucagaaaacugcuccaagucucagaauccaccggcgucgcccucaaacgcucauccuggcucauuguccuccucguacuccuaaccgucagccuauccccaguccaauccgcacccguaggc

SEQ ID NO: 15644 - RNA, 972 nt, Artificial Sequence
  derived and/or modified CDS sequence (opt11) from CCHFV(47-ST-2013)__KR814861.1__Gn
uccgaagaacccggagacgacugcauaucacgcacccaacuucucaaaaccgaaacagccgaaauccacgacgacaacuacggcggccccggcgacaaaauaacaaucugcaacggauccaccaucgucgaccaacgccucggcuccgaacucggcugcuacaccaucaaccgcgucaaauccuucaaacucugcaaaaacagcgccaccggcaaaaccugcgaaaucgacagcacaccagucaaaugccgccaaggcuucugccucaaaaucacccaagaaggccgcggccacguaaaacucagccgcggauccgaagucguccuagacgccugcgacuccucaugcgaaaucaugauacccaaaggcaccggcgacauccucguugacugcuccggcggccaacaacacuuccuaaaagacaaccucaucgaccugggaugcccacauaucccccuccuuggcaaaauggccaucuacaucugccgaauguccaaccacccacgcaccaccauggccuuccucuucugguucucauucggcuacgucauaaccugcaucuucuguaaagcccuguucuacucacucauaaucaucggcacacuaggaaagaaaaucaaacaauaccgcgaacuaaaaccccaaaccugcaccaucugcgaaaccgcccccgucaacgccaucgacgccgaaaugcacgaccucaacugcuccuacaauauaugccccuacugcgcaucccgccucaccuccgacggacucgcccgccacguaacacaaugccccaaacgcaaagaaaaagucgaagaaaccgaacucuaccuuaaccuagaacgcauccccuggaucguccgcaaacuucuccaaguauccgaauccaccggagucgcacuuaaacgcuccuccuggcucaucguccuccuaguccuacuaaccguaucccucucccccguccaauccgcccccgucggc

SEQ ID NO: 15645 - RNA, 972 nt, Artificial Sequence
  derived and/or modified CDS sequence (opt11) from CCHFV(52-R-2014)__KR814862.1__Gn
ucagaagaacccggcgacgacuguaucucucgaacccaacuccuacgcaccgaaaccgccgaaauccacgacgacaacuacggaggacccggcgacaaaauaacaaucugcaacggcucaaccaucguagaucaacgccucggcagcgaacucggcugcuacaccaucaaccgcgucaaauccuucaaacucugcgaaaacuccgccaccggcaaaaccugcgaaaucgacuccacacccguaaaaugccgccaaggauucugccucaaaaucacccaagaaggccgaggacacguaaaacucucacgcggcucagaagucguccucgacgccugcgacaccucaugcgaagucaugauccccaaaggcaccggcgacauccucgucgacugcuccggcggccaacaacacuuccucaaagacaaccucaucgaccucgggugcccucacgucccccuacucggcaaaauggccaucuacaucugccgaauguccaaccacccacgcaccaccauggcauuccucuucugguucucauucggauacgucauaaccugcaucuucugcaaagcacuauucuacagccucaucaucaucggcacccucggcaagaaaaucaaacaauaccgcgaacucaaaccccaaaccugcaccaucugugaaaccgcacccgucaacgccaucgacgcagaaaugcacgaccucaacugcucauacaacaucugcccauacugcgccucccgccuaaccucagacggacucgcccgacacgucccacaaugccccaaacgcaaagaaaaagucgaagaaaccgaacucuaccugaaccucgaacggauccccuggauaguccguaaacuccuccaagucucagaauccacaggagucgcacuaaaacgcuccucauggcucauaguccuacucguccuccucaccguaucucucuccccaguccaaucagcacccgucgga

SEQ ID NO: 15646 - RNA, 972 nt, Artificial Sequence
  derived and/or modified CDS sequence (opt11) from CCHFV(75-R-2012)__KR814863.1__Gn
uccgaggaacccggugacgacugcaucagccgcacccaacuccuccgaaccgaaaccgccgaaauacaugacgacaacuacggcggacccggagacaagaucaccauaugcaacggauccaccaucguagaccaacgccucggcuccgaacucggcugcuacaccaucaaccgagucaagagcuucaaacucugcgaaaauuccgccacaggcaaaaccugcgaaaucgacagcgcuccagucaaaugccgccaaggcuucugccucaaaaucacccaagaaggacgcggccacguaaaacucucucgcggcagcgaggucguccuagacgccugugacucauccugcgaggucaugaucccaaaaggcaccggcgacauccucgucgacugcuccggcggccaacaacacuuccuaaaagacaaccucaucgaccucggcugcccccacaucccacuacucggcaaaauggccaucuacaucugccgcaugucaaaccacccccgcaccaccauggccuuccuauucugguucucuuucggcuacgucauaaccugcaucuucugcaaagcacuauucuacucucucaucaucaucggcacccuaggaaagaaaaucaaacaauaccgcgaacuaaaaccccaaaccugcaccaucugcgaaaccgcccccguaaacgccaucgacgccgagaugcacgaccucaacugcucauacaacaucugccccuacugcgccucccgccucaccuccgauggccuugcccgacacgucccccaaugccccaaacgcaaagaaaaagucgaagaaacagaacucuaccuaaaccuagaacgcaucccauggaucguccgaaaacuccuccaagucuccgaauccacaggaguagcccucaaacgcucauccuggcuaaucguccuucucguacuacucaccgugucacucucacccguacaauccgcacccgucggc

SEQ ID NO: 15647 - RNA, 972 nt, Artificial Sequence
  derived and/or modified CDS sequence (opt11) from CCHFV(75-ST-2010)__KR814864.1__Gn
ucagaagaauccggcgacgacugcauaucacgcacccaacuccugcgcaccgaaaccgccgaaauccacgacgacaacuacggaggccccggcgacaaaaucacgaucugcaacggcuccaccauagucgaccaacgccucggauccgaacucggcugcuacaccaucaaccgcgucaaauccuucaaacuuugcgaaaacuccgccacaggcaaaaccugcgagaucgacagcacacccgucaaaugccgccaaggcuucugccuaaaaaucacacaagaaggccgcggccacgucaaacucucccgcggcuccgaaguaguccuagacgcaugcgacuccuccugcgaagucaugauccccaaaggcaccggcgacauacucgucgacugcagcggaggccagcaacacuuccuaaaagacaaccuaaucgaccucggcugcccccacaucccacuccuaggaaaaauggccaucuacaucugccgaauguccaaccacccccgaaccaccauggcauuccuauucugguucuccuucggcuacgucauaacuugccucuucugcaaagcccucuucuacucccuaaucaucaucggcacccucggaaagaaaaucaaacaauaccgcgagcuccgaccacagaccugcaccauaugcgaaacagcaccagucaacgcaaucgacgccgaaaugcacgaccuaaacugcuccuacaacauaugccccuacugcgccucacgccuuacauccgacggacucgcccgccacgucccacaaugccccaaacgaaaagaaaaagucgaagagacagaacuauaccucaaccucgaacgcaucccauggaucguccgcaaacuucuccaagucucagaaucaaccggcgucgcccuaaagcgaucguccuggcucaucguccuacucguccuccuuaccguuagccucuccccaguccaauccgcgcccgucggc

SEQ ID NO: 15648 - RNA, 972 nt, Artificial Sequence
  derived and/or modified CDS sequence (opt11) from CCHFV(3820-ST-2007)__KR814868.1__Gn
ucugaagaacccggcgacgacugcaucucccgcacccaacuccucaaaacugaaacagccgaaauccacgacgacaacuacgguuccccuggcgacaaaauaacaaucugcaacggauccaccauagucgaccaacgccuaggcuccgaacucggcugcuacaccaucaaccgcguaaaauccuucaaacucugcgaaaauucagccaccggcaaaaccugcgaaaucgacuccacacccgucaaaugucgccaaggcuucugccucaaaaucacccaagaaggccgcggccacgucaaacucagccgcggcuccgaagucguccucgaugccugcgacuccuccugcgaaaucaugaucccaaaaggaaccggagacauccucgucgacugcuccggcggccaacaacauuuccucaaagacaaccuaaucgaccucggcugcccacacaucccccuccucggaaaaauggccaucuacauaugccgcauguccaaccacccccgcaccacaauggccuuccuauucugguucuccuucggcuacgucauaaccugcaucuucugcaaagcccucuucuauucucucaucaucaucggaacccucggcaagaaaauaaaacaauaccgugaacuaaaaccccaaaccugcacaaucugcgagaccgcccccguaaacgccaucgacgccgaaaugcacgaccugaacugcucauacaacaucugccccuacugugccucccgccuaaccuccgacggccucgcccgccacgucacccaaugccccaaacgcaaagaaaaagucgaagaaaccgaacucuaccucaaccucgaacgcauacccuggaucguccguaaacuacuccaagucucugaauccaccggugucgcccucaaacgcuccuccuggcucaucguccuacucguccuccucgccgucucccucucacccguccaauccgcccccgucggc

SEQ ID NO: 15649 - RNA, 972 nt, Artificial Sequence
  derived and/or modified CDS sequence (opt11) from CCHFV(4701-ST-2009)__KR814872.1__Gn
agcgaagaacccggcgacgacugcaucagccgaacccaacuacuuaaaaccgaaaccgccgaaauccacgacgacaacuacggcggccccggagacaaaauaaccaucugcaacggauccaccgucguagaccaacgucucggauccgaacucggaugcuacaccaucaaccgaguaaaauccuucaaacucugcgaaaacuccgcaaccggaaaaaccugcgaaaucgacuccaccccagucaaaugccgccaaggcuucugccucaaaauaacccaggaaggacgcggccacgucaaacucucacggggcuccgaaguaguccuagacgcaugcgacagcuccugcgaaauuaugauccccaaaggcaccggcgacauccuaguagacugcuccggcggccagcaacacuuccucaaagacaaccuaaucgaccucggcugcccacacaucccacuccuuggcaaaauggccaucuacaucugccgcauguccaaccacccccggaccacaauggccuuccucuucugguucuccuucggauacgucauaaccugcaucuucugcaaggcccucuucuacucccucaucaucaucggcacccucggcaaaaagaucaaacaauaccgcgaacuaaagccccagaccugcaccaucugcgaaacagcccccgucaacgccaucgacgccgaaaugcacgaccuaaacugcagcuacaacaucugccccuacugcgcgucccgccucaccuccgacggacucgcacgccauguaacccaaugccccaaacgcaaagaaaaagucgaagaaaccgaacuauaccuaaaccuagaacgcauccccuggaucgugcgcaaacuacuccaagucuccgaauccaccggcgucgcccucaaacgcuccuccuggcuaauaguccuccucguacuccucaccgucucacucucccccguccaauccgcccccgucggc

SEQ ID NO: 15650 - RNA, 972 nt, Artificial Sequence
  derived and/or modified CDS sequence (opt11) from CCHFV(5170-R-2011)__KR814873.1__Gn
uccgaagaaccaggcgacgacugcaucagccgcacccaacuccucaaaacagaaaccgccgaaauccacgacgacaacuacggcggacccggcgacaaaaucaccauaugcaacggcuccaccaucgucgaccaacgccucggcucagaacucggcugcuacaccaucaaccgcgucaaauccuucaaacucugcgaaaacucagccaccggcaaaaccugcgaaaucgacuccacacccgucaaaugccgccagggcuucugccuaaaaaucacacaggaaggccgcggccacguaaaacucagcagaggcagcgaagugguccucgaugucugcgacagcuccugcgaaaucaugauacccaaaggcaccggcgacauccucgucgacugcuccggcggccaacaacacuuccuaaaagacaaccucaucgaccuaggcugcccccacaucccccuacuaggcaaaauggccaucuacaucugccgcaugucgaaccacccccgcaccacaauggccuuccucuucugguucucauucggcuacgucaucacaugcaucuucugcaaagcacucuucuacucccuuaucaucaucggaacccucggaaaaaaaauaaaacaauaccgagaacucaaaccccaaaccugcaccauuugcgaaaccgcucccgucaacgccauagacgcagaaaugcaugaccucaacugcuccuacaacaucugccccuacugcgcaucacgccuaacauccgaaggcuuagcccgacaugucacccaaugccccaaacgcaaagaaaaagucgaagaaaccgaacuauaccuaaaccucgaacgcauacccuggauaguccgaaaacuccuccaaguauccgaauccacaggagucgcccuaaaacgcuccuccuggcuaaucguccuccucguccuccuaaccguuucccucagccccguccaaagcgcccccguaggu

SEQ ID NO: 15651 - RNA, 972 nt, Artificial Sequence
  derived and/or modified CDS sequence (opt11) from CCHFV(200406546-Turkey)__KR864902.1__Gn
uccgaagaaccuggagacgacugcaucucccgcacccaacuccucagaaccgaaaccgccgaaauccaugacgauaacuacggcggccccggcgauaaaaucaccaucugcaacggcucaaccaucgucgaccaacgccuaggaucagaacuuggaugcuacaccaucaaccgcgucaaaucuuucaaacucugcgaaaacucagcuaccggaaaaaccugcgaaauagacagcacccccgucaaaugccgucaaggcuucugccucaaaaucacacaagaaggccgcggccacgucaaacucagccgaggcuccgaagucguccucgacguaugcgacucuuccugcgaagucaugauccccaaaggcacaggcgacauccuagucgacugcucaggcggccaacaacacuuccucaaagauaaccucaucgaccucggaugcccccauguaccacuucucggccgcauggcaaucuauauaugccgcauguccaaccacccccgaaccaccauggccuuccucuucugguucuccuucggcuacgucauuacaugcaucuucugcaaagcacuauucuacucacuaauaaucaucggaacccucggcaaaaaauucaaacaauaccgcgaacucaaaccccaaaccuguacaaucugcgaaaccgcccccgugaacgccaucgacgcagaaaugcacgaccuaaacugcuccuacaacaucugcccauacugcgccucccgccucaccuccgacggccucgcccgacacgucccccaaugccccaaacgcaaagaaaaagucgaagaaacagaacucuaccucaaccuagaacgcauacccuggaucguccgcaaacuccuccaagucucagaaucaaccggcgucgcacuuaaacgcuccuccuggcucaucguccuucucguccuccucaccgucucacuaucccccguccaauccgcccccgucggc

SEQ ID NO: 15652 - RNA, 972 nt, Artificial Sequence
  derived and/or modified CDS sequence (opt11) from CCHFV(1-CR/HU-2015)__KU161584.1__Gn
ucugaagaaccaggcgacgacugcaucagcagaacucaacuccuccgaaccgaaaccgccgaaauccacgacgacaacuacggcggccccggcgacaaaaucaccaucugcaacggauccacaaucgucgaccaaagacucggcuccgaacucggcugcuacaccauaaaccgcgucaaaucauucaaacucugcgaaaacuccgcaaccggcaaaaccugcgaaaucgacuccacccccgucaaaugccgccaaggcuucugucuaaaaauaacccaagaaggccgcggccacgucaaacucucucgaggcuccgaagucguccucgacgccugcgacagcuccugcgaagucaugauccccaaaggcaccggcgacauccuagucgacugcuccggaggccaacaacacuuccuaaaagacaaccucaucgaccucggaugcccccacaucccccuccugggcaaaauggccaucuacaucugccgcauguccaaccacccccgaacaaccauggccuuccuguucugguucucuuucggcuacgucauaaccugcaucuucugcaaagcacucuucuacucccucaucauaaucggcacacucggcaaaaagauaaaacaauaccgcgaacucaaaccccaaaccugcaccaucugcgaaaccgcacccguaaacgccaucgacgccgaaaugcacgaccuuaacugcuccuacaacaucugcccauacugcgccucccgacucacaucagacggccuagcccgccacgucacacaaugcccaaaacgcaaagaaaaagucgaagaaaccgaacucuaccucaaccuagaacggaucccauggauaguccgaaaacuacuacaagucuccgaaucuaccggagucgcccucaaacgcuccuccuggcucaucguccuccucguccuccuaaccguaucucuaagcccaguccaaagcgcccccgucggc

SEQ ID NO: 15653 - RNA, 972 nt, Artificial Sequence
  derived and/or modified CDS sequence (opt11) from CCHFV(Gaib)__KX013445.1__Gn
uccgaagaaucuuccgacgacugcauaagccgcacccaacuccuccgcacugaaacagccgaaauccacaacgacaacuacggcggccccggcgacaaaaucaccaucugcaacggcuccaccaucgucgaccagcgccucggcuccgaacuaggcugcuacaccaucaaccgcgucaaaucuuucaaacuuugcgaaaauagcgccaccggaaaaucaugugaaauagacuccauccccgucaaaugucgccaaggauucugccuaaaaaucacacaagaaggccgcggccacguuaaacucucccgcggauccgaaguaguccucgacgccugcgacuccucaugcgaaaucaugaucccaaaaggcaccggcgacauccucgucgacugcuccggcggccaacaacacuuccuaaaagacaaccucaucgaccucggcugccccaacauaccccuccuaggcaaaauggccaucuacaucugccgaauguccaaccaccccaaaacaaccauggccuuccuauucugguucuccuucggcuacgucaucacaugcauauucugcaaagccaucuucuaccuccucauaaucgucggcacucucggcaaaaaauucaaacaauaccgcgaacuaaaaccccaaaccugcacaaucugcgaaaccacccccgucaacgccaucgacgccgaaaugcacgaccucaacugcuccuacaacaucugccccuacugcgccuccagacucacauccgacggacuagcacggcacgucguccacugccccaaacgcaaagaaaaaaucgaagaaaccgaacuauaccucaaccucgaaagagucccaugggucguccgaaaacuccuccaagucuccgaaucaaccggcguagcccucaaacgauccucauggcucaucguccuucucguccuccucaccguaucccuaagccccguacaaucagcaccaauaggc

SEQ ID NO: 15654 - RNA, 972 nt, Artificial Sequence
  derived and/or modified CDS sequence (opt11) from CCHFV(Hodzha)__KX013448.1__Gn
uccgaggaauccggcgacgacugcaucucacgcacccaacuccuacgaaccgaaaccgccgaaauacacggcgacgacuacggaggacccggcgacaaaaucaccauaugcaacggcagcacgauaguugaccaacgccuaggcuccgaacucggcugcuacaccauaaaccgcgucaaauccuucaaacuaugcgaaaacuccgccaccggcaaaagcugcgaaaucgacucaacccccguaaaaugccgccaaggcuacugccuaaaaaucacccaagaaggacgcggccacgucaaacugagccgcggcuccgaagucguccuagacgccugcgacagcuccugcgaagucaugaucccaaaaggcacaggcgacauccucguagacugcucaggcggccaacaacacuuccuuaaagacaaccucauagaccuaggcugccccagaaucccccuccucggcaaaauggccaucuacaucugccgaaugucgaaccaccccgaaacaaccauggccuuccuauucugguucuccuucggcuacguaauaaccugcauccucugcaaagcuaucuuuuaccuccucaucaucgucggcacccucggaaaacgcuucaaacaauaccgcgaacucaaaccccaaaccugcaccauaugcgaaacaacacccgccaacgccaucgacgcagaaaugcacgaccucaacugcagcuacaacaucugcccauacugcgcaucccgccucaccucagacggacuagcccgccacguaacccaaugccccaaacgcaaagaaaaagucgaagaaaccgaacucuaccuaaaccucgaacgaauccccuggaucguccgcaaacuacuccaagucucagaaucaaccggcgucgcacucaaacgauccuccuggcucaucguacuccuaguacucuucgccgucagccucucccccguccaauccgcccccaucggc

SEQ ID NO: 15655 - RNA, 972 nt, Artificial Sequence
  derived and/or modified CDS sequence (opt11) from CCHFV(IbAn7620)__KX013451.1__Gn
uccgaagaacccucagacgacugcauaucccgcacccaacuccuccgcacagaaaccgcugaaauccacggcgacaacuacggcggcccaggagacaaaaucaccaucugcaacggaucaacuaucgucgaccaacgccuaggcuccgaacucggcugcuacaccaucaaccgcguuaaauccuucaaacucugcgaaaacuccgcaaccggcaaaaacugcgaaaucgacagcguccccgucaaaugccgccaagguuacugccuccgcaucacccaagaaggccgaggacacguuaaacuauccagaggcucagaaaucguccucgacgcaugcgacacaucgugcgaaaucaugauccccaaaggcaccggagacauacucgucgacugcuccggcggacaacaacacuuccucaaagacaaccucaucgaccucggcugccccaaaaucccccuacuuggaaaaauggccauuuacaucugccgcauguccaaccaccccaaaacaacaauggccuuccuauucugguucuccuucggcuacgucauaaccugcauacuaugcaaggcaaucuucuaccuacuaaucaucaucggcacccuaggcaaacgccucaaacaauaccgcgaacucaaaccacaaaccugcaccaucugcgaaacaaccccuguuaacgcuaucgacgccgaaaugcacgaccucaacugcuccuacaacaucugcccauacugcgccucacgccuaaccuccgacggccuagcccgccacgucauccaaugccccaaacgcaaagagaaaguagaagaaaccgaacucuaccucaaccucgaacgaaucccaugggucguccgcaaacuccuccaagucucagaauccaccgguguagcccuaaaacgaucauccuggcucaucguccuccuaguccucuucaccgucucccuaagucccguacaaucagcccccaucgga

SEQ ID NO: 15656 - RNA, 972 nt, Artificial Sequence
  derived and/or modified CDS sequence (opt11) from CCHFV(K128_76)__KX013454.1__Gn
uccgacgaauccggcgacgacugcaucuccagaacccaacuccuacgcaccgaaaccgccgaaauccacggcgacaacuacggcggccccggagacaaaaucaccauaugcaacggcuccaccaucguagaccaacgccuuggauccgaacucggcugcuacacaauaaaccgggucaaauccuucaaauuaugcgaaaauuccgcaaccgguaaaucaugcgaaauagacuccauccccguuaaaugccgccaaggcuacugccuaaaaauaacccaggaaggccgcgggcacgucaaacuaagccgaggcuccgaagucguccucgacgccugcgacagcagcugcgaagucaugaucccaaaaggcaccggagacauccucgucgacugcuccggcggccaacaacacuuccuaaaggacaaccuaaucgaccuagguugccccaaaauaccccuccucggcaaaauggccaucuacaucugccgcaugucgaaccacccaaaaaccaccauggccuuccucuucugguucuccuucggcuacgucauaaccugcaucguaugcaaagcaaucuucuaccuccucaucaucgucggcacccucggcaaacgcuucaaacaguaccgagaacucaaaccacaaaccugcaccaucugcgaaacuacccccaccaacgccaucgacgcagaaaugcacgaccucaauugcuccuacaacaucugcccuuacugcgccucacgccuaacauccgacggccuagcccgccacgucacacacugccccaaacgcaaggaaaaagucgaagaaaccgagcuauaccuaaaccucgaacguaucccauggguaguccgcaaacuccuccaagucuccgaauccaccggcgucgcccucaaacgcucauccuggcuaaucguccuccuaguccucuucgccgucucacucucccccguccaauccgcccccaucucc

SEQ ID NO: 15657 - RNA, 972 nt, Artificial Sequence
  derived and/or modified CDS sequence (opt11) from CCHFV(K168_40)__KX013457.1__Gn
uccgacgaauccggugacgacugcaucucaagaacccaacuacuacgcaccgaaacagccgaaauccacggagacaacuacggaggacccggcgacaaaaucacuauaugcaacggcuccaccaucgucgaccaacgacuaggcuccgaacucggcugcuacaccaucaaccgcgucaaauccuucaaacucugcgaaaacagcgccaccggcaaauccugcgaagucgacagcauccccgucaaaugccgccaaggcuacugccucaaaaucacccaagaaggaagaggacacgucaaacucucccgcggcuccgaagucguccucgacgccugcgacagcucaugcgaagucaugauccccaaaggcaccggcgacauccucgucgacugcuccgggggccaacaacacuuccucaaagacaaccucaucgaccucggaugcccaaaaaucccacuacuaggcaagauggccaucuacaucugccgcaugucaaaccacccaaaaaccaccauggccuuccuauucugguucuccuucggcuacgucaucacaugcaucgucugcaaagccaucuucuaccuccuaaucaucgucggcacccucggcaaacguuucaaacaauaccgcgaacugaaaccccaaaccugcaccauaugcgaaacaacccccacaaacgccauagacgcagaaaugcacgaccucaacugcuccuacaacaucugccccuacugcgccuccagacuuaccucagacggucucgcccgacacgucacccacugccccaagcgcaaagaaaaagucgaagaaacugaacuauaccuuaaccuagaacgcaucccuugggucguccgcaaacuacuccaagucucagaauccaccggcgucgcccuaaaacgaucaagcuggcucauaguccuucuaguccuauucgccgucucccucucccccguccaaucagcccccauagga

SEQ ID NO: 15658 - RNA, 972 nt, Artificial Sequence
  derived and/or modified CDS sequence (opt11) from CCHFV(K168_125)__KX013460.1__Gn
agcgacgaaucuggcgacgacugcaucucccgcacccaacuccuccgaaccgaaaccgccgaaauccacggcgacaacuacggcggccccggggacaaaaucaccaucugcaacggcuccaccaucgucgaucaacgccuaggauccgaacucgguugcuacaccauaaaccgcguaaaauccuucaagcucugcgaaaacagcgccacuggcaaauccugcgaagucgacuccauaccugucaaaugccgccaaggcuacugccuaaaaaucacacaagaaggacgcggccacgucaaacucucccgcggcucagaagucguccuagaugccugcgacuccuccugcgaagucaugauccccaagggcaccggcgacauccucgucgacugcucaggcggccaacaacacuuccuaaaagacaaccuaaucgaccuaggaugccccaaaguaccacuacuaggaaaaauggccaucuacauaugccgaauguccaaccaucccaaaaccaccauggcauuccucuucugguucuccuucggcuacguaauaacaugcaucgucugcaaagccaucuucuaccuccucaucaucgucggcacccuaggcaaacguuucaaacaauaccgagaacucaaaccccaaaccugcacaaucugugaaaccaccccaaccaacgcaaucgacgcagaaaugcacgaccucaacugcuccuacaacaucugccccuacugcgccagccgccucacaucagacggccuagcccgacacguuacucacugcccaaaacgcaaagaaaaaguagaagaaacagaacucuaccucaaccuagaacgcauccccugggucguccgaaaacuacuccaagucuccgaauccaccggcgucgcacuuaaacgcuccuccuggcucaucguccuccucguccucuucgccgucucacuuuccccaguccaauccgcccccaucgga

SEQ ID NO: 15659 - RNA, 972 nt, Artificial Sequence
  derived and/or modified CDS sequence (opt11) from CCHFV(K229_194)__KX013463.1__Gn
uccgaagaacccggcgacgacugcaucuccagaacccaacuacuaaaaacggaaaccgccgaaauccacgacgacaacuacggaggccccggcgacaaaaucaccaucugcaacggauccacaauagucgaccaacgccuaggcucugaacucggaugcuacaccaucaaccgcguaaagucauucaaacucugcgaaaacuccgcgaccggcaaaaccugcgaaaucgacuccaccccugucaaaugccgacaaggcuucugucuaaaaaucacacaggaaggacgcggacacguaaaacucucccgaggauccgaaguaguccucgacgccugcgacucaagcugcgaaaucaugauccccaaaggcaccggcgacauccucgucgacugcuccggcggccaacaacacuuccucaaaggcaaucucauagaccucggaugcccccacauaccccuccucggcaaaauggccaucuacauaugccgcauguccaaccacccccgcacaacuauggccuuccucuucugguucucauucggcuacgucauaaccugcaucuucugcaaggcacuauucuacucccucauaaucaucggaacccucggcaagaaaaucaaacaauaccgagaacucaaaccccaaaccugcacaaucugcgaaaccgcucccgucaacgccaucgacgccgaaaugcacgaccuaaacugcagcuacaacaucugccccuacugcgccucccgccucaccuccgacggccucgcacgccacgucacccaaugccccaaaagaaaagaaaaagucgaagaaaccgaacucuaccucaaccuagaacgcauccccuggaucguccgcaaacuccuccaggucuccgaauccacaggcguagcgcucaaacgauccuccuggcucaucguccuacuuguacuccucaccgucucacucucccccguccagagcgcccccguaggc

SEQ ID NO: 15660 - RNA, 972 nt, Artificial Sequence
  derived and/or modified CDS sequence (opt11) from CCHFV(K315_14)__KX013469.1__Gn
ucagaagaaccaggcgacgacugcauauccagaacccaauuacucaaaaccgaaaccgccgaaauccaugacgacaacuacggcggccccggcgacaaaaucaccaucugcaacggcuccaccgucgucgaccaacgccucggcuccgaacuaggaugcuacaccaucaaccgcgucaaaucuuucaaacuaugcaaaaacuccgccaccggcaaaaccugcgagaucgacuccacccccguaaaaugccgccaaggcuucugccucaaaauaacccaagaaggccgcggacacgucaaacucucacgcggcucagaaguuguccucgacgucugcgacuccucaugcgaaaucaugaucccaaaaggcaccggcgacauccuagucgacugcuccggcggccaacaacacuuccucaaagacaaccucaucgaccucggcugcccccacaucccccuccucggcaaaauggcaauauacauaugccgcauguccaaccaccccagaacaacaauggccuuccuauucugguucuccuucggcuacgucauaaccugcaucuucugcaaagcucuauucuacucccucaucaucaucggaacccucggcaaaaaaaucaaacaguaccgcgaacuaaaaccccaaaccugcaccaucugcgaaaccgcccccgucaacgcuaucgacgccgaaaugcacgaccucaacugcagcuacaacaucugccccuacugugcaucccgccuaaccuccgaaggccucgcucgccacguaacacaaugccccaaacgaaaagaaaaagucgaagaaaccgaacucuaccugaaccucgaacgaaucccauggaucguccgaaaacuacuccaagucuccgaauccaccggagucgcccucaaacgcuccucauggcucaucguccuccucguccuccucaccgucucccucucccccguacaauccgcacccgucggc

SEQ ID NO: 15661 - RNA, 972 nt, Artificial Sequence
  derived and/or modified CDS sequence (opt11) from CCHFV(K323_27)__KX013472.1__Gn
uccgaagaacccggcgacgacugcaucucacgcacacaacuccucaaaacagaaaccgccgaaauccacgacgacaacuacggaggccccggcgacaaaaucaccaucugcaacggaucaacaauaguagaccaacgccucggcuccgaacucggaugcuacaccaucaaccgcgucaaauccuucaaacucugcgaaaacucagccaccggcaagacuugcgaaaucgacuccaccccugucaaaugccgacaaggcuucugccucaaaauaacccaagaaggcagaggccacguaaaacucucucgcgguuccgaagucguccucgacgcaugcgacucauccugcgaaauaaugaucccaaaaggcaccggcgacauccucgucgacugcucuggcggccaacaacacuuccucaaagacaaccucauugaccuuggcugcccacacaucccccuccucggcaaaauggccaucuacaucugccgcaugagcaaccacccccgcaccaccauggccuuccucuucugguucuccuucggcuacgucaucacaugcaucuucugcaaagcccucuucuaccuccuuaucauaaucggcacccucggcaagaaaaucaaacaauaccgcgaacucaaaccccaaacuugcacaaucugcgaaaccgccccagucaacgccaucgacgccgaaaugcacgaccucaacugcuccuacaacauaugcccauacugcgccucacgccucaccucggacggccucgcacgccaugucacccagugucccaaacgcaaagaaaaagucgaagaaaccgaacucuaccugaaccuagaacgaauccccuggaucguucgaaaacuccuacaaguauccgaauccacgggcgucgcacuaaaacgcuccuccuggcucaccguccuccucguccuccucaccgucucccuaucccccguccaauccgcccccgucggc

SEQ ID NO: 15662 - RNA, 972 nt, Artificial Sequence
  derived and/or modified CDS sequence (opt11) from CCHFV(K340_6)__KX013475.1__Gn
uccgaagaacccggcgacgacugcaucucccgaacccaacuacucaaaacagaaaccgccgaaauccacgacgacaacuacggaggaccaggcgacaaaauaacaaucugcaacggcagcaccaucgucgaccaacgacucggcucagaacucggcugcuacaccaucaaccgaguaaagagcuucaaacucugcgaaaacuccacaacaggcaaaaccugcgaaaucgacucuaccccagucaaaugccgccaaggauucugccucaaaaucacccaagaaggccgcggccacguaaagcucucacgcggauccgaagucguccucgacgcuugcgacuccuccugcgaaaucaugauccccaaagggaccggcgacauacucgucgacugcuccggcggacaacaacacuuccucaaagacaaccucaucgaccuaggcugcccacacaucccaccccucggcaaaauggccaucuacaucugccgcauguccaaccacccccgcaccaccauggccuuccucuucugguuuuccuuuggauacgucauuaccugcaucuucugcaaagcccucuucuacucauuaaucaucaucggaacccuaggcaagaaaaucaaacaguaccgagaacucaaaccccaaaccugcaccauaugcgaaaccgcccccgucaacgccauagacgcagaaaugcacgaccuuaacugcuccuacaacaucugcccuuacugcgccucccgacucaccuccgacggucucgcccgccacgucacccaaugccccaaacgcaaagaaaaagucgaagaaaccgaacucuaccucaaccucgaacgcauccccuggauaguccgcaaacuccuacaagucuccgaauccacaggcgucgcccucaaacgaucaucauggcucaucguccuccucguccugcucaccgucucccuaucccccguccaauccgcacccgucggc

SEQ ID NO: 15663 - RNA, 972 nt, Artificial Sequence
  derived and/or modified CDS sequence (opt11) from CCHFV(Mamon)__KX013478.1__Gn
ucggaagaacccggagaugacugcauaucccgaacacaacuccuccgcacagaaaccgccgaaauccacgacgauaacuauggcggccccggcgacaaaaucacaauaugcaacggaucaacaaucgucgaccaacgccucggcuccgaauuaggcugcuacaccauaaaccgcguaaaauccuucaaacucugcgaaaacuccgccaccggcaaaaccugcgaaaucgacucaaccccuguaaaaugccgccaaggcuucugccucaaaaucacacaagaaggccguggacacgucaaacuaucccgaggcuccgaagucgucuccgacgccugcgacuccucaugcgaagucaugauccccaaaggcacaggagacauccucgucgacugcucaggcggccaacaacacuuccucaaagacaaccucaucgaccucggcugcccacacaucccccuccucggcaaaauggccaucuacaucugccgaaugagcaaccacccccgcaccaccgucgccuuccuauucugguucuccuucggauacguaaucacaugcaucuucugcaaagcccucuucuacucccuaaucaucaucgggacccucggcaaaaaaaucaaacaauaccgcgaacucaaaccccaaaccugcaccaucugcgaaaccgcccccgucaacgccaucgacgccgaaaugcacgaccuaaacugcuccuacaacauuugcccauacugcgcaucccgccucaccuccgacggacucgcacgccacgucccccaaugccccaaacgaaaagaaaaagucgaagaaacagaacuuuaucuaaaccucgaacgaauccccuggaucguccgaaaacuccuacaaguauccgaauccacgggaguugcccucaaacgcucaagcuggcucaucguacuccucguccuccucaccgucucccucucacccguccaauccgcccccguaggc

SEQ ID NO: 15664 - RNA, 972 nt, Artificial Sequence
  derived and/or modified CDS sequence (opt11) from CCHFV(Nakiwogo)__KX013484.1__Gn
gcagaaggcgucucgaacgacugcgugagccggacccaacucauaaaaacggaagucgccgaaauccacgaagacuccuacggcggccccggagagaaaaucaccaucugcaacggcagcaccaucgucgaccaacgccucggcuccgaacucggcugcuacaccauaaaccgcgucaaaaccuacaaacuaugcgaaaacagcgcuaccgaaaaaggaugcgaaaucgacucaguacccguaaaaugcaaacaaggcuucugccucaaaguuacccaagaaggccgcggccacgucaaacuaucccgcggcaccgaaaucguccucgacgucugcgacaccucaugcgaacucaugaucccaaaaggaacaggcgacauccuagucgacugcuccggcggccaacaacacuuccuucaagacaaccucaucgaccucggcugccccaacgucccacuccucggaaaaauggccaucuacaucugccgcauguccaaccaccccaagaccaccauggcauuccucuucugguucucauucggcuacguaauaaccugcguagucugcaaaguccucuucuaccuccucauagucauaggaacccucggcaagaaacuaaaacaauaccgagagcucaaaccccaaaccugcaucguaugcgaauccauccccgucaacgucaucgacgccgagaugcacgaacugaacugcaauuacaacaucugccccuacugcgcaucccgccucaccuccgacggacucgucagacacgucacccaaugccccaaacgcaaagaaaaagucgaagaaaccgaacuauaccucaaccucgaacguauccccuggcuaguccgccgccuacuccaagucucagaaagcaccggcauggcccucaaacgcuccugcuggaugaccacacuccucauccuccucguagucucccucucccccguccaaucagcccccgucggc

SEQ ID NO: 15665 - RNA, 972 nt, Artificial Sequence
  derived and/or modified CDS sequence (opt11) from CCHFV(Saf)__KX013487.1__Gn
uccgaagaacccggagacgacugcaucucccgcacacaacuccuccgcaccgaaaccgccgaaauucacgacgacaacuacggcggccccggcgacaaaaucaccaucugcaacggcuccaccaucguagaccaacgccuaggcuccgaacucggcuguuacaccauaaaccgcgucaaauccuucaaacucugcgaaaacuccgcaaccggcaaaaccugcgaaaucgacucuacccccguaaagugccgccaaggcuucugccucaaaauaacccaagaaggccgcggccacguaaaacucucacggggcucagaagucguccucgaugccugcgacuccagcugcgaaguaaugauccccaaaggaaccggagacauccuagucgacugcucagggggccaacaacacuaccucaaagacaaccucaucgaccucggaugcccgcacaucccccuacucggaaaaauggccaucuacaucugccgcauguccaaccacccccgaaccaccauggccuuccuguucugguucuccuucggcuacgucauaaccugcaucuucugcaaagcccucuucuacucccuaaucaucaucggaacacucggaaagaaaaucaaacaauaccgcgaacucaaaccccaaaccugcacaaucugcgaaaccgcccccgucaaugccaucgacgccgaaaugcacgaccucaacugcucauacaacaucugcccuuacugcgccucacgccuaacaucagacggccucgcccgccacgucccccaaugcccaaaacgcaaagaaaaagucgaagaaaccgaacucuaccuaaaccucgaacgaauacccuggaucguacgaaaacuccuccaagucucagaauccaccggaguagcccucaaacguuccucauggcucaucguccuucucguacuccucaccgucucccuaucacccguccaauccgcccccgucggc

SEQ ID NO: 15666 - RNA, 972 nt, Artificial Sequence
  derived and/or modified CDS sequence (opt11) from CCHFV(Ast199)__KX056051.1__Gn
uccgaagaacccggcgacgacugcaucuccagaacccaacuccuaaaaacagaaacagccgaaauucacgacgacaacuacggcggccccggagacaaaaucaccauuugcaacggcuccaccaucgucgaccaacgauuaggcuccgaacucggcugcuacaccaucaaucgcgucaaauccuucaaacucugcgaaaacuccgccaccggcaaaaccugcgaaaucgacuccacccccguaaaaugccgccaaggcuucugccuaaaaaucacccaagaaggccgcggacacguaaaacucucccgcggcuccgaaguaguccucgacgccugcgacuccucaugcgaaaucaugauccccaaaggcaccggcgacauccucgucgacugcucaggcggccaacaacacuuccuaaaagacaaccuaauagaccucggcugcccccacaucccucuacucggcaaaauggcaaucuacaucugccgcaugucaaaccacccucgcaccacaauggccuuccuuuucugguucucauucggauacgucaucaccugcaucuucugcaaagcucuauucuacucccucaucaucaucgguacacucgguaaaaaaaucaaacaauaccgcgaacucaaaccccaaaccugcaccauaugcgagaccgccccagucaacgcaaucgacgccgaaaugcacgaccucaacugcagcuacaacauaugcccuuacugcgccucccgacuaacuuccgacggccucgcccgucacgucacccaaugccccaaacgaaaagaaaaaguagaagaaaccgagcucuaccucaaccucgaacgcauucccuggaucguacgcaaacuucuccaagucucagaauccacaggcguagcccucaaacgcuguagcuggcucaucguccuccucguccuccuuaccgucucucugucacccguacaaucagcccccgucgga

SEQ ID NO: 15667 - RNA, 972 nt, Artificial Sequence
  derived and/or modified CDS sequence (opt11) from CCHFV(Ast137)__KX056057.1__Gn
ucagaagaacccggcgacgacugcaucagccgcacccaacucuuaaaaaccgaaaccgccgaaauucacgacgacaacuacggaggcccaggagacaaaaucaccauauguaacggcuccaccaucgucgaccaacgccucggcuccgaacucggcugcuacacaaucaaccgcgucaaauccuucaaacucugcgaaaacuccgccaccggaaaaaccugcgaaaucgacagcacccccgucaaaugccgccaaggauucugccuaaaaauaacacaagaaggccgcggccacgucaaacucucccgcggcuccgaagucguccucgacgccugcgacuccuccugcgaaaucaugauaccaaaaggcaccggagacauacucgucgacugcuccggaggccaacaacacuuccucaaagacaaccucaucgaccucggcugcccccacauaccccuccuaggcaaaauggccauccacauuugccgaauguccaaccacccacgcaccacuauggccuuccucuucugguucuccuucggcuacgucauaaccugcaucuucugcaaagcacuauucuacucccucauaaucaucggcacccucggcaagaaaaucaaacaauaccgcgaacuaaaaccccaaaccugcaccaucugcgagaccgcacccgucaacgccaucgacgccgaaaugcacgaccucaacugcuccuacaacaucugccccuacugcgccucccgccucacauccgacggccucgcacgccacgucacacaaugccccaaacgcaaagaaaaagucgaagaaaccgaacuguaccucaaccucgaacgcauccccuggaucguccgcaaacuccugcaaguaucugaaucaaccggcgucgcccuaaaacgcuccagcuggcucaucguccuccucguacuccucaccgucucccucucaccuguucaauccgcacccgucggu

SEQ ID NO: 15668 - RNA, 972 nt, Artificial Sequence
  derived and/or modified CDS sequence (opt11) from CCHFV(Ast133)__KX056060.1__Gn
uccgaagaacccgacgacgacugcauaucacgaacucaacuccucaaaaccgaaacagccgaaauccacgacgacaacuacggcggccccggcgacaaaaucaccaucugcaacggcuccaccaucgucgaccaacgccucggcucagaacucggcugcuacaccaucaaccgcgucaaauccuucaaacuaugcgaaaacagcgccaccggcaaaaccugcgaaaucgacucaacccccgucaaaugccgucagggcuucugccucaaaaucacccaagaaggcagaggccacgucaaacuaagccgaggcuccgaagucguccucgacgcaugcgacuccucaugcgaaaucaugaucccuaaaggcacuggcgacauacuagucgacugcuccggaggccaacaacacuuccuaaaagacaaccuaaucgaccucggaugcccccacauaccccuacucggcaaaauggcuaucuacaucugccgcaugucaaaccacccccgcacaaccauggccuuccucuucugguucuccuucggauacgucauaaccugcauauucugcaaagcccuauucuaccuccuaauaaucauaggcacccucgguaaaaaaaucaaacaauacagagaacucaaaccccaaaccugcaccaucugcgaaacagcccccgucaacgccaucgacgccgaaaugcacgaccuuaacugcagcuacaacaucugcccauacugcgccucccgcuuaaccagcgacggccucgcacgacacgucacccaaugccccaaaagaaaagaaaaagucgaagaaaccgaacuguaccucaaccuagaacgaaucccauggaucguccgcaaacuacuccaagucucagaauccaccggcguagcccuuaaaaggagcucauggcucaucguccuccucguccuccuaaccgucucacucucacccguccaauccgccccagucgga

SEQ ID NO: 15669 - RNA, 972 nt, Artificial Sequence
  derived and/or modified CDS sequence (opt11) from CCHFV(SK/2015/human)__KX458183.1__Gn
uccgaagaaucaggcgacgacugcaucucccgaacccgccuccuucgaaccgaaacagccgaaauccacggagacuccuacggcggacccggcgacaaaaucacaaucugcaacggcuccaccauagucgaccaacgccuaggaagcgaaaugggcugcuacacaaucaaccgagucaagagcuucaaacuaugcgaaaauuccgccaccgguaaauccugcgagaucgacucgauccccguccgcugccgacaaggauacugccuuaaaauaacccaagaaggacgcggccacguaaaauuaagccgaggcuccgaagucguccuagacgcaugugacagcuccugcgaaguaaugaucccaaaaggcaccggcgacauccucguagacugcuccggcggccaacaacacuuccucaaagacaaccucaucgaccucggcugcccaaacauaccccuacuaggcaaaauggccaucuacauaugccgaaugucaaaccaccccaaaaccaccauggcauuccuuuucugguucuccuucgguuacgucauaaccugcauccucugcaaagccaucuucuaccuucuaaucaucguaggcacacucggaaaacgcuucaaacaauaccgcgaacucaagccacaaacaugcacgaucugcgaaaccacccccgcaaacgcaaucgacgccgaaaugcacgaccuaaacugcagcuacaccauuugcccauacugcgccucacgccucaccuccgacggccucgcccgccacgucacccaaugcccuaaacgcaaagaaaaagucgaagaaaccgaacucuaccucaaccuagaacgcauacccuggguuguccgcaaacuacuucaagucuccgaaucaaccggcgucgcccucaaacgauccucauggcucauuguccuccucguccucuucaccgucucccucucaccaguccaauccgccccuaucgga

SEQ ID NO: 15670 - RNA, 972 nt, Artificial Sequence
  derived and/or modified CDS sequence (opt11) from CCHFV(YL16070)__KY354081.1__Gn
gcagagggcggcucaucagacugcauaucccguacccaacucgucaaaaccgaagucgccgaaauccacgaagacuccuacggcggccccggcgagaaaaucaccaucugcaacgguagcacaaucgucgaccaacgccuaggcucagaacuuggcugcuacaccauaaaccgcgucaaauccuacaaacuaugcgaaaacuccgccuccggcaaaucaugcgaaauagacagcauucccguaaaaugcaaacaaggcuucugccuaaaaaucacccaagaaggccgaggccacguaaaacucucccgaggcaccgaaauagugcuagacgucugcgacuccagcugcgaacuaaugauaccaaaaggcacaggagacauccucguagacugcucaggaggacaacaacacuuccuccaaaacaaccucaucgaccucggcugccccaacguaccccuccucggcaaaauggccaucuacguaugcagaauguccaaccaccccaaaaccaccauggccuuccuguucugguucuccuuuggcuacgucauaaccugcaucgucugccgcguacucuucuaccuccuaaucgccaucggcaccgucgguaagaaacucaaacaauaccgcgaacuaaaaccccaaaccugcaucguaugcgaauccguuccaguaaaugcaauagacgcagaaaugcacgaacucaacugcucguacaacauaugcccauacugcgccucacgccucuccacagacggccucauccgccacgucacgcaaugcccaaaacgccgagaaaaagucgaagaaaccgaacucuuccuaaaccucgaacgcauaccauggcuaguacgcaaacuccuccaaguauccgaauccaccggcauggcccuaaaacgcuccugcuggaugaucacgcuacucauccuacuccucgucuccaugucccccguccaaucagccccagucggc

SEQ ID NO: 15671 - RNA, 972 nt, Artificial Sequence
  derived and/or modified CDS sequence (opt11) from CCHFV(UCCR4448)__KY484042.1__Gn
uccgaagaaaccuccgacgacugcaucucccgcacccaacuacuccguaccgaaaccgccgaaauccacggcgacaacuacggaggccccggcgacaaaaucaccauaugcaacggcuccaccaucgucgaccaacgacucggcuccgaacucggcugcuacaccaucaaccgaguaaaauccuucaaacucugcgaaaacuccgccaccggcaaauccugcgaaaucgacuccgucccagucaaaugccgccaaggcuacugccuccgcaucacccaagaaggccgcgggcacgucaaacucucccgcggcuccgaagucguccucgacgcaugcgacaccucaugcgaaauaaugauaccaaagggcaccggcgacauacucguugacugcucaggcggccaacaacacuuccucaaagacaaccucauugaccucggcugcccgaaaaucccucuccucggaaaaauggcuauauacaucugccgcauguccaaccaccccaaaacaacaauggccuuccuauucugguucuccuucggcuacguaauaaccugcauccucugcaaagcuaucuucuaccuccucauaaucauaggaacccucggaaaacgcuucaaacaauaccgagaacuaaaaccccaaacaugcacaauaugcgaaaccacccccguaaacgccaucgacgcagaaaugcacgaccuaaacugcucauacaacauaugccccuacugcgccucccgccucaccuccgacggccucgcccgacacgucacccaaugccccaaacgcaaagaaaaagucgaagaaaccgagcucuaccucaaccucgaaagaauccccugggucguccgcaaacuacugcaaguauccgaauccaccggcgucgcccucaaacgcuccucauggcuaauaguccuccucguccucuucaccaucucacucagccccguccaauccgcacccaucucc

SEQ ID NO: 15672 - RNA, 972 nt, Artificial Sequence
  derived and/or modified CDS sequence (opt11) from CCHFV(SPU 45/88)__KJ682809.1__Gn
uccgaagaaagcucugacgacugccucagccgaacacaacuccuccgcaccgaaaacaccgaaauccacuccgacaacuacggcggcccaggcgacaaaaucaccauaugcaacgguuccaccaucguagaccaacgacuaggcuccgaacucggcugcuacaccaucaaucgcguaaaauccuucaaacucugcgaaaacagcgccaccggcaaaagcugcgaaaucgacuccacccccguacgcugccgccaaggauucugccucaaaaucacacaagaaggccgcggccacgucaaacuaucccgcggcucagaagucguccucgacgcaugcgacuccuccugcgaaaucaugauucccaaaggcaccggcgacauacucgucgacugcuccggcggccaacaacacuuccuaaaagacaaccucguagaccucggaugccccaacaucccccuccucggcaaaauggccaucuacaucugccgaauguccaaccaccccaaaaccacaaugggauuccuauucugguuuucauucggauacgucauaaccugcauccucuguaaagucaucuucuaccuccuuaucgucgucggcacacucggcaagaaauucaaacaguaccgcgaacucaaaccccaaaccugcaccaucugcgaaaccacucccguaaacgcaauagacgccgagaugcacgaccucaacugcuccuacaacaucugccccuacugcgccucacgccucacauccgacggacucgcccgccacgucaugcaaugccccaaacgcaaagagaaaaucgaagaaaccgaacucuaccucaaccuagaacgcauccccuggaucguccgcaaacuccuccaaguuuccgaaucaaccggagucgcgcucaaacgcuccuccuggcucguaguccuccucguccuacuaaccgucucccuaucacccguccaauccgcucccaucggc

SEQ ID NO: 15673 - RNA, 1932 nt, Artificial Sequence
  derived and/or modified CDS sequence (opt11) from CCHFV(10200)__U39455.2__Gc
uuccucgacagcaccgccaaaggcaugaaaaaccuccucaacucaacaucccucgaaaccucauuaucuauagaagcccccuggggcgcaauaaacguccaauccaccuacaaacccacuguauccacggccaacaucgcccuauccuggucgagcguagaacauagagguaacaagauccugguauccggacgcucagagagcauaaugaaacuugaagaacgcaccggcaucuccugggaccuaggugucgaagacgccuccgaguccaaacuccucaccgucagcguaauggaccucucccaaauguacucccccgucuucgaguaccucuccggggacagacaagucgaagaauggccaaaagcaaccugcaccggagacugccccgaaagaugcggcugcaccucauccacaugccuccacaaggaauggccccacucccgaaacuggcgcuguaacccaaccuggugcuggggcgucggcaccggcugcacaugcugcggacuagacguaaaagaccucuucacagacuacauguucguaaaguggaaaguagaauacauaaaaacagaagccauaguaugcgucgaacugaccucacaagaacggcaaugcucccuuaucgaagcggggacaagauucaaccuuggccccguuacaaucacccucuccgaaccacgcaacauucaacaaaaacucccucccgagauaaucacucuccacccacgaauagaggaaggcuucuucgaccucaugcacguccaaaaaguacucucggccagcacggucuguaaacuccaaucuugcacccacgggguccccggcgaccuccaagucuaccacauaggcaaccuccucaaaggugacaaagucaacggacaccucauccacaaaauagaaccccacuucaauaccagcuggaugucaugggacggcugugaccucgacuacuacugcaauaugggagacuggcccuccugcacauacaccggaguuacccaacacaaccacgccagcuuuguaaaccuccucaacaucgagaccgacuacaccaaaaacuuccauuuccacuccaaacgcguaacagcccacggcgacacaccucaacuagaccuaaaagcccgcccuacauacggagccggagaaauaaccguacucguugaagucgccgacauggaauuacacaccaagaaaaucgaaauauccggacugaaauucgcaucucucgcgugcacaggcugcuacgccugcucaagcuccaucucaugcaaagucagaauccacguagacgaaccagacgaacuaaccguccacgucaaaucagacgacccagacguagucgccgccucauccagccucauggcccgaaaacucgaguucgggaccgacuccacuuucaaagcguucuccgccaugcccaagaccucccucugcuucuacaucguagaacgcgaacacugcaaaucaugcucagaagaagacaccaagaaaugcgucaacacaaaacuugaacaaccacaaucgauccugaucgaacacaaaggcacgaucaucggaaaacagaacucaacaugcacagccaaggcaucaugcuggcucgaaucagugaaauccuucuucuacggucucaaaaacaugcuaagcgggauuuucggcaacgucuucaugggaaucuuccuauucuuagcccccuucauacuccuaauccucuucuucauguuuggcuggcgcauacucuuuugcuucaaaugcugccgccgaacacgcggacuauucaaauaccgccaccucaaagacgacgaagaaaccggauaucgcagaauaaucgaaaaacucaacaacaagaaaggcaaaaacaagcuccucgacggagaaagacucgccgacggacgaauagccgagcucuuuucaacuaaaacccacaucggu

SEQ ID NO: 15674 - RNA, 1932 nt, Artificial Sequence
  derived and/or modified CDS sequence (opt11) from CCHFV(IbAr10200)__AF467768.2__Gc
uuccuagacuccacagccaaaggaaugaaaaaccugcucaacagcacaucccuagaaacaucccuauccaucgaagcccccuggggagcuaucaacguccaaucgaccuacaaacccacaguuuccacagccaacauagcauuauccuggagcucugucgaacaccggggcaacaaaauacuuguaucaggacgguccgaaagcauaaugaagcucgaggagcguaccggcaucucaugggaccucggagucgaagacgcguccgaauccaaacuccucaccgucucaguaauggaccucucccaaauguacucacccgucuucgaguaccucuccggcgacaggcaaguaggagaauggccaaaagcaaccugcacuggcgacugccccgagcgaugcggaugcaccucauccacuugccuccacaaggaauggccccacagccgcaacuggcgcuguaacccaacuuggugcuggggagucggcacaggcuguaccugcugcggucucgacgucaaagaccucuucacagacuacauguucguuaaguggaaagucgaauacaucaagaccgaagccaucgucugcguagaacuaaccucccaagagcggcaaugcucccuuaucgaagcaggcacccgauucaaccuagguccaguaaccaucacccucuccgaaccgagaaauauccaacaaaaacuaccuccagaaaucaucacccuacacccgagaauagaagaaggauucuucgaccuaaugcacguccagaaggucuuaagcgccucaaccgucugcaaacuccaaagcugcacacacggaguccccggcgaccuccaaguauaccacauaggcaaccuccuaaaaggcgacaaagucaacggacaccuuauccacaagauugaaccccacuucaacaccucauggaugagcugggacggcugcgacuuagacuacuacugcaacaugggcgacuggccgucaugcaccuacaccggcgucacacaacacaaccacgccucauuugucaaccuccucaacauagagaccgauuacacgaaaaauuuccacuuccacagcaaacgcgucacagcccacggcgacacaccccaacucgaccuaaaagccagacccaccuacggcgccggcgaaauaacaguccuagucgaagucgccgacauggaacuacacaccaagaaaauugaaauaagcggccuuaaauucgccagccucgccugcaccggaugcuacgccugcucaagcggcaucucgugcaaaguccgcauccacguagacgaacccgacgaacucacaguacacguaaaauccgaugacccagacgucguagccgccucauccagccuuauggcccgaaagcuggaguucggcacagacuccacuuucaaagccuucucagccaugcccaaaaccucccuaugcuuuuacaucgucgaacgcgaacacuguaaguccugcuccgaagaagacaccaaaaagugcguaaacacaaaacuagaacaaccccaauccauccucaucgaacacaaaggaaccaucaucggcaagcaaaauuccacaugcaccgccaaagcaucgugcuggcuugaauccguaaaaucuuucuucuacggccucaaaaacaugcuauccggcaucuucggcaacgucuucaugggaaucuuccucuuccucgcacccuucauacuacuaauccucuucuucauguucggauggcgaauccuauucugcuuuaaaugcugccgccgaacccgcggccucuuuaaauaccgacaucuaaaagacgacgaagaaacaggcuaccgccgcaucaucgagaaacucaauaacaagaaaggcaaaaacaaacuccucgacggagaacgauuagcagaccgcagaaucgccgaacucuucuccaccaaaacccacaucggc

SEQ ID NO: 15675 - RNA, 1932 nt, Artificial Sequence
  derived and/or modified CDS sequence (opt11) from CCHFV(Turkey-Kelkit06)__GQ337054.1__Gc
uuccuugacagcaucgucaaagguaugaaaaaccuccucaacucuacgucacucgagaccucacuaucaauugaagcaccauggggcgccaucaacguccaaagcaccuucaaacccacaguauccaccgccaacaucgcccucuccuggagcucugucguccaccgcggcaacaaaauccuugucaccggacgcuccgaaucaaucaugaagcucgaagaacgcacgggcgucagcugggaccucggcgucgaagacgcaucagagucgaaacuacuaaccgucucaauaauggaccuaucccaaauguacucaccagucuucgaauaccuaagcggcgacagacagguagaagaguggccaaaagcaaccugcacaggcgacugccccgaacggugcggcugcacauccaguaccugccuccacaaagaguggucacacucacgcaacuggcgcugcaauccgaccuggugcuggggcgucgggacaggauguaccugcugcggagucgacgucaaagaccucuucacugaccacauguucgucaaauggaaggucgaauacauaaaaaccgaagccaucguaugcgucgcccuaacaagccaggaacgccaaugcucccucaucgaagcaggaaccagauucaacuuaggacccguaaccaucacgcucuccgaaccccgaaacauacaacagaaacucccacccgaaaucauaacccuucaccccaaaauagaagaaggcuucuucgaccucaugcacguccaaaaaguacucuccgccuccacagucugcaaacuacaaagcugcacccauggcauacccggcgaccuccaagucuaccacaucggcaaccuacuaaaaggcgaccgcguuaacggccacuuaauccacaaaauagaaucccacuucaacaccuccuggauguccugggacggcugcgaccuagacuacuacugcaacaugggcgacuggcccagcugcaccuacaccggagucacacaacacaaccacgccgcguucgucaaccuccucaauauagaaacagacuacacaaagacauuccacuuccacuccaaaagaguaaccgcccacggcgacacaccacaacucgaccuaaaagcgcgccccacauacggggccggaggcaucaccguccuaguagaagucgcagacauggagcuacauacaaagaaaguagaaauauccggccucaaguucgcaucacucgccugcacaggcuguuacgcuuguucaucaggcaucucaugcaaaguacgcauucacgucgacgaacccgacgaacuaaccguacacgucaaaucgucagacccagacguaguagcagccagcacgucacucauggcccgaaagcucgaguucggaaccgauucaaccuucaaggccuucucagcuaugcccaaaaccucacucugcuucuacaucgucgaacgcgaauacugcaaaucaugcucagaagacgacacccaaaaaugcguagacacccgccuagaacaaccccaaucaauccuaauagaacacaaagguacgauaauaggaaagcaaaacgauaccugcaccgcaaaagcauccugcuggcuugaauccgucaaaucguucuucuauggccucaaaaacaugcucggaagcguauucggcaaccucuucaucggaauacuccuguuccucgcccccuucguccuccucguccuauucuuuauguucggcuggaagauccucuucugcuucaaaugcugccgucgcacacguggccucuucaaauaccggcaccuaaaagacgacgaagaaaccggcuaccgcagaaucauagagcgacuuaauucuaaaaagggcaagaaccgucuucucgacggcgaccgccucgcugaccgcaaaaucgcagaacuauucuccacaaaaacccacaucggc

SEQ ID NO: 15676 - RNA, 1935 nt, Artificial Sequence
  derived and/or modified CDS sequence (opt11) from CCHFV(SR3)__AJ538199.1__Gc
cucuuccucgacagcauuguaaagggaaugaaaaaccuacuaaacucaaccagccuagagacaucacucucaaucgaggcccccuggggcgccaucaacguccaaagcacauacaaacccaccguaagcacggccaacauagcccuauccugguccagcguugaacauagaggcaacaagguccucguaucaggccgcucagaauccaucaugaaacucgaggaacgcacaggcauaucgugggaccucggcgucgaagacgccucagaauccaaacuacucaccguaucagucauggaccucucccaaauguacucacccguauucgaauaccucagcggcgaccgccaagucgaagaauggccaaaagcgacaugcaccggagacugccccgagcgcugcggcugcacuuccuccacgugccuccacaaggaauggccccacagccgaaacuggcgcuguaacccgacauggugcuggggcguaggcaccggcuguaccugcugcggccucgauguaaaagaucucuucacagacuauauguuugucaaauggaaagucgaauacauaaagaccgaagccauaguuugcgucgaacugaccucacaagagcgccagugcucacucaucgaggccggaacccgauucaaccuuggcagcguaacgauaacucucagcgaaccacgaaacauccaacaaaaacucccacccgaaaucaucacccuacaccccaaaaucgaagagggcuucuucgaccucaugcacguacaaaaaguccucuccgcgagcacaguaugcaaacuccagucaugcacucacggcguaccaggcgaccuacaggucuaccacaucggcaaccuacucaaaggggaccgagucaacggccaccuaauccacaaaaucgaacaacacuucaacaccucauggaugucgugggacggaugcgaccuagacuacuacugcaacaugggcgauuggcccuccugcacauacacaggaguaacacaacacaaccacgcaucguucgucaaccuccuaaacaucgaaacagauuacaccaagaccuuccacuuccacuccaaaagagucacagcccauggcgacaccccacaacuggaccucaaagcccgaccaaccuacggagcgggcgaaaucacaguccucgucgaagucgcagauauggagcuccacaccaagaaaaucgagaucagcggccuaaaauucgccggacuaaccugcaccggcugcuacgccugcuccuccggcaucucaugcaagguacgcauacacgucgacgaaccggacgagcucaccguccaugucaaaucagacgaccccgauguagucgccgcaucuagcucacucauggcccgaaaacuagaguucgggaccgacuccacauucaaagcauucuccgccaugccaaaaaccucccuaugcuucuauaucguggaaagagaauacugcaaauccugcaacaaagaagacacccagaaaugcguuaacacaaaacucgaacaaccccaaucaauacuaauugaacacaagggcaccaucaucgggaagcaaaacaauaccugcaccgccaaagccuccugcuggcucgaaucaguaaaaucauucuucuacgggcucaaaaacaugcucggcggcaucuuuggcaacguguucaucggcauauucacuuuccucacacccuucauacuccugauacucuucuucauguucggauggcgaauccucuuuugcuucaaaugcugccgacgcacaagaggccucuucaaauaccgccaucuaaaggacgacgaagaaacaggguaccgcaaaaucaucgagcgccugaacaacaagaaaggcaaaaaccggcuccuugacggcgaacgacuagccgaccgaaagaucgccgaacuguucuccacuaaaacccacauaggc

SEQ ID NO: 15677 - RNA, 1935 nt, Artificial Sequence
  derived and/or modified CDS sequence (opt11) from CCHFV(UCCR4413)__KY484038.1__Gc
uuccuauccagcaucgucaaaggaaagaaaaaccuccuaaacagcgcuucccucgagacgucgcucucaauagaagcacccuggggcgcgauaaacgcacaaagcaccuucaaacccacuaucuccacagccaacauagcacuaucauggucauccgucgaacaccgaggcaacaaaguccucgucagcggaagaucagaauccaucaugaaacucgaagaacgcaccggcaucucguggaaccucggagucgaagacgccagcgaaagcagaaugcuuacgguuuccgucauggaccuuucucaaauguacuuacccgucuucgaguaccucucaggcgaccggcaaguugaagaauggcccaaagccaccuguacaggcgacugcccugagcgaugcggcugcacauccuccacaugccuccacaaagaauggccccauucccgcaacuggcgaugcaaccccaccuggugcuggggcgucgggaccgguuguaccugcugcggccuagacguaaaagaccucuucaccgacuacauguucguuaaauggaaagucgaauacauaaaaacugaggcaaucgucugcguagaacuaaccagccaagaacgucagugcucccucaucgaagcagggacucgauucaaccucgguccggucacuaucacccuauccgaaccacguaacauccagcaaaaacuacccuccgagaucgugacccugcaccccaaaaucgaagagggcuucuucgaccugaugcacgugcagaaaguacucuccgccucaacgguaugcaagcuccaaagcugcacccacggaguugccggcgaccuacaagucuaccacguuggaaaucuccucaaaggagacaaaaucaacggacacucaauccauaaaauagaaccccaccucaacacauccuggaugagcugggacgguugcgaccuugacuacuauugcaacaugggugacuggcccuccugcaccuacaccggcgucacccaacacaaccacgcagccuucgucaaccucuuaaacaucgaaacggacuacaccaagagcuuccacuuccacuccaaacgcgucaccgcucacggcgacacgccccaacuugaccuaaaagcgcgccccauguacggggccggcgaaaucaccguccucgucgagguagccgacauggaacuccauuccaaaaacaucgaaaucuccggucucaaauucgccagccuaaccugcuccggcuguuacgcaugcuccuccggaaucuccugcaaaguccgcauccacguagacgaaccugacgaacucgcaguccaugucaaaucagacgaccucgacguugucgcggccagcuccucccucauggcccgaaaaauagaguucggcacagacuccaccuucaaagccuucuccagcaugcccaaagaaucacucugcuucuacauagucgaaagagacuucugcaaauccugcgcagccgaagacacgcagaaaugcguuaaagcuaaacuggaacaaccccaauccauccucaucgaacacaaaggaacuaucauaggaaaacaaaacgauaccugcuccacuaaaacauccugcuggcucgaaucauucaaaucauucuucuacggucucaagaacaugcucuccggaguguuuggcucggccaucaugggcauucuucuguuccucgcccccuucauccuccuaauccucuucuucuucuucggcuggcgaauacucuucugccuccgcugcugccgccguacacgaggacucuucaaguacaaacacauaaaagacgacgaagaagccggcuacaagaaaaucaucgaaaaacucaacaacaagaaaggcggaaccuccaaacuacucgacggagagcgccuugccgaccgaaaaaucgcagaacuauucucaaccaaagcucacaucgga

SEQ ID NO: 15678 - RNA, 1932 nt, Artificial Sequence
  derived and/or modified CDS sequence (opt11) from CCHFV(66019)__AB069669.1__Gc
uucagcgacucuauagucaaagguaugaaaaaucuccucaacucgacaucacuggaaaccucccuuuccauagaagcccccuggggcgcuaucaacgugcaauccaccuucaaacccaccgucaguaccgccaacaucgcacucuccugguccagcguugaacaccgcggcaacaagauauuaguauccggacgcucugagagcaucaugaagcucgaagaacgcaccggaaucagcugggaccucggagucgaagacgcgagcgagagcaaacuccuaacagucagcgucauggaccuaucccaaauguacagcccaguguucgaauaccucagcggcgaccgacagguggaagaauggccaaaagcaacaugcaccgggaauugccccgaucggugcggcugcaccagcagcacaugccuccauaaggaauggccccacagcagaaacuggcgcugcaacccaaccuggugcuggggcgucggaaccggauguaccugcugcggccucgaugucaaggaccucuucaccgacuacauguucgucaaauggaaagucgaauauaucaaaacggaagccauugucugcgucgaacucaacucccaagaacgacaaugcucacucaucgaagcaggcaccagauucaaccuaggccccguaacaaucacgcuauccgaaccgcgcaacauccaacaaaagcuaccaagcgaaauaaucacccuccacccgcgaaucgaagaaggcuucuucgaccugaugcacguccaaaaaguacucucagccagcaccgucugcaagcuccaaucaugcacacacggcgucccaggcgaccuccagaucuaccacaucgguaaccuacuaaaaggagaccgcgucaacggccaccuaauacacaaaauagaaccccacuuuaacaccuccuggauguccugggacggcugcgaucucgacuauuacuguaacaugggcgacuggcccucgugcaccuacacgggcgucacacagcacaaucacgcagcauucgucaaccuccugaacaucgaaaccgacuacaccaaaaacuuccacuuccacuccaaacgugucaccgcccacggcgauacaccccaacucgaccuaaaagcacgcccgaccuacggcgcuggagaaaucacugucuuggucgaaguagccgauauggaacuccauacuaagaaaauagcaaucuccggccugaaauucgccucccucaccuguaccggaugcuacgccugcuccagcggaauuucgugcaaaguccgcauccacgucgacgaaccggacgaacucacaguucacguaaaaagcgaggaccccgacauagucgcggccuccuccagccuuauggcacgaaaacuagaguucggcacagacuccaccuucaaggcuuucuccgccaugcccaaaaccucacucugcuucuacaucguggaaagggaauacugcgaaucuugcagcaaagaggacacccagaaaugcgucaacacuaaacucgaacaaccccaaucaauacugauagaacacaaaggcacgauaauaggaaaacaaaacgauaccugcaccgccaaagccuccugcuggcuagaauccguaaaaucguucuucuacggccugaaaaacaugcucagcggcauauucggaaacgucuucauaggaauauuccucuuccuagcccccuucauccuacugaucuuguucuucauguucggcuggagaauccucuucugcuucaagugcugccgccgcacccgcggacucuucaaauaccgcuaccucaaagacgacgaagagucaggauaccgccgcaucaucgagcgacuaaacaacaagaaaggcaaaaacaaacuccucgacggagaacgacucgcagaccgccgcauagccgaacuauucagcaccaagacacauaucggc

SEQ ID NO: 15679 - RNA, 1932 nt, Artificial Sequence
  derived and/or modified CDS sequence (opt11) from CCHFV(7001)__AB069670.1__Gc
uuccuagacaacaucgcaaaaggcaugaaaucacuacugaacucaacaucacucgaaacaucccuauccauagaagcccccuggggagccauaaacguacaaucaacauucaaacccacagucagcgccgccaacaucgcucucucaugguccagcguggaacaccgcggcaacaagauccucguaagcggccggagcgaaucuaucaugaaacuugaggaaagaaccgggguaucauggaaccugggagucgaagacgcaagcgaaagcaagacccugaccguauccgucauggaccucucacaaauguacuccccuguauucgaauaccucaguggcgaccgccaaguggaagaguggcccaaagcuacuuguacaggagacugccccgaaagaugcgggugcaccuccuccaccugucuccacaaggaauggccccacagcaggaacuggcgcugcaaccccaccuggugcuggggcgucggaacaggcuguaccugcugcgggcuagacgucaaagacuucuucacagacuacaugcuaguuaaauggaaagucgaauacauaaaaaccgaagcaaucguaugcgucgaacuaacuucgcaggaacgccagugcucccucauagaagcaggcacccgauucaacuuaggccccgucaccaucacccugagugaaccucgaaacguacaacaacgacugcccccagaaaucguaacccuccacccgaaaaucgaagagggcuucuuugaccuuaugcacguacagaaaauccucuccgcaucaacaguaugcaaacuccaauccugcacccacggcgucccaggagacuuucaaguauaccacgucggcaaccuccuccgcggcgacaaaguaaacggccacuccauacacaagaucgaaccccacuuuaacacaucguggaugaguugggacggcugcgaccuagacuacuucugcaacaugggagacuggcccuccugcacauacaccggcgucacccaacacaaccgcgccgcauucaucaacaugcuaaacauagaaacggacuacacuaaaacauuccacuuccacuccaaacgagucacagcacacggagacaccccucaacuagaccuuaaagcgcgaccagcauacggagccggcgaagucaccguccuagucgaggucgccgaccucgaacuacacacaaagaaacucgaagucucgggccucaagauagccagccuaaccugcuccggaugcuacgcaugcuccuccggaaucuccugcaagguaagaauccacguuaacgaaccggacgaguucaccguccacguacgcagcucggacccagacgucguagcagcaggcuccucccucauggcccgcaaaauagaguucggcgccgacuccaccuucaaggcauucucuucaaugccaaaagacucacucugcuucuacaucgucgaaaaggacuacugcagcucaugcaccgacgacgacacccaaaaaugcgucaacaccaagcucgaccacccacaauccauccugauagaacacaaaggaaccaucaucggcaaacagaacgauaccugcucuaccaagacauccugcuggcuagaaagcguaaagggauucuucuacggccucaaaaacaugcuauccggaaucuucgggaacguauucuuaggaaucuuccucuuccucgcaccguucguacuccuaaucuucuucuuuuucuucggcuggcgacuacuauucugccuaaaaugcuguagacgcaccagagggcuccuaaaauacaaacaccucaaagacgaagaagaagccggcuacaagaagaucauagagcgccuaaacggcaagaaaggcaaaagucaacucuucgacggagaacgacuagcagaccgcaaaauugcagagcuuuucucaacuaaaauacacaucggc

SEQ ID NO: 15680 - RNA, 1932 nt, Artificial Sequence
  derived and/or modified CDS sequence (opt11) from CCHFV(75024)__AB069671.1__Gc
uuccuagacucaauagucagaggaaugaaaaaucaacucaacagcacaucccucgagaccucccuauccaucgaagcccccuggggagccauaaacguacaaucgaccuacaaaccaaccgucagcaccgcaaacaucgcccucagcuggucuagugucgaacaccgcgggaacaaaauacucguaucgggccgguccgaaucaauaaugaaacuagaagaacggaccggcauaucaugggacuuaggcgucgaagacgcaagcgaguccaagcuccucaccguguccgucauggaccucucccaaauguacucccccgucuucgaguaccucuccggugaucgacaaguagaagaguggcccaaggcgacaugcacuggagacugcccggagcgcuguggaugcacaaccagcacuugccuacacaaagaauggccccacagcagaaacuggcgcugcaacccuaccuggugcuggggcgucggaacaggauguaccugcugcggccucgacgucaaagaucuauuuaccgacuacaugauagucaaauggaaagucgaauacauaaaaacggaagccaucguaugcguggaacuaacaucgcaagaacgccaaugcucccucaucgaagcaggaacgcgcuucaaccugggaagcguaacaaucacccucucagaaccccgcaacauacaacaaaaacucccacccgagauuaucacucuucacccccgcauagaagaaggcuucuucgaccucaugcacguccaaaaaguccuaagcgcauccacaguaugcaagcuccaaucgugcacacacggcguacccggcgaccuccaggucuaccacguaggcaaccuccuaaaaggcgacaaagucaacggccaccuaauacacaaaauagaaccccaccuaaacaccucauggauguccugggacggcugcgaccucgacuacuacugcaacaugggcgacuggcccucuugcaccuacaccggcgucacccaacacaaccacgcauccuucguaaaccuacucaacaucgaaacugacuacaccaaaaguuuccacuuccacucaaaacgcgucaccgcacauggcgacacaccccaacucgaccucaaggcccgucccaccuacggcgcaggagagauaaccguacuggucgaagucgccgacauggaguucacaccgaaaaagauagaaauaagcggccugaaauuugccucccuaacaugcacaggcugcuacgccugcucauccggcaucuccugcaaagucagaauccacgucgacgagccagacgagcucaccguccacgucaaaucugacgacccggacguuguagccgccuccagcucucuuauggcccgaaaacucgaguucggaacggauucaacauucaaagccuucucagccaugcccaaaaccucccugugcuucuacaucgucgaacgcgaauacugcaaguccugcuccaaagaagacacccaaaagugcgucaacacaaaacucgaacagccccaaagcauccugaucgaacacaagggcacgauaaucgggaaacaaaacaacacgugcacugccaaagccucaugcuggcucgaauccgucaaaucauucuucuacggccucaaaaacauguuaucaggcauauuuggcaaccucuucaugggcauauucuuguuccucgccccguucauacuacuaauccuauucuucauguucggcuggcgaauccucuucugcuucaaaugcugccgacgaacgcggggccucuucaaauaccgacaccucaaagacgaugaagagaccggauaccgacgcauaauugaacgacuaaacaacaagaaaggcaagaacaaacuucucgacggcgaacgccucgcggacaggcgaaucgccgaacucuucuccacgaaaacgcacauaggc

SEQ ID NO: 15681 - RNA, 1932 nt, Artificial Sequence
  derived and/or modified CDS sequence (opt11) from CCHFV(7803)__AB069672.1__Gc
uuccucgauuccaucguccgcggaaugaaaaacccccucaacagcacgucccucgagacaucucucagcauugaggcaccuuggggagccauaaacguacaaagcacauacaaaccgaccguauccaccgccaacaucgcccuauccuggucguccgucgaacacagagggaacaaaauccuagucuccggcagguccgaaagcauaaugaaacuggaagaacgaaccggcauauccugggaccugggcgucgaggacgcaucagaauccaaacuacucacaguaagcguaauggaccucucgcaaauguacuccccaguuuuugaauaccuauccggggaccgacaaguugaagaauggcccaaagcgaccugcaccggcgacugccccgagcgcugcggcugcacaacgucaaccugccuccacaaagaauggccccacagccgcaacuggcgaugcaacccaaccuggugcuggggcgucggcacaggcugcacuugcugcggccucgaugucaaagaccuguucacagacuacaugaucguaaaauggaaaguagaauauaucaaaacgcgcggaaucguaugcguagaacucacaagccaagaaagacaaugcucgcugaucgaagccgguaccagauucaaccucggcagcgucaccaucacacuaucagagccccgaaacauccagcaaaaacucccaccagaaaucaucacccuucacccccgcaucgaggaaggcuucuucgaccuaaugcacguccaaaagguacucuccgcauccaccguaugcaaacuccaauccugcacgcacggggucccgggugaccuccagguauaccacgucggcaaccuccucaaaggcgacaaagucaacggccaccucauccacaaaaucgaaccccaccucaacaccuccuggauguccugggacggcugcgaccucgacuacuacugcaacaugggugacuggccaucaugcacauacaccggagugacccaacacaaccacgccagcuucgucaaccugcugaacauagagacugacuacacuaaauccuuccacuuccacucuaaacgcguaaccgcccacggcgacacuccccaauuagaccugaaagcccgccccaccuacggagccggcgaaaucaccguccuugucgaagucgccgacauggaauuuacccccaaaaagaucgagaucucaggccuuaaauucgccagccuaaccugcacaggcugcuacgcaugcucaagcggaaucucuugcaagguucgcauccacgucgacgaacccgacgaacucaccgugcacgucaaaagcgacgaccccgacgucgucgcagccucuucaucccugauggcccgaaaacuagaguucggaaccgacuccacauucaaagccuucucagccaugccgaaaaccucgcuaugcuucuacaucguagaacgggaauacugcaaaagcugcagcaaagaagacacccaaaaaugcgucaacaccaaacucgaacagccccaaucuauucucaucgaacacaaaggcaccauaaucggcaaacaaaacaacacaugcaccgcaaaggcuuccugcuggcuagaauccgugaaaucguucuucuacgggcucaaaaacaugcuauccggcaucuucggaaacuuuuucaugggcaucuucuuguuccucgcccccuuuauccugcucauccucuuuuucauguucggauggagaauacuauucugcuucaaaugcugcagacgcacacgcggccucuucaaauaccgccaccuaaaagacgaugaagaaaccggauaccgacgcauaaucgaacgccuuaacaacaagaaaggcaaaaacaaacuccuggacggagaacgccucgcagaccgccgcauagccgaacucuucagcaccaaaacccacaucggc

SEQ ID NO: 15682 - RNA, 1932 nt, Artificial Sequence
  derived and/or modified CDS sequence (opt11) from CCHFV(79121)__AB069673.1__Gc
uuccucgacagcaccgcaaaaggcaugaagucccuacuaaacucaaccucccuagaaaccucccuguccaucgaagccccauggggagcaauaaacguccaauccacauucaaaccaacugucuccgcagcaaacaucgcauuauccuggucauccguggaacaccgcggcaacaagauacucgucuccggacgcuccgaauccaucaugaaacucgaagaacgaaccgguguaucauggaaccucgggguugaagacgccagcgagucuaagacacuuacggucagcgugauggaucuaagccaaauguacucacccgucuucgaauacuugucaggcgaccgccaagucgaggaauggcccaaagcaaccugcacaggagauugccccgaacgaugcgguuguaccuccuccacaugccuacacaaagaauggccccauagcagaaacuggcgcugcaaucccaccuggugcuggggcgucggcacgggcugcacgugcugcggccuagacguaaaggacuuuuucaccgacuacaugcuaguuaaauggaaagucgaauacauaaaaaccgaagccauaguaugcgucgaacucaccucgcaagaacgccaaugcuccuuaauagaagccggcacccguuucaaccucggccccguaaccaucacucuauccgaaccacgcaacguucaacaacgacucccgccugaaaucgucacccuucaccccaaaaucgaagaaggcuuuuucgaccuaaugcacguacagaaaauacuuagcgcaagcacggucuguaaacuccaaucaugcacacacggaguccccggcgacuuucaaaucuaccacgucggcaaccuacuucgcggcgacaaaguaaacggucacuccauccacaaaauagaaccccacuucaacaccagcuggauguccugggacggcugcgaccucgauuacuucugcaacaugggcgacuggccguccugcacguacacaggcgugacacaacacaaccgagcagcauucauuaacaugcucaauauagaaacagacuacaccaaaaccuuccacuuccacuccaaacgcguaacagcucacggcgacaccccacaacuagaccucaaagcacgcccagcauacggcgcgggcgaagucaccguacuugucgaggucgccgaccucgaacuccacaccaaaaaccuagagguuucuggccucaaaaucgccucacuuacauguuccggaugcuacgccugcuccuccggaaucucaugcaaaguacgcauccacguaaacgaacccgacgaauuuaccguccacguccgcagcuccgaccccgacguagucgccgcgggcuccagccuaauggcaaggaaaauagaguucggcgccgacucaacauucaaagcguucagcagcaugcccaaagacucccuaugcuucuacauagucgaaaaggauuacugcuccucaugcaccgacgacgacacacaaaaaugcgucaacacaaaacucgaccacccccaauccauacuaaucgaacacaaaggcacaaucauuggcaaacaaaacgauaccugcuccaccaaaaccuccugcuggcucgaauccgucaaagguuucuucuacggccucaaaaacaugcuauccggcauauucggcaacgucuuccucgggauauuccuauuucucgccccauucguccuccuaauauuuuucuucuucuucgguuggcgccuccuguucugccucaaaugcugccgccggacccgcggccuccuaaaauacaaacaccucaaggacgaagaagaagccggcuacaagaaaauaauagaacgccucaacggcaagaaaggaaaaucgcaacucuucgacggcgaacgccucgccgaccgcaagauagcagaacuuuucagcaccaaaauccacaucgga

SEQ ID NO: 15683 - RNA, 1932 nt, Artificial Sequence
  derived and/or modified CDS sequence (opt11) from CCHFV(8402)__AB069674.1__Gc
uucucagacuccaucgucaagggaaugaaaaaccuccuaaacuccacaucgcuagagacaagccucucaaucgaagcaccuuggggagccaucaacguccaaagcaccuucaaaccuaccgucagcgcagcaaacaucgcccugagcugguccagcguggagcaccgcggaaacaaaauccucgucagcggccgcuccgaaucaaucaugaaacuagaagaacggaccggcauauccugggaccucggcgucgaagacgccucggaauccaaacuccuaacugucagcgugauggaucucucacaaauguacucacccguauucgaguaccucagcggcgacagacagguagaagaauggccaaaagccacaugcacaggagacugcccagaacguugcggcuguaccucaagcacaugccugcacaaggaauggccccacucacgaaacuggcgcugcaacccaaccuggugcuggggcguaggaaccggcugcacaugcuguggccucgacgucaaagaucucuucaccgacuacauguucaucaaauggaaaguagaauacauaaaaaccgaagcaauagucugcgucgaacucaccucacaagaacgccagugcacccucaucgaagccggcacacgcuucaaccucggcccgguaaccaucacacuaucugaaccccgaaauauccagcaaaagcugcccccagaaauagucacccuccaccccagaauugaagagggcuucuucgaccucaugcacguacaaaaaguacuaagcgccuccacagucugcaaacuacaaucgugcacccacggggugcccggcgaccuccaagucuaccacaucggcaaccuccuaaagggggacaaaguaaacggacaccuaauccacaaaaucgaaccccacuucaacaccucauggaugucaugggacggaugcgaccucgauuauuauugcaauaugggcgacuggcccucgugcacauacaccggaguaacccaacauaaccacgccgccuucgucaacaugcugaacauagaaaccgacuacaccaagaacuuccacuuccacucaaaacgcgucaccgcacauggugacacuccacaacucgaccucaaagcccgccccaccuacggcgcuggugagauaacagucuugguggaaguagcagacauggaacuccacaccaaaaagauagagaucuccggccugaaauucgccagccuaaccugcaccggcugcuacgccugcuccuccggaaucuccuguaagguccgcauccacgucgacgaaccagacgagcuaaccguucacguuaaaagcgaggauccggacaucgucgcagccucaagcucacucauggcccgcaaacuagaguucggaacagacuccaccuucaaagccuucucggccaugcccaaaaccucgcucugcuucuacaucguggagcgcgaauacugcaaaagcugcuccaaagaagauacacaaaaaugcgucaauacuaagcuagaacaaccccaaucgauauugaucgaacacaaggguaccaucaucggcaaacaauccaacacuugcacagccaaggcaucaugcuggcuugaauccguaaaaucauucuucuacggccucaaaaacaugcucuccggcaucuucggaaacguauucaucggcgucuuccucuucuucgcacccuucauacuacuaauccucuucuucauguucggguggcgcauccucuucugcuucaaaugcugccgacgcaccagaggccucuucaaauaccggcaucucaaagacgaugaagagaccggauacagaaaaauaaucgaacgccucaacaacaagaaagggaaaaacaaacuccuagacggcgaacgccucgccgaccgcaaaaucgccgaacucuucucaacaaaaacacacaucgga

SEQ ID NO: 15684 - RNA, 1932 nt, Artificial Sequence
  derived and/or modified CDS sequence (opt11) from CCHFV(88166)__AB069675.1__Gc
uucagcgacuccaucgucaaagggaugaaaaaccugcuuaacucaaccucccucgaaacgucccuaucaauugaagcccccuggggcgccauaaacguccaauccacuuucaagccuaccaugucagcggcgaacaucgcacuuucuuggagcuccguagaacaccgaggcaacaaaauccugguauccggccggucagaauccauaaugaaacucgaagaacgcacgggcauauccuggaaccuaggcgucgaagacgccagcgaaagcaaacuacucaccgucagcguaauggaccucucgcagauguacucacccgucuucgaauaccucaguggcgaccgccaagucgaagaauggcccaaagcgaccugcacuggcgacugccccgaacggugcggcugcacuucaucaaccugccuacacaaagaauggccccacagccgcaauuggcgcugcaaccccacauggugcuggggcgucggcaccggguguaccugcugcggacuagaugucaaagaccucuucaccgacuacauguucaucaaauggaaaguagaauacauaaaaacagaagcaaucgugugcguugaacuaaccagccaagaacgccagugcacccuaaucgaggcagggacacgcuucaaccucggccccguaaccaucacacucuccgaaccccgcaacauccaacaaaaacuaccacccgaaaucguaacccuacacccccgcauagaagaaggauucuucgaccuaaugcaugugcagaagguacucucagccagcacagucugcaaacuccaaagcugcacccacggaguacccggcgaccuacaagucuaccacaucggaaaccuccuaaaaggagacaaagucaacggccaccucauccacaaaauagaaccccacuucaacaccagcuggaugucaugggacggcugcgaccucgacuacuauugcaacaugggagacuggcccagcugcacguacacaggcgucacccaacacaaucaugccgccuucgugaacaugcugaacauagaaaccgacuacacuaaaaacuuccacuuccacuccaaacgcgucaccgcacacggcgacaccccgcaacuagaucuaaaggcacgcccaacauacggcgccggagaaauaaccguccuagucgaaguagcagacauggagcuccacacgaagaaaaucgaaaucucaggacuuaaauucgcaucccuaacaugcaccggcugcuacgcaugcucaagcggaaucucaugcaaaguccgcauccacguugaugaaccagaugaacucacaguccaugucaaaagcgaagaccccgaccucgucgccgccucgucaucccucauggccaggaaacucgaguucggcacagacucgaccuucaaagccuucuccgccaugccaaaaaccucacucugcuucuacauaguggaacgagaauacugcaaaucaugcagcaaagaagacacccagaaaugcguuaacaccaagcuagaacaaccgcagucgauccuaauugaacacaagggaaccaucaucggcaagcaaaacaacacgugcaccgccaaggccuccugcuggcuagaaaguguaaaauccuucuucuacggacucaaaaacaugcucucgggcauauucggcaacguauucaucggcgucuuccucuucuucgccccauucauacuacuaauacuguucuucauguucggcuggcgcauccucuucugcuucaaaugcugccggcgcacccgaggacuauucaaauaccgccaccuuaaagacgaugaagaaaccggcuacaggaaaauaaucgaacgacucaacaacaaaaagggaaagaacaaacuacucgacggagaaagacucgccgacaggaagaucgcagaauuauucagcaccaaaacccacaucggc

SEQ ID NO: 15685 - RNA, 1932 nt, Artificial Sequence
  derived and/or modified CDS sequence (opt11) from CCHFV(BA88166)__AF338470.1__Gc
uacuuagacagcauagucaaaggaaugaaaaaccuucugaacuccaccucacucgaaacaucccuguccaucgaagccccauggggcgccauaaacguccaaucgaccuucaaaccaaccaugucagcugccaacauagcccucucaugguccagcguggaacaccgcggcaacaagauccucguauccggccgcuccgaaucaaucaugaaacucgaagaacgcaccggcaucucauggaaccuaggaguagaggacgccagcgaaagcaaacuccuuacaguaagcguaauggacuuaagccaaauguacuccccaguuuuugaauaccugagcggggaccgccaagucgaagaguggcccaaagcgacaugcaccggagacuguccagagcgcugcggcugcaccuccucaaccugccuacacaaagaauggccccacucccgcaacuggcgcugcaacccaaccuggugcuggggcguaggaacgggaugcacaugcugcggacucgacgucaaagaccucuucacagacuacauguuuaucaaguggaaagucgaauacauaaaaacagaggcaaucguaugcgucgaacucaccagccaagagcggcaaugcacacucaucgaagcaggcacacgauucaaccuaggcccugucaucaucacacuauccgagccacgaaauauccagcaaaaacuacccccagaaauagucacucugcacccccgcaucgaagaaggcuucuucgaccucaugcacguacaaaaaguccuaagcgccuccaccguaugcaaacuccagucaugcacccacgggguccccggcgaccuucagguauaucacauaggcaaccuccucaaaggcgacaaagucaacggccaccuaauccacaaaauagagccccacuucaauacaucauggauguccugggacggaugcgaccuagacuacuacugcaacaugggagacuggcccuccugcaccuacacaggcgugacacaacacaaccaugcggcauuugucaacauguuaaacauugaaaccgacuacaccaaaaacuuccacuuccacucaaaacgcgucacugcccacggugacaccccacaacucgaccugaaagcacgaccuaccuacggcgccggcgaaauuacaguccugguagaggucgccgacauggaacuacacacaaagaaaauagaaauaagcggacuaaaauucgccagucuuaccugcaccggcugcuaugcaugcuccuccggaauuuccugcaaagucaggauccacgucgacgaacccgacgaacuuaccguucacgucaaaagcgaggaccccgacauagucgcugccuccucuucccucauggcccgcaaacuagaguucgguacagauucuacuuucaaagccuucucagccaugcccaagaccucccuaugcuucuacaucgucgaacgcgaauacugcaaauccugcagcaaagaagacacccagaaaugcguaaacaccaaacucgaacaaccccaaucaauccuaaucgaacacaaaggcacaauuauaggcaaacagaauaauaccugcaccgccaaagccucuugcuggcucgaaagcgucaaauccuucuucuacggccucaaaaacaugcuuucuggcauauucggaaacgucuucaucggcguauuccucuucuucgcaccguucauccuacucauccucuucuucauguucggauggagaauccuuuucuguuucaaaugcugccgacgcacccgcggccuauucaaauacagacaccuaaaggacgacgaagaaacaggauaccgcaaaaucaucgagcgccuaaacaacaagaaagggaaaaacaaacuccuagacggagagcgccuggcagaccgcaaaaucgcagaacuauucuccaccaaaacccacaucgga

SEQ ID NO: 15686 - RNA, 1932 nt, Artificial Sequence
  derived and/or modified CDS sequence (opt11) from CCHFV(BA66019)__AF350448.1__Gc
uucagcgacaguaucgucaaaggcaugaaaaaccuccuaaacucaaccucccucgaaaccucccucuccaucgaagcaccauggggagccaucaaugugcaauccaccuucaaaccgaccgucucuaccgcgaacaucgcacuaucauggucuagcguagaacacagagggaacaaaauccucgucucaggcagaagcgaaagcauaaugaaacucgaagaaaggacaggcauuuccugggaccuuggcguagaagacgccagcgaaagcaaacuccuaaccgucucagucauggaccucucccaaauguauucccccgucuucgaauaccugagcggcgaccgacaagucgaagaauggcccaaagcaaccugcaccggggacugccccgaccgaugcggcugcaccucaucaaccugccuacacaaagaauggccccacagccgcaacuggcgaugcaacccgaccugguguuggggcgucggcacagguuguaccugcugcggccucgacguaaaagaccuuuucaccgacuacauguucgucaaauggaaagucgaguacaucaaaacagaagcaauagucugcguagaacucaacucgcaagaacgccaaugcucccucauagaagccgguacucgcuuuaaccucggcccagucaccaucacccuaucggaaccacgcaacauccagcaaaaacucccgcccgagaucauaacccuacacccccgaaucgaagagggcuucuucgaccucaugcacguucaaaaaguccucagugcgagcacagugugcaaacuucaaucgugcacccacggcguaccaggcgaccuccaaaucuaccauauaggcaaccuacucaaaggcgacagagucaauggccaccucauucacaaaauagaaccccacuucaacacaucauggaugucuugggacggaugcgaccucgacuacuacugcaacaugggcgacuggcccucaugcacauacaccggcgugacccaacacaaccacgcagccuuugucaaccuccuuaauaucgaaacugacuacaccaaaaacuuccacuuccacagcaaaagggucaccgcccacggcgacacaccucaacuagaccucaaagcacgcccaacauacggcgccggugaaaucaccguccuaguagagguagcggacauggagcuacacacaaagaaaaucgccaucucgggccucaaauucgccucccucacaugcaccggcugcuacgccugcuccucaggcaucucuugcaaagugcgcauccacguagaugaaccagacgaacucacgguacacgucaaauccgaagacccggacauuguagcagccuccuccucucuaauggcacgcaaacuggaguucggaaccgacucgacauucaaagcauucuccgcuaugccaaaaaccucccucugcuucuacaucgucgaaagagaauacugcgaaagcugcuccaaagaagacacccagaaaugcgucaacaccaagcucgaacaaccccagucaauacuaaucgaacacaagggcacaaucaucgguaagcagaacgacacaugcacagcuaaagcauccugcuggcucgaaucagucaagagcuucuucuacggacuuaaaaacaugcucuccggcaucuucgggaacguauucaucggcaucuuccuguuccucgcaccauucauccuacuaauccucuucuucauguucggauggcguauccuguucugcuucaaaugcugccgccgcacccgaggccucuucaaauaccguuaccuaaaagacgacgaagaauccggcuaccgccgaauaaucgaacgucucaacaacaagaaagggaaaaacaaacuccucgacggagaacgucuagccgaccgucgaauagccgaacuauuuuccacgaaaacacacauaggc

SEQ ID NO: 15687 - RNA, 1932 nt, Artificial Sequence
  derived and/or modified CDS sequence (opt11) from CCHFV(BA8402)__AF350449.1__Gc
uucagcgauagcauagucaagggcaugaaaaaccuccucaacucuacaucacucgaaaccucacucuccaucgaagcacccuggggcgcuauaaacgugcaauccacguucaaacccaccguguccgccgcaaacauagcccucucauggucguccguagaacaucgagggaacaaaauccucgucuccggccgguccgagucgaucaugaaacucgaagagagaaccggaauauccugggaucuaggaguagaggacgcauccgaguccaaacuccucaccguuuccgucauggaucucucgcaaauguacucccccgucuucgaauaccucuccggcgaucgacaaguagaagaauggccaaaagcgaccugcaccggagacugccccgaacgcugcggcugcaccucaucaaccugucuccacaaagaguggccccacucccgaaacuggcgcugcaacccaaccuggugcuggggcgucggaaccggcuguaccugcugcggacuugacgucaaagaccucuucaccgacuacauguucaucaaauggaaagucgaauacauaaaaacugaagccauaguaugcguugaacuaacuucacaggagcgccaaugcacacucaucgaagccggcacccgcuucaaccucggccccgucacgaucacccuaagcgaaccucgcaacauacagcaaaaacuacccccagaaaucguaacccuccacccucggaucgaagaaggcuuuuucgaccucaugcacguacaaaaaguccucagcgccagcaccgucugcaaacuccaaucaugcacccacggcgucccgggagaucuccaagucuaccacauuggcaaccuccucaaaggagacaagguaaacggacaccuaauacacaagauagagccccacuucaauacaucauggaugagcugggacggcugcgaccuacacuacuacugcaacaugggcgacuggcccucgugcacguacacgggagucacacaacacaaccacgcugccuucguaaacaugcucaacaucgaaacagacuacaccaaaaauuuccauuuccacuccaaacgcgucacggcccacggcgacaccccgcaauuagaucuaaaggcccgacccacauacggcgccggcgaaauaaccguccucgucgaagucgccgacauggaacuccacaccaagaaaaucgaaaucuccggccucaaauuugcaucccucaccuguaccggaugcuacgccuguuccagcggcaucuccugcaaaguucggauacacgucgacgaacccgacgaacucacuguccacgucaaauccgaagaccccgacauagucgcagcaagcagcucccucauggcccggaaacuggaguucggcaccgacuccaccuucaaagcauucuccgcaaugcccaaaaccucccuaugcuucuacaucguagaacgcgaauacugcgaaagcugcuccaaagaagacacacaaaagugcguuaacacgaaacucgagcaaccccagucgauccuaaucgaacacaaaggcaccaucauagggaagcaaucgaacacaugcaccgcaaaggccucaugcuggcucgaaagcgucaagucguucuucuacggacucaaaaacaugcucucaggaauauucggcaacgucuucaucggcguauuccucuuuuucgcuccauucauccuacuaauucucuucuucauguucggcuggcgcauacucuucuguuucaaaugcugccgacgcacccgugggcuauucaaauaccgccaccuaaaggacgacgaagaaacagguuacagaaaaaucauagaacgccuuaacaacaagaaaggcaaaaacaagcuccucgacggcgaacgucuugccgaccgaaaaaucgccgaacuauucuccaccaaaacacacauagga

SEQ ID NO: 15688 - RNA, 1932 nt, Artificial Sequence
  derived and/or modified CDS sequence (opt11) from CCHFV(Matin)__AF467769.2__Gc
uuccucgacucaaucauaaaaggcaugaaaaaccuccugaacucaacaucccuagaaaccucccucagcauagaagccccauggggcgcaaucaacguacaaucuacauucaaaccgaccaugagcgccgccaacauugcacucuccuggagcagcguagaacacagaggaaauaaaauacuggucucuggacgcagcgaauccaucaugaaacuugaagaacgcacagggaucucaugggaccucggcguugaggacgcguccgaauccaagcuccuaaccgucagcguaauggaccugucccaaauguacuccccaguauucgaguaucucucaggagaccgccaagucgaagaauggcccaaagcuacuugcaccggcgacugccccgaacgaugcggcugcaccagcucgaccugccuacacaaggaguggccacacucccgcaacuggcgaugcaaccccacauggugcuggggcgucgguacaggauguaccugcugcggacucgacgucaaagaccuauucaccgacuacauguuuguaaaauggaaggucgaauacauaaaaaccgaagucauuguaugcgucgagcucacaucccaagaacgccagugcucacucaucgaagccggcacccgauucaaccucggccccgucaccaucaccuuauccgaaccacgcaauauccaacaaaagcucccacccgaaauagugacccuacacccacgcauagaagagggauucuuugaccucaugcacguccaaaagguccucuccgccuccacagucugcaaacugcaaucgugcacccacggcguacccggcgaccuacaaguguaucacauaggcaaccuacugaaaggggacaaaguaaacggacaccuaauccacaaaauagaaccccacuucaacaccuccuggauguccugggacggcugcgaccucgacuacuauugcaacaugggcgauuggccaucaugcucguacacgggcguaacccaacacaaccacgccgcuuucgucaacaugcugagcaucgaaacagacuacaccaagaacuuccacuuccacucaaaacgcguaaccgcucacggcgacaccccgcagcuagaccucaaagcacggccaaccuacggcgccggagaaaucaccguccucguagaagucgcagacauggaacuacauaccaaaaagaucgaaaucucuggucuaaaauucgcauccuuaacaugcacgggaugcuacgcgugcagcucagggauauccugcaaaguccgaauccacguugacgaaccagacgaacucaccguucacgucaaauccgaagaccccgauaucgucgccgccucuagcucccuaauggcccgaaaacucgaguucggcaccgacuccaccuuuaaagcauuuucagcaaugccaaaaacaucucucugcuucuacauuguggaacgugaauacugcaaauccugcagcaaagaagacacccaaaaaugcgucaacaccaaacuagaacaaccccaauccauccuaaucgaacacaaaggaaccaucauagggaaacaaaacgacacaugcacggccaaagcauccugcuggcucgagucaguuaaaucauucuucuacggacucaaaaauaugcuauccggcauauucggcaaugucuucauuggcaucuuucuauuccucgcccccuucgcacuccugauacuauucuucauguucggcuggcgcauacucuucugcuucaaaugcugcagacgcacacggggacucuucaaauaccgccaccuaaaggacgacgaagaaaccggcuaucgaaaaaucaucgaacgccucaacaacaagaaaggcaaaaacaaacuacucgacggcgaacgccuagccgacagaaaaauugcugaauuauucuccaccaaaacccacgucgga

SEQ ID NO: 15689 - RNA, 1932 nt, Artificial Sequence
  derived and/or modified CDS sequence (opt11) from CCHFV(Baghdad 12)__AJ538197.2__Gc
uuccuagacuccaucgucaagggaacaaagaaccugcucaacuccaccucccucgagacaagccucuccaucgaggccccauggggcgcaaucaacguccaauccaccuacaaacccacagucucuaccgcaaauaucgcccucuccugguccucaguggaacaccgugggaacaaaauccucguauccggccgcuccgaaucaaucaugaaacuggaagagaggacgggcaucuccugggaccucggcgucgaggacgcuagcgaaagcaaacuacuaaccguuucugucauggaucucagccagauguacucgccagucuucgaauaccucagcggggaccgacaagucgaagaauggcccaaagcgaccugcaccggcgacugcccagaacgcugcggcuguaccacaucaaccugccuacacaaagaauggccccacucccgcaacuggcgaugcaacccgaccugguguuggggcgucggaacaggcuguaccugcugcggccucgacgucaaagaccucuucaccgacuacauguucgucaaauggaaagucgaguacaucaaaacagacgccaucguaugcgucgaacugacaucccaagagcgccaaugcucccucaucgaagccggcacacgcuucaaccucggcuccgucaccaucacccuuuccgaaccacgcaauauccaacaaaaacuaccacccgaaaucaucacccuccacccacgaauugaggagggauucuucgaccuaaugcaugugcaaaaaguucucuccgccuccaccgucugcaaacuucaauccugcacgcacggcguacccggcgaccuccaagucuaccacaucggcaaccuuuugaaaggcgacaaaguaaacggacaccucauccacaagaucgaaccccacuucaacaccucguggauguccugggacggcugcgaccucgacuacuauugcaacaugggagacuggcccuccugcacuuacacuggcguaacccaacauaaccacgcgucauucgucaaccugcucaacaucgagacagacuauacaaagagcuuccacuuccacuccaaacgaguaaccgcccacggcgauacaccccaacuagaccucaagguccggccaaccuacggcgccggagaaaucaccguacucguagaagucgcagacauggaacuccacacuaaaaagaucgagaucucgggccuaaaauucgcgucacuaaccugcacaggaugcuacgccugcucgucugguaucuccugcaaaguccgaauccaugucgacgaacccgacgaacucaccguucaugucaaaagcgaugaccccgacgucguagcggcaucguccucacuaauggccagaaaacuggaguucggcacagacucaacauucaaggcuuucucugccaugcccaaaacaucacuuugcuuuuacaucgucgaacgcgaauacugcaaaucuugcucuaaagaagacacccaaaaaugcgucaacaccaaacucgaacaaccccaauccauccucauugaacacaaaggcaccaucaucggcaaacaaaacaauaccugcacagccaaaaccaguugcuggcuugaauccgucaaauccuucuucuacggacucaaaaacaugcucucaggcauauucggcaacuucuuuaugggcaucuuccucuuccuugcuccguucauacuucucauccuauucuucauguucggcuggcgcauccucuucugcuucaaaugcugccgccgaacaagaggacucuuuaaauaccgccaccucaaagacgacgaagaaacaggauacagacgaaucauagaacgccuaaacaacaagaaaggcaaaaacaaacuacucgacggagaacgccucgcggaccgccgcaucgcagaacucuucuccacaaaaacccacauagga

SEQ ID NO: 15690 - RNA, 1932 nt, Artificial Sequence
  derived and/or modified CDS sequence (opt11) from CCHFV(VLG/TI29414)__AY179961.1__Gc
uuccuggacagcauagucaaaggaaugaaaaaccuccucaacuccacaaaccucgaaacaucacucagcaucgaggcacccuggggagcaauaaacguccaauccacauucaaacccaccguauccacggcaaauauagcauuaucauggucgucagucgaacaccguggcaacaaaauucuaguaaccgggaggagcgaauccaucaugaaacuagaagaaagaaccggcgucuccugggaccucggggucgaagacgccagcgaaagcaaacuacucacggucagcauaauggaccucagccaaauguacuccccugucuucgaauaccucagcggcgaccgucaaguggaagaauggccgaaagcaacaugcacaggcgacugcccagagcgcugcggcugcacauccaguaccugccuacacaaagaauggccacacagcagaaacuggcgaugcaaccccaccuggugcugggaagugggcacaggcuguaccugcugcggcuggaacguaaaggaccuauucaccgaccacauguucgucaaauggaaagucgaauacauaaaaaccgaagccaucgugugcguagaacuaaccucccaagaacggcaaugcucccucaucgaagcgggaacacgauucaacuuagggccagucaccauaacccuguccgaaccacgaaacauccaacaaaaacuacccccagaaaucaucacgcuccauccaaaagucgaagaggguuucuucgaccucaugcacguccaaaaaguccuuagcgccagcaccgucugcaaacuccaauccugcacccacggcauccccggcgaccuacaagucuaccacauaggcaaccuccuaaaaggcgaccgagucaacggccaccucauccacaaaaucgaaccacacuucaacaccuccuggauguccugggacggcugcgaccucgacuacuacugcaacaugggcgacuggccaucgugcaccuacacgggaaugacacaacauaaccacgcugccuucguaaaccuccucaacaucgaaacagacuacaccaaaacauuccacuuccacucuaagcgagucaccgcucacggcgacacaccccaacuagaccuaaaagccagacccaccuacggagccggagaaaucaccguccucgucgaagucgcagacauggaacuccacaccaagaaagucgaaaucucaggccugaaauuugccucacuugcgugcacuggcugcuacgcuugcuccuccggcaucucauguaaaguccgcauucacgucgacgaaccagacgaacugacaguacacgucaaauccaacgaucccgacguaauagcagccuccacaagccucauggccagaaaacuggaguucggcacagacucuaccuucaaagccuucagcgccaugcccaaaaccucccuguguuucuacaucgcugaacgcgaauacugcaaaucuugcuccgaagaagacacccaaaaaugcguagacacaaaacucgaacaaccacaguccauacucauagaacacaaaggcaccaucauaggcaagcaaaacgauaccugcacagcaaaagccagcugcuggcuugaaagcgucaaauccuucuucuauggccucaaaaacaugcuuggcucagucuucggaaacuucuuuaucggaauccuacucuuccuugcacccuucguucuccucguccucuucuucauguucggcuggaaaauacuauucugcuucaagugcugccgucgcacccgaggccuccucaaauaccgacuacuaaaagacgacgaagaaaccggcuaccgaaggauaaucgaacgucucaacaacaagaaaggcaaaaaccgacuucuggacggagaacgccucgccgaucgaaaaauagcagaacuauucagcaccaaaacccacaucggc

SEQ ID NO: 15691 - RNA, 1932 nt, Artificial Sequence
  derived and/or modified CDS sequence (opt11) from CCHFV(TADJ/HU8966)__AY179962.1__Gc
uuccucgacuccaucgucaagggcaugaaaaacccucuaaacagcaccucacuagaaaccucacuaagcaucgaagcaccauggggugccauaaacguccaaucgacauacaaaccaaccgucagcacggccaacauagcccucucaugguccagcauagaacaucgugguaacaacauacucguaucaggacgaagcgaaucaaucaugaaacucgaagaacgcacagggauaucuggcgaccuaggggucgaagacgccucagaaagcaaacuccucaccgucuccgucauggaccucucgcaaauguacuccccaguauucgaguaccucuccggcgaccggcaaguagaagaauggcccaaagcaaccugcacaggggacugcccagaaagauguggcugcaccuccuccacaugccuccacaaagaauggccccauagccgcaacuggcgcugcaaccccacuuggugcuggggcgucggcacuggcuguaccugcugcggccuagacguaaaagaccuauucauagacuacauguucgucaaauggaaggucgacuacauuaaaacagaagccaucguaugcguagaacuaaccagccaggaacgacaaugcucccucgucgaagccggcacacgcuucaaccucggcccaguaacaaucacccuaucagagccccgaaacauacaacaaaagcucccucccgaaaucaucacucuccacccccgcaucgaagaaggcuuuuucgaccucaugcacgugcaaaagguccucucagcaagcaccgucugcaaacuccaaucgugcacacacggaguccccggcgaccuccaaguauaccacaucggcaaccuccucaaaggagacaaagaaaacggccaucucauccacaagaucgaaccccacuucaacaccucguggaugagcugggacggcugcgaccuagacuacuacugcaacaugggcgacuggcccucaugcacauacacaggaguaacccaacauaaccacgccuccuucgucaaccuccucaacaucgaaacggacuacaccaagagcuuccacuuccacucgaaacgggucaccgcucacggcgacacaccccaacuugaccucaaagcccgccccaccuacggagccggcgaaaucaccguucuaguagaggucgcagacauggaacuccacaccaagaaaaucgaaauaaccggacucaaauucgcaucccucacaugcacgggcugcuacgccugcucgucugggauauccugcaaaguacguauccacgucgacgagcccgacgagcuuaccguccacguaaaauccgacgacccggacguggucgccgccucguccucccuaauggcacgcaaacuggaguucggcacggacuccaccuucaaagccuucuccgcuaugccaaaaaccucccuaugcuucuauaucguagaaagagaauaccgcaaaagcugcagcaaagaggacacccaaaaaugcguuaacaccaaacucgaacaaccccaaucaauauugaucgaacacaagggcacuauaauaggcaagcaaaacaacacaugcaccgccaaggccuccuguuggcucgaauccguaaaaucuuucuucuacggccuaaagaacauguuauccggcaucuucggaaacguauucgucggcaucuuccucuuccuggccccauucauacuccuuauacuauuuuucauguucggcuggcgcauccucagcugcuucaaaugcugcagacgcacacgagggcuacuaaaacaccgccaucucaaggacgacgaagagaccggcuaccgacgaaucaucgaacgacuuaacaacaagaaaggcaaaaauaaacuccuugacggcgaaagacuugcggaccgacgcaucgccgaacucuucuccacaaaaacacacaucggu

SEQ ID NO: 15692 - RNA, 1932 nt, Artificial Sequence
  derived and/or modified CDS sequence (opt11) from CCHFV(Hodzha)__AY223476.1__Gc
uuucuugacucaauagucaaaggaaccaaaaaccuacucaacucaacaucgcuagaaacaucccucuccauugaagcacccuggggagcaaucaacguccaaucaaccuacaagccgaccgucucaaccgcaaacaucgcccuguccugguccagcgucgaacaccgcggcaacaagauacuugucuccggccgauccgaaagcauuaugaagcucgaagaaagaaccggaauaucaugggaccucggggucgaagacgcaagcgaaagcaaacuccuuaccgugagcgucauggaccucucccaaauguacucaccagucuucgaauaccucagcggagaccggcaaguagaagaauggccaaaagcgacaugcaccggcgacugcccagaacgcugcggcugcaccuccucaaccugccuucacaaagaauggccacacucccgcaauuggcgcugcaaccccacuuggugcuggggcgucggaacaggaugcacaugcugcggccucgauguaaaggaucucuucacggauuacauguucgucaaauggaaggucgacuacauaaaaaccgaagcaaucguuugcguagaacucaccucccaggaacgacaaugcucacucgucgaagcaggcacacguuuuaaccugggcccagucacaauaacccugucggaaccucgcaacauccagcaaaaacuacccccugaaauaaucacauugcacccccgcaucgaagaaggauucuucgaccuaaugcacguccagaaaguacuguccgccucaacaguaugcaaacuacaaagcugcacacauggaguccccggcgaccuccaaguauaccacaucggcaaccuccucaaaggcgacaaagucaacggccaccuaauccauaaaaucgagccucacuucaacaccucauggaugagcugggacgggugcgaccuagauuacuacugcaacaugggcgacuggcccagcugcaccuauacgggagucacccagcacaaccacgccucauuuguuaaccuacuaaacauugaaacagacuacacaaaauccuuccacuuccacuccaaacgagucaccgcccacggagacaccccacaacucgaccuaaaagcccgccccacauacggugccggcgaaaucacaguccuugucgaggucgcagacauggaacuccacaccaagaaaaucgagauaacaggccuaaaauucgccucccuaaccugcaccggcugcuacgcaugcuccucagguaucucaugcaaaguacgaauacacguagacgaacccgacgaacuaaccguccauguaaaaucagacgaucccgacguagucgccgccuccaguucccucauggcacgaaaauuagaguucggcaccgacucaacguuuaaagcauucuccgccaugcccaagaccucacuaugcuucuacaucguagaacgagaauacugcaaaagcugcucaaaggaagauacccaaaaaugcgucaacacaaaacucgaacaaccacaaucaauccucauagaacggaaaggcaccauaauuggaaaacaaaauaacacaugcacagccaaagcauccugcuggcuagaaucuguaaagucauucuucuacggccucaaaaacaugcucuccggcauauucggcaacguauucguaggaauauuccuauuccucgcccccuucauccuacuaauccucuucuucauguucggauggcgcauacucuucugcuucaagugcugccgcagaacccgcgggcuauucaaauacaaacaccuaaaggacgacgaagaaaccggcuaccggcgaauaauagaacgccuaaacaacaaaaagggcaaaaacaagcuccuggacggcgaacgacuggccgacaggcgcauagcggaacuauucucaacgaaaacccacaucgga

SEQ ID NO: 15693 - RNA, 1932 nt, Artificial Sequence
  derived and/or modified CDS sequence (opt11) from CCHFV(Kosovo/9553/2001)__AY675511.1__Gc
uuccuagacucgauagucaaaggcaugaaaaaccuacuuaacucaaccagccuagaaaccagccuaagcaucgaggccccauggggcgccaucaacguccagagcaccuucaaacccacagucucgacagcuaacauagcacuuucauggucauccgucgaacaccgcggcaacaaaauccucguaacaggccguagcgaaucaauaaugaaauuagaagaacgcacaggcgucagcugggaccucggcguagaggacgcauccgaauccaaacuccucacagucucaauaauggaccucucccagauguacuccccagucuucgaauaccucuccggcgaccgacaaguagaagaguggccaaaagcaaccugcaccggagacugcccagaacgaugcggcugcaccuccucgaccugccuccauaaagaauggccacacucccgcaauuggagaugcaaccccacaugguguuggggaguaggcaccggguguaccugcugcggagucgacgucaaagaccucuuuaccgaccacauguucguaaaauggaaagucgaauacaucaaaaccgaagccauuguaugcguugaacucacaagccaggaacgucaaugcucccucaucgaagccggcacccgcuuuaaccucggaccagucacuauuacccuauccgaaccacgaaacauccaacagaaacucccgcccgaaauaaucacccuccaccccaaaaucgaagaaggcuucuucgaccucaugcauguccaaaaaguucucuccgccuccaccguaugcaaacuccaauccugcacacacggaauccccggagaccuacaaguauaccacaucggaaaucuacucaaaggagaccgaguaaacggacaccucauccacaagauugaaccgcacuucaacacaucauggaugagcugggacggcugcgaccucgacuacuacugcaacaugggcgacuggccuuccugcaccuacaccggagucacccaacacaaccacgccgccuucguaaaucuacuaaacaucgagaccgacuacaccaaaacguuccacuuccacagcaaacgagucaccgcacacggagacacaccccaacuugaucuaaaagcccgccccaccuacggagccggcgaaaucaccgugcucgucgaagucgccgacauggagcuccacaccaagaaggucgaaaucuccggccugaaauucgcaucccuugcaugcacaggcugcuacgccugcucgucuggcauaucauguaagguccgcauccacgucgacgaaccggacgaacuaacaguccacgucaaaagcuccgaccccgacgucgucgccgcuuccacaucccucauggcacgcaaacucgaguucggcaccgacuccacuuucaaagccuucuccgcaaugccuaaaaccagccucugcuucuacauuguagaaaaagaauacugcaaaucaugcagcgaagacgacacaaagaaaugcgucgacaccaaacuagaacaaccccaguccauacucaucgaacaccgcggaaccauaauaggaaaacccaacgacaccugucccgcaaaaacaagcugcuggcuagaaucaguuaaauccuucuucuacggccucaaaaauaugcuagggucgguauucggcaacuucuuuauaggcauacuacuuuuccuagccccauucuuccucuggaugcucuccuucauguucggauggaaaauacuauucugcuucaaaugcugccgccgcacacgcggccucuucaaauaccgacaccuaaaagacgaugaagaaaccggcuaccgcagaaucauagaaagacuaaacaacaagaaaggcaaaaaccgauuacucgauggagaaagacucgcagaccgaaaaauagcagaacucuuuuccaccaaaacacacaucggg

SEQ ID NO: 15694 - RNA, 1932 nt, Artificial Sequence
  derived and/or modified CDS sequence (opt11) from CCHFV(SPU41/84)__AY900142.1__Gc
uuccucgacucaaucguuaaaggcaugaaaaaccuccucaacucgacaucgcucgaaaccucgcucuccaucgaagcacccuggggcgccauaaacguacaaucaaccuacaaaccaaccguauccacggcaaacauagcacucuccugguccuccgucgagcaccgaggaaacaaaauccucgucucagguagguccgaguccaucaugaaacucgaggaacgaaccggcaucucgugggaccucggcguugaagacgcaagcgaaagcaaacuccucaccguauccgucauggaccuaucgcagauguacucccccguauucgaauaccugagcggcgacagacaaguugaagaguggccaaaagcgaccugcaccggagacugccccgagcgcugcggauguacaucgagcacaugccuccacaaagaauggccccacagccgcaacuggcgcugcaacccaaccuggugcuggggcguaggaaccggcuguaccugcugcggccucgacgucaaagaccuguuuaccgacuacauguucgucaaguggaaagucgaauacaucaaaacggaagccauagugugcgucgaacuaaccucgcaagaacgucagugcucacuaauagaagccggaacgcgcuucaacuuaggccccguaacaaucacacuauccgaaccccgcaacauccaacaaaaacuaccacccgaaaucauaacccuacacccgcgcauagaagaggguuucuucgaccuaaugcacgugcaaaaaguacucuccgccuccacagucugcaaacugcaauccugcacgcacgguguccccggcgaucuccaagucuaucacaucgguaaccuccucaaaggcgacaaggucaaugggcaccuaguccauaagaucgaaccccacuucaacaccuccuggauguccugggacggcugcgaccuggacuacuacugcaacaugggggacuggcccucgugcacguacaccggcgucacccagcacaaccacgccuccuucgucaacaugcuuaacaucgaaacggacuacacaaagaacuuucacuuccacucaaaacgagucacugcccacggugauacaccccagcuggaccugaaagcccgacccaccuauggagccggugagaucacgguccuagucgaggucgccgacauggaacuccauacgaagaaaauugagaucuccggacucaaauucacaucgcuaaccugcacagguugcuacgccugcucaucuggaauaucuugcaaaguacggauccacgucgacgaaccagaugaacucacaguccacgucaaaagcgaggaccccgacguagucgccgcaucaagcucccucauggcccgcaaacuggaguucggcacagacucgaccuucaaagcguucagcgccaugccuaaaaccucccuaugcuucuacauaguugaacgcgaauacugcaaaagcugcucagaagaagacacccaaaaaugcgucaacacaaaacucgaacagccccaaucaauccucauagaacgcaaaggcacaaucaucggcaaacagaacaauaccugcaaagccaaggccggaugcugguuagagagcguaaaaucauucuucuacgggcucaaaaacaugcuuucaggaaucuucggaaacguuuucaucggcaucuuucucuuucucgccccauucauccuccucauacuauucuuuauguuuggcuggcgcauucuauucugcuucaaaugcugccgacggacacgcggacucuucaaauaccgccaccucaaagacgacgaagagaccggcuaccguaagauaaucgaacgccuaaacaacaaaaagggaaagaacaagcuccuagacggggaacgccucgcugaccgacgcauagccgaacucuucuccacaaaaacccacaucggc

SEQ ID NO: 15695 - RNA, 1932 nt, Artificial Sequence
  derived and/or modified CDS sequence (opt11) from CCHFV(UG3010)__AY900143.1__Gc
uaccuagacucaauagccaaaggcaugaaaucacuauuaaacuccaccaaucuagaaaccucccucucaauagaagccccauggggagccaucaacguucaaucgacauucaaaccgacuguaagcgcagcaaacaucgcccucucaugguccuccguagaacaccgcggaaacaaaaucuuagucuccggcagauccgaauccaucaugaaacucgaggagcgcacgggcaucucauggucccucggagucgaagacgccuccgagagcaaaacuuuaaccgucagcguaauggaccucagccaaauguacuccccaguauucgaauaccuauccggcgaucgccaagucgaagaauggcccaaagcaaccuguacuggcgacugccaagaacgauguggcugcacauccagcacaugccuccacaaggaauggccacauagccgcaacuggcgaugcaaccccacguggugcuggggagucggaaccggaugcacuugcuguggccuugacguucgagaccucuucacagauuacaugauggucaaauggaaaguagaauacguaaaaaccgaagcaaucaugugcguggaacuaaccucgcaagagcgccaaugcucccuaaucgaggcaggaacccgauuuaaccuaggccccguaacaaucacacuaucggagccacgcaacauucaacaaagacuccccagcgaaaucguuacccuccaccccaaaaucgaagagggcuucuucgaccucaugcacguccaaaaaguacugucagccuccaccgucugcaagcuccaauccugcacucauggcguccccggagaccuccaaguauaccacgucggcaaccuacuaaaaggcgauaaaguaaacggccacucgauccacaagaucgaaucccacuucaacaccucauggauguccugggacggcugcgaccuagacuacuucugcaacaugggagacuggcccuccugcaccuacaccgguguaacccaacacaaccgcgcagccuucaucaacaugcucaacauagaaaccgacuacacaaaaacauuucacuuccauuccaaacgcgucacagcccacggagacaccccucaacuagaucuuaaggcacguccaaccuacggcgccggcgaaguuaccguacucgucgagguagccgaccuagagcuccacacuaagaaaauagaagucuccggcuuaaaauuugcaucacuaacuugcucaggaugcuacgccugcuccuccggcaucucaugcaaaguuaggauacacgucaacgaacccgacgaguucaccguccacgucaaguccuccgaccccgacguggucgccgccgguucuucccucauggcccgcaaaaucgaguucggcgcagacucgaccuucaaagccuucuccucaaugcccaagaacucccuaugcuucuauaucguggaacgcgauuacugcuccagcugcaccaacgacgacacacaaaaaugcgucgacaccaaacucgaacacccacaguccaucuugaucgaacacaaaggcaccaucaucggcaagcagaacgacacaugcucaaccaaaaccuccugcuggcucgaauccguaaagagcuucuucuacggccucaaaaauaugcuaggaggcaucuucggaaacgucuuccucggcauauuucuguuccuagcacccuucgcccuccuaaucuuuuucuucuuuuucggcuggcgccuccucuucugccuaaaauguugccgccgaacccgcggccuccucaaauacaaacaacucaaagacgaagaagaagccggcuacaagaaaaucaucgaacgacucaacgacaagaaaggcaaaagccgacuauucgacggcgaacgacucgccgaccgcaaaauagccgaacucuucaguaccaaaacccacaucggu

SEQ ID NO: 15696 - RNA, 1932 nt, Artificial Sequence
  derived and/or modified CDS sequence (opt11) from CCHFV(Hy13)__AY900145.1__Gc
uucuccgacucaauagucaaaggcaugaaaaaccuucucaacuccaccucccucgaaacaucacuauccauagaagcccccuggggcgccaucaacguacaaucuacuuucaaacccacuguuucugccgcaaauaucgcccucuccuggucuucagucgaacaccgcggaaacaaaauccuagucuccggccgcagcgaauccaucaugaaacuugaggagcgcacugggaucuccugggaccucggcguagaagacgcaagcgaguccaaacuccuaaccgucagcaucauggacuuaucacaaauguacucacccguauucgaguaccuaagcggcgaccgacaaguagaggaguggccaaaagcaaccugcaccggagacugccccgagcgcugcggcugcaccucaucuacaugccuccacaaagaauggccccacucgcgcaacuggcgcugcaacccaaccuggugcuggggcguugguacaggauguaccugcugcgggcucgacgucaaagaccuguucacagaccacauguucgucaaauggaaaguagaauacauaaaaacugaagccauagugugcguugaacugaccucgcaagagcgccaaugcucacucaucgaagcaggcacccgauucaaccuuggccccguaacaaucacacucuccgaacccagaaacauccaacaaaaacucccacccgaaaucgucacccuccauccgcggauagaagaaggcuucuucgaccucaugcacgugaagaaaguccugagcgcuuccacagugugcaaacuccagucaugcacgcacggcgucccuggcgaccuccaaguauaccacaucggcaaccuacucaaaggcgacaaggucaacggccaucucauccacaagaucgaaccacacuucaacaccuccuggaugagcugggauggcugcgaccuagacuacuacugcaacaugggagacuggccaucaugcucguacaccggaguaacccagcacaaccacgccgccuuugucaacaugcucaacaucgaaaccgacuacacaaaaaucuuccauuuccacagcaagcgcgucaccgcccacggagacacaccccaacucgaccucaaagcccgacccaccuacggcgccggagaaauuacgguacucgucgaagucgccgacauggaauuacauacuaagaaaaucgaaaucagcggccuuaaauucgccucacuuaccugcacaggcugcuacgcaugcuccucaggaauauccugcaaaguccgaauacacgucgacgaacccgacgaacucacuguucacgucaaaagcgaagaccccgacauagucgcggccuccagcucccuaauggcccgcaaacucgaguucggcacagauucgaccuucaaagccuucagcgccaugcccaaaaccucacucugcuucuacaucgucgaacgggaauauugcaaauccugcagcaaagaagacacccagaaaugcgucaacaccaagcucgaacaaccccaaagcauacucaucgaacacaaaggcaccaucaucggcaaacaaaacgacacauguaccuccaaagcaggcugcuggcuagaaucaguaaaauccuuuuucuacggacucaaaaacaugcucuccggcauauucggcaacguguucaucggaaucuuccuauuccucgcacccuucauccuccucauccuauucuucauguucggcuggcgcauccucuucugcuuuaaaugcugccgccgcacacguggccuauucaaauaccgccaucucaaggacgacgaagaaaccggcuacagaaaaauaaucgaacgccuaaacaacaagaaaggcaaaaacaagcuccucgacggagaaaggcuugccgaccgcaaaaucgccgaacucuucagcacaaaaacacacaucggc

SEQ ID NO: 15697 - RNA, 1932 nt, Artificial Sequence
  derived and/or modified CDS sequence (opt11) from CCHFV(Semunya)__DQ094832.1__Gc
uuccucgacuccauagccaagggcaagaaaucacuccucaacucaacaaaccuugaaaccagccucagcauagaagcacccuggggagccauaaacguacaaucaaccuucaaaccaacaguaagcgcagccaacaucgcccuauccuggucauccguagaacaccgcggaaacaaaauccuaguauccggccgcucggagagcauaaugaaacucgaagaacgcacaggaaucucuuggucacucggcgucgaagacgcauccgaaaguaaaacacuaacaguaucaguaauggaccucucacaaauguacucaccagucuucgaguaccucagcggggacagacaaguagaagaauggccaaaagcaacaugcaccggagacugcccagagagaugcggaugcaccucaucaaccugccuccacaaagaauggccccacucccgcaacuggcgaugcaacccgacauggugcuggggcgucggcacaggguguacaugcugcggacuagacguccgcgaccuguucacagacuacaugauggucaaguggaaagucgaauacgucaagacagaagccaucaugugcguggaacuaacaucccaagaaagacaauguucccucaucgaagccggcacacgauuuaaccucggacccgugacuauaacgcucagcgaaccgcgcaauguacaacaacgacuuccauccgaaaucguaacccuacacccuaaaauagaagaaggauuuuucgaccucaugcauguccaaaaaguacucuucugcaaauacagccugcaagccacaucaugcacccacggagucccaggcgaccuccaagucuaccacguaggaaaccucuuaaaaggcgacaaagucaacggccacaguauccacaaaauugaaagccacuuuaacaccucauggaugagcugggacggcugcgaccucgacuauuucugcaacaugggagacuggccauccugcaccuacaccggugucacccaacacaaccgagcagccuucgucaacaugcuaaacaucgaaacggacuacacaaaaacguuccacuuccacagcaaacgcguaacugcacacggagacaccccacaacucgaccuaaaagcgagaccgacauacggggccggcgaagucacaguacucguagaagucgcggaccucgaauuacacaccaaaaagauagaggucuccggccucaaauucgccagccuuacgugcuccggcuguuacgcaugcucguccggcaucuccugcaagguccgaauccacgucaacgaaccggacgaguucaccguccacguaaaaagcaacgacccggacguagucgcagccggguccucccucauggcccgcaaaaucgaauuuggcgcagacagcacuuucaaagccuucucauccaugcccaaaaacucacuaugcuucuacauagucgaacgagacuacugcuccuccugcaccgacgacgacacccaaaaaugcguuaauaucaaacuggaacacccgcaaagcauucuaaucgaacacaaaggcacaaucaucggcaaacagaaugauaccugccccacaaaaacuuccugcuggcuagaauccguuaaaucauucuucuacggacucaaaaacaugcuaggaggcauauucggaaacguauuccucggaauauuccuauuucucgcccccuucgcccuacucauucucuuuuucuucuucggcuggcgccuacucuucugccucaaaugcugccgacgcacacgcggccuccucaaauacaaacaacucaaagacgaagaagaggcaggcuacaagaaaauaauugaacgccuaaacgacaagaagggaaagagccgccucuucgacggagaacgccucgcagaccgaaaaauagcaaaacucuucucaacuaaaacccacaucggc

SEQ ID NO: 15698 - RNA, 1932 nt, Artificial Sequence
  derived and/or modified CDS sequence (opt11) from CCHFV(SPU128/81/7)__DQ157174.1__Gc
uuccuagacuccauagucaaaggaaugaaaaaccuccuaaacucaaccucccuggaaaccucacucucaaucgaagcacccuggggcgccauaaacguacaauccacuuacaaaccgacaguuagcaccgcaaacaucgcccucucuuggucauccguggaacaccgagggaacaaaauccuaguguccggccgauccgaauccauaaugaaacuagaagaacgaaccggcauuuccugggaccucggcguagaagacgccagcgaaagcaagcuccuaacaguaagcguaauggaccuaucacaaauguacucucccgucuucgaauaccugaguggagaccggcaaguagaagaauggccuaaagcaaccugcacaggggacugccccgagcgauguggaugcaccuccagcacaugccugcacaaagaauggccccacucccgcaacuggcgaugcaacccaaccuggugcuggggcgucggcacaggauguaccugcugcggccuagacguuaaagaccuauucaccgacuacauguucgucaaauggaaggucgaauacauuaaaacggaagccauaguaugcguagaacuaaccucccaggaacgacagugcucccucaucgaagccggcacacguuucaaucuaggcccagucacgaucacacucucggaaccccgcaacauccagcaaaagcucccgccagagaucauaacccuccacccgcgaaucgaagaaggcuucuucgaccucaugcauguacaaaagguccuaagcgccagcaccgucugcaaacugcaaucaugcacccacggcgucccgggcgaccuacaaguauaccacaucggcaaccuccuaaaaggcgacaaggucaacggccaccucauacacaaaaucgagccccacuucaacaccuccuggaugagcugggacggcugcgaccucgacuacuacugcaauaugggagacuggccaucguguacauacaccggcgucacccaacacaaccacgcuuccuucgucaauuuacuaaauaucgaaacagacuacacgaaaaacuuccacuuccacuccaaaagggucaccgcccacggagacacgccacaacucgaccucaaagcacgcccgaccuauggcgccggagaaaucacgguccuagucgaagucgcagacauggaacuucacaccaagaaaaucgaaauaucaggccucaaauucgccucccuaacuugcacuggcugcuacgcaugcucguccggcaucucaugcaaagucagaauccaugucgaugaaccagacgaacucacaguccacguaaaaagugacgacccugacguggucgccgcauccucaucccuaauggcacgcaaacuggaguucgguacggacuccaccuucaaagccuucucagccaugccaaaaaccucccuauguuucuacaucguggaacgagaacauugcaaaagcugcucagaggaagacacaaagaaaugcgucaacacaaaacucgagcaaccacaauccauacuaauagaacacaaaggcacaaucaucgguaagcaaaauagcacaugcacugccaaagcauccugcuggcucgagagcgucaaauccuucuuuuacggccuuaaaaacaugcucucaggcauauucggcaacguauucauaggaaucuuccucuuccucggacccuucauccuucucauccuauucuucauguucggcuggcgcauccucuucugcuucaaaugcugccgacgcacccgaggccucuugaaauaccgccaccucaaagaagacgaagagaccggguaccggcgcaucaucgaacgccucaacaacaagaaagguaaaaacaaacuccucgacggcgaacgccucgcagaccgccgcaucgcagaacucuucagcaccaaaacgcacaucggc

SEQ ID NO: 15699 - RNA, 1932 nt, Artificial Sequence
  derived and/or modified CDS sequence (opt11) from CCHFV(ROS/HUVLV-100)__DQ206448.1__Gc
uuccucgacuccaucgucaaaggaaugaagaaccuccuaaacuccacaagccucgaaaccagccuguccaucgaagccccuuggggugccaucaacguacaauccacauucaaacccacaguaagcacggcuaacaucgcacuaagcuggucgagcguagagcaccgaggcaacaaaauucucguaacagggcgcagcgaauccaucaugaagcucgaggaacgaacuggagucuccugggaccuaggaguagaggacgccagcgagucuaagcuacuaaccguguccauaauggaccucucacaaauguacucacccguauucgaauaucucuccggcgaccgacaaguggaagaauggcccaaagcuaccugcaccggcgacugccccgaacgcugcggaugcacuuccagcaccugucuccacaaagaauggccccacagccgaaacuggcgauguaaccccacauggugcuggggaguaggaaccgguuguaccugcugcggcguagacgucaaagaccuauucacagaccacauguucgucaaauggaaagucgaauacaucaaaacagaagccauugucugcguagaacucacaucacaagagaggcaaugcagucucauagaagcagguacacgauucaaccuaggccccguaaccaucacacugucagagccccgaaauauccaacaaaaacucccgcccgaaaucauuacucuacacccaaaagucgaggaaggcuucuucgaccucaugcacguccaaaaaguacucagcgcguccacagucugcaaacuccaauccugcacccacggaauccccggcgaccuccaagucuaccacaucggcaaccuccucaaaggagaccgcgugaacggccaccucauccacaagaucgaaccacacuucaacaccucguggauguccugggacggcugcgaccucgacuacuacugcaacaugggcgauuggccauccugcacauacacaggcgucacacagcacaaccaugcagccuucgucaaucuccucaacaucgaaacagacuacacaaaaaccuuccacuuccacuccaaacgcgucacagcccacggagacacaccucaacuagaccucaaagcacgacccacuuacggugccggcgaaaucacaguccuggucgagguagccgauauggaacuccacaccaagaaaguagagauaucaggucugaaauuugccucacucgcuugcacaggcugcuacgccugcuccuccggaauaucaugcaaaguacgaauccacgucgacgaaccagacgaacucaccguccacguuaaauccuccgaccccgacgucgucgccgccuccaccucccucauggcccgaaaacuagaguucgggaccgacucaacuuucaaagcauucucggcgaugccaaaaaccucccucugcuucuacaucguagaacgagaauacugcaaauccugcucagaagaagacacccaaaaaugcgucgacacaaaacucgaacaaccgcaguccauacuaaucgaacacaaaggcaccauaaucggcaaacaaaacgauaccugcacagccaaagccagcugcuggcucgaaagcguaaaaucauucuucuacggccucaagaacaugcuaggcucagucuucggaaacuucuucaucggcauccuccuauuccucgccccauucguccuccucguccucuucuucauguucggauggaaaauccucuucugcuucaaaugcugccgaagaaccagagggcuccuaaaauaccgccuccugaaggacgacgaagaaaccggauacaggcgcauaaucgaacggcugaacaacaagaaaggcaaaaaccgccuacucgacggcgaacgacuagcagacagaaaaauagccgaacuauucuccaccaaaacccacaucggc

SEQ ID NO: 15700 - RNA, 1932 nt, Artificial Sequence
  derived and/or modified CDS sequence (opt11) from CCHFV(AP92)__DQ211625.1__Gc
uuccucgacucaauagccaagggagucaaaaaccuccuaaacucgacaucacucgaaaccucccuauccauagaagcccccuggggcgcaauaaacgcccaauccacuuacaaaccaacagccaguucagccaacauagcacuuacguggucauccguagaacaccgagggaacaaaauccucguaucgggccggagugaaagcauaaugaagcuagaagaaagaaccggcaucuccuggaaccuuggcgucgaagacgccagcgaaucacgaacccuaacaaucuccgucauggaccucucgcaaauguacucgccagucuucgaauaccucaguggcgaccgccaagucgaagaguggcccaaagccacuugcacaggcaacugccccgaacgaugcggaugcaccucguccacaugccucuauaaggaauggccccacagcagaaacuggcgcugcaaccccaccuggugcuggggagucggcacaggauguaccugcugcggccucgacguuaaagaacucuucaccgaccacaugcuagucaaauggaagguagaguacaucaaaaccgaggcaauaguaugcgucgaacuuacaucccaagaacgucaaugcagccucauagaggccggaacgcgauucucccucggcccagucacaaucacccuaucggaaccccgcaacauccaacaaaaacuaccgccagagcucaucacacuucacccuaaaaucgaagacggcuacuucgaccucaugcacguccaaaaaguaauguccgccuccacuguaugcaaacuccaaucgugcacccacggcgucccaggcgaccuacaaaucuaccacgucgggaaccuucucaagggcgaccgcguuaacggacaccucauccacaaggucgaaccccaccuaaacaccuccuggaugucuugggacggcugcgaccucgacuacuucugcaacaugggggacuggccauccugcacauacaccggagucacccagcacaaccacgccgcuuucgccaacuuacucaacaucgaaaccgacuacacaaaaacauuccauuuccacuccaaacgggucaccgcccauggcgacaccccacagcuagaccuuaaagcacgcccccgcuacggcgcuggugagaucacaguccuggucgaagucgcagacauggaacuccacacuaagaaagucgaagucacggggcuaaaauucgccucccugacaugcuccggaugcuaugccugcagcagcgggauaucaugcaaaguccgaauacacgucgacgaacccgacgaacucaccguacauguaaaauccucagacccagacauugucgcagcaucaucuucgcuuauggcccgcaaaaucgaguucggaguagacucaacauucaaagcguucagcucaaugccaaaagacucacucugcuucuauaucgucgaacgcgacuacugcaacucaugcaagaacgaagagacacaacgcugcguaaacgccaaacucgaacaaccucaaucaauccuaaucgagcacaccggaacaauaauaggcaaacagaacgauaccugcggaagcaggaccuccugcuggcuagacagcuuuaaauccuucuucuacggacucaaaucaauguuauccggcauauucgggaacguauuccuggguauauuccucuuccucgcuccauucgcacuucuacucuucuucuucuucuucggauggcgaauacucuucugcuucaaaugcugccguagaacgcgcggccuauucaaauaccgccauaucaaagacgacgaagaagucggguacaaaaagaucaucgaacgccucaacaacaaaaagggcaaacaucgccuccuagacggagaacgacucgcagaccggaaaauagcagaacucuucagcacaaaaacacauaucggc

SEQ ID NO: 15701 - RNA, 1932 nt, Artificial Sequence
  derived and/or modified CDS sequence (opt11) from CCHFV(ArD8194)__DQ211626.1__Gc
uuccucgaccgaauagcaaaaggcaugaaaucacugcucaacucaaccucccucgagacaucacucagcaucgaagcaccauggggcgccauaaacgugcaauccaccuucaaaccaaccgucuccgccgccaacauagcacucuccuggucaucaguagaacacaaaggaaacaagauccucgugucgggccggagcgaaagcauaaugaaacuagaggaacgcacaggcaucucauggugccuagguguagaagacgcauccgaguccaagacucucacaguaagcgugauggaccuaucacaaauguacuccccagucuucgaauaccuaucuggcgaccgacaagucgaagaauggcccaaagccacuugcacaggggacugccccgaacgcugcggaugcaccuccuccacuugccugcacaaagaguggccccacucccgcaacuggcgcugcaaccccaccuggugcuggggcguaggcaccggcuguaccugcugcggccuggacgucaaggaccuauucaccgacuacaugcuugucaaauggaaaguagaauacauaaaaaccgaagccauaauuugcgucgaacuaaccagccaagaaagacagugcucauuaauagaagcuggcacccgcuuuaaccucggcccggucaccauaacacuuuccgaacccagaaauguccaacaacggcucccacccgaaauaauaacacuacaccccaaaauagaagaaggcuucuucgaccucaugcacguacaaaaaguaaugagcgccuccaccguaugcaaacuccaauccugcacccacggaguccccggcgaccuccaggucuaccacgucggcaaccuccucaaaggcgacaaggucaacggacacagcauccacaaaauagaaucccaccugaacacauccuggaugagcugggacggaugcgaccuagacuacuucugcaauaugggggauuggccauccugcacauacaccggagucacccaacacaaccacgccgccuucaucaacaugcuaaacauugaaacugacuacacaaaaaccuuccacuuccacucgaaacgcguaaccgcccacggcgacacaccccaacucgaccuaaaagcgcgccccgccuauggcgcaggcgaaaucaccguccucguagaggucgccgaccuggaacuccacaccaagaaaaucgaagucuccggacuaaaauucgccucacucuccugcucaggcugcuacgccugcuccucagggauauccugcaaaguccgcauccacgucaacgaaccagacgaauuuaccguucacgucaaaucuaacgaccccgacgucguagccgccggaaguagccucauggcccgcaaaaucgaaucaggcgcagacucaaccuucaaagccuucucauccaugcccaaaaacucccuuugcuuuuacauuguggaaagggacuacuguucgagcugcaccgacgacgacacccaaaaaugcgucgacauuaaacucgaacacccccaauccauacugaucgaacacaaaggcaccauaauaggcaaacaaaacgauaccugcccaaccaaaacuuccugcuggcuagagagcaucaaaaguuucuucuacggccucaagaacaugcucuccgguauauucggcaacgucuuccugggcaugcucuuauuccuagcccccuucauccuccucauccucuucuucuucuucggcuggcgacuucuguucugccucaaaugcugccgccguacccgaaaacuacucaaauacaaacaccuccgcgacgaagaggaaaguggcuacaagaagaucaucgaacgccucaacgacaagaaaggcaaaagccgccucuucgacggcgaacgucucgccgaccgaaaaauagccgaacuauucucuaccaaaacccacauaggc

SEQ ID NO: 15702 - RNA, 1932 nt, Artificial Sequence
  derived and/or modified CDS sequence (opt11) from CCHFV(ArD15786)__DQ211627.1__Gc
ucacuagacucaauagccaaaggaaugaaaucacuucucaacagcaccagccucgagaccucccucuccaucgaagcacccuggggagccaucaacguccaaucuacauucaaacccaccaucucagcggccaacauagcacuaucaugguccucagucgaacauaaaggaaacaaaauacucguauccggccgcuccgaauccaucaugaaacuugaggaacgcaccgguaucucauggugccuaggggucgaggacgcgagcgaauccaagacacuaaccgucuccguuauggaccucucccaaauguacuccccugucuucgaauaccuguccggcgaccgccaagucgaggaauggccaaaagccaccuguaccggagacugucccgaacgaugcggcugcaccuccagcacaugucuccacaaagaauggccccacucccggaacuggcgcugcaauccgaccuggugcuggggcgucggaaccggcugcacgugcugcggacuagacgucaaagaccuauucaccgacuacaugcuugucaaauggaaggucgaauacauaaaaaccgaagccaucaucugcgucgaauuaaccucgcaagaacgccaaugcucacucauagaagccggaacccgcuucaaccuggggcccgucacaaucacacucucugagccccgcaacguucaacaacgccucccaccugagaucauaacccugcacccuaaaaucgaagaaggcuucuucgaccucaugcacguccaaaaagucaugagcgcaagcacagucugcaaacuacaaucgugcacccacggcguacccggcgaccuacaagucuaccacgucggcaaccuucucaaaggcgacaagguuaacggccacuccauacacaaaauugaaucacaccucaacaccuccuggauguccugggacggaugcgaucuagacuacuucugcaauaugggcgacuggcccucgugcaccuacaccggcgugacucaacacaaccgagcagccuucaucaauauguuaaacauagaaaccgacuacaccaaaaccuuccacuuccacucaaaacgcgucaccgcccacggagacacaccccagcuagaccuaaaagcccgaccaaccuacggagcuggcgagaucacaguccucgucgaaguagcggaccucgaacuacacacaaagaaaauugagguuucaggacucaaauucgccucccuaaccugcuccggaugcuacgcaugcuccagcgguauaucgugcaaaguucgcauacacgucaacgaaccggacgaguucaccguccaugucaaaagcaacgacccggacgucguagcagccggcuccagccuaauggcacgaaaaaucgaauccggcgccgacucaacauucaaagcauucucgucaaugcccaaaaacagccuaugcuucuacaucguugaacgagacuauugcuccuccugcacagacgacgacacccaaaaaugcguagacaucaaacucgaacacccacagucaauccucaucgaacacaaaggaaccauaaucgguaaacaaaacgauaccugcccaaccaaaaccagcugcuggcucgagagcaucaaaucguucuucuacggccucaagaacaugcucuccggcaucuucggaaacaucuuucucggcaugcucuuauuccuagccccuuucguccuccuuauccucuucuucuucuucggcuggcgacuccuauuuugccucaaaugcugccgaagaaccagaaaacuccucaaauacaaacaccuccgagacgaagaagagucaggcuacaagaaaaucauagaacgccucaacgacaagaagggcaaaucccgccuauucgacggagaaagacucgcggaccgcaaaaucgcugaacucuuuuccacaaaaacccacgucggc

SEQ ID NO: 15703 - RNA, 1932 nt, Artificial Sequence
  derived and/or modified CDS sequence (opt11) from CCHFV(ArD39554)__DQ211628.1__Gc
uuccuagacuccaccgccaaauccaugaaaucacuccuaaacuccacaucccucgaaaccucgcuuucuaucgaggcccccuggggagccauaaacguccaauccacauucaaaccgaccgcaagcacggccaacaucgcacucucauggucuagcguggaacaccgcggaaacaaaauccuuguaaccggcagaagcgaaucaauaaugaaacucgaggaacgaaccggaaucucauggaaccuuggcgucgaggacgccucagaaagcaaaacccucacagucucugucauggaccucucccaaauguacucaaccgucuucgaauaucugagcggagaccgacaaguagaggaauggccgaaagcaacauguaccggagacugcccagaacgaugcggaugcacaucaucaacaugccugcacaaggcauggccccacucccguaacuggcgaugcaaccccaccuggugcuggggcgucggcacgggcuguaccugcugcggucuagacgucaaaaacuuauucacggacuacauguuaaucaaauggaaaguagaguucaucaaaacugaagcuaucguaugcguagaacugaccagccaagagcggcagugcucacucaucgaagccggcacccgcuucaaccugggacccgucacaaucacacuauccgaaccccgaaacauccaacagaaacucccacccgaacucgucacacuccacccccgcguagaagaaggcuucuucgaccucaugcacguccagaaaguacuaagcgccuccaccguaugcaaacuccaauccugcacacacgggguccccggcgaccuucagguauaccacgugggcaaccuacucaaaggggacaaaaucaacggaaacucauuccacaaaaucgaaccaaaccucaacacuuccuggauguccugggacggcugcgaccucgacuacuacugcaacaugggcgacuggcccucgugcacauacacaggcgucacccagcacaaccacgccgccuuuguaaaccuccucaacaucgaaacggacuacaccaaaaacuuccacuuccacucaaaaaggguuacagcccacggcgagacaccccaacuagaccuuaaagcacgccccaaauacggggccggcgaaguaacaguccuagucgaagucgcggacauggaacuacacaccaaaaagaucgagaucuccggccuuaaauucgcuagccucacuugcacaggcugcuacgccugcucauccggcaucucgugcaaaguccggcugcacgucgacgaacccgacgagcucacaguccacgugaagagugacgacccggacgucguagcagccucgagcagccucauggcuagaaagauagaauuuggaacggacuccacuuucaaagcguucucaagcaugcccaaggacaagcuaugcuucuauaucgucgaacgagacuacugcagcuccuguucaaaggaagacacccaaaaaugcgucaacgcuaaacucgaacaaccccaaucgauccucaucgaacacaagggcaccaucaucggaaaacaaaacgacacaugcaccgucaaggccuccugcuggcucgaaucaguaaaguccuucuucuacggccucaaaaacaugcucggagguaucuucggcaacgucauacuaggcaucaucauguuccucgccccauucgcccuccuucuacucuucuuccuauuuggauggcgcauacucuucugucuccgcugcugccgcagaacccgcgggcuauucaaauauaaacauauaaaagacgacgaagaaucaggauauaaacgcauaauagaacgccuaaacaacaaaaagggcaaaaacaaacucuuugacggcgaacggcucgccgacaagaaaauagccgagcuuuucucaacgaaaacgcacaucggg

SEQ ID NO: 15704 - RNA, 1932 nt, Artificial Sequence
  derived and/or modified CDS sequence (opt11) from CCHFV(C-68031)__DQ211629.1__Gc
uucuccgacagcaucguuaaaggcaugaaaaaccuccucaacuccacaagccucgaaacaucacucucgauagaagcaccuuggggcgccaucaacguccaauccacguucaaacccaccguguccgcggcaaauaucgcccucucauggucauccgucgaacaccgcgggaauaaaauccucguguccgggcgcagcgaguccauaaugaaacucgaagaacgaacuggaaucucgugggaccuaggcguagaagacgcauccgaauccaaacuccucacggucagcauaauggaccuaucgcagauguacucccccgucuucgaguaccucuccggggaccggcaaguugaagaauggccaaaagcaacuugcacaggcgacugcccggaacgaugcggcuguaccucgagcacaugccuacacaaagaauggccccacucaagaaauuggcgcuguaaccccaccuggugcuggggugugggaacaggauguacaugcuguggacucgacgucaaagaccuguucacagacuacauguucgucaaguggaaagucgaauauaucaaaacagaagcaaucgucugcgucgaacucacaucgcaagagcgccagugcucccucauagaagcagguacacgcuucaaccuaggccccguaaccauaacacucagcgaaccucgcaacauccagcaaaaacuaccacccgaaaucgugacccuacacccccgaauagaggagggcuucuuugaccucaugcaugugaagaaaguacuaagugcaagcacagucugcaaacuccaaucaugcacacauggcgucccgggcgaccuccaggucuaucacauaggcaaccuacucaaaggcgacaaagugaacggacaccucauccacaaaaucgaaccccacuucaacacuucauggauguccugggacggaugcgaccucgacuacuacugcaacaugggcgacuggccauccugcagcuacaccggagugacccaacacaaccacgccgccuucgucaauaugcugaacaucgagacagauuacacaaaaaucuuccacuuccacucaaaaagagucaccgcccacggcgauacuccccaacuagaccucaaagcgcgaccaaccuacggcgccggcgaaaucacaguccuagucgaagucgccgauauggaacuccacaccaagaaaaucgaaaucucaggcuuaaaauucgcgucccuaaccugcacaggcugcuacgcaugcucaucaggcaucucaugcaaaguaagaauccacgucgacgaacccgacgaacucaccguccacgucaaaucagaagacccagacauaguagcggcauccuccucacucauggcccgcaaacuagaguucggcaccgacuccaccuuuaaagccuuuucagcuaugccaaaaaccucccucugcuucuacaucgucgaaagagaauacugcaaguccuguagcaaagaagacacccaaaaaugcgucaacaccaaacucgaacaaccacaaucaauccuaaucgaacacaaaggaacaaucauaggcaaacaaaacgacacauguacuuccaaagccggaugcuggcuagaauccgucaaaucauucuucuacggacucaagaacaugcucagcggcaucuucggcaacgucuuuaucggcauauuccucuuccuggcucccuucauacuacuaauccucuucuucauguucggcuggagaauccucuuuugcuuuaaaugcugccgacgcacccgcggacucuucaaauaccgccaccucaaggacgacgaagagaccggcuaccgcaaaaucaucgaaaggcucaacaacaagaaaggcaaaaacaaacuccuagacggcgaaagacuagcagaccgaaaaaucgccgaacucuucagcaccaaaacacacaucgga

SEQ ID NO: 15705 - RNA, 1932 nt, Artificial Sequence
  derived and/or modified CDS sequence (opt11) from CCHFV(Drosdov)__DQ211630.1__Gc
uuucuggauucaaccgucaaaggcaugaaaaaucuacuaaacucaacaucgcuagagacaucacuauccaucgaagccccuuggggagcaaucaacgugcaaucgacauucaaaccaacagucagcacagcaaacauagcccuauccuggagcuccguggagcaucgcggaaacaaaauccucguaaccggccgcagcgaaagcaucaugaaacucgaagaacggacuggagucagcugggaccucggagucgaagacgccagcgagagcaaacuccuuaccgucucaaucauggacuugucccaaauguacucacccguauucgaauaccuaucaggcgaccggcaagucgaagaauggccuaaagcgaccugcaccggcgauugcccagaaagaugcggcugcaccuccucaacaugccuccauaaagaauggccccacagccgcaauuggcgcugcaaccccacauggugcuggggagucggcaccggcugcacgugcugcggagucgacguaaaggaccuuuucaccgaccacauguucguaaaauggaaagucgaauacaugaaaacagaagccaucgugugcguggaacucaccucacaagaacgccaaugcucccucauugaagccggaacccgcuucaaccuaggacccgucacaaucacacucucagaaccacgcaacauucaacaaaaacuaccgccagagaucauaacccuacaccccaaaaucgaagaaggcuucuucgaucucaugcacguacaaaaagucuuaagcgccuccaccgucugcaaacuacaaucaugcacccacggcaucccgggcgaccuccaaaucuaccacauaggaaaccuacucaaaggcgaccgugugaacggccaccuaauacacaaaaucgaaccacacuucaauacuuccuggaugagcugggauggaugcgaccucgacuacuacugcaauauggguaacuggccauccugcacauacaccggaguaacccagcacaaccacgccgccuucgucaaccuccucaacaucgagaccgacuauacaaagacauuccacuuccacuccaaacgcgucaccgcacacggcgacacaccucagcuagaccucaaagcaagacccacauacggcgcaggggagauuacaguccuaguagaaguagccgacauggaacuccacacaaagaaagucgaaaucuccggccuaaaauucgccuccuuaguuugcaccggcugcuacgcaugcucaagcggcauaucgugcaaaguacguauccacgucgacgaaccugacgaacucacaguacauguaaaauccucagaccccgacguagucgcagccuccacaucccucauggcccgcaaacucgaguucggaacagacuccauauucaaagcauucuccgccaugcccaaaaccucacucugcuucuacauagucgaacgagaauacugcaaauccugcagcgaggacgacaccaagaaaugcgucgacaccaaacucgagcaaccccaaucaauccucauagagcacaagggcacuauaaucggaaaacaaaacgacacaugcacagcaaaagcauccugcuggcuagaauccgucaagagcuucuucuacgggcucaaaaacaugcucggauccguguucggcaacuucuuugucggcauccuacucuuccuugcccccuucguccuccugguccuauuuuucauguucggcuggaaaauccucuucugcuucaaaugcugccgacguacccgcggccuauucaaauaccgccaccucaaagacgacgaagaaaccggcuaccgacggauaauagaacgacuaaacucuaagaaaggcaaaaacagacuacuggacggcgaaagacucgccgaccgcaaaaucgcagaacucuucagcacgaaaacacacaucggc

SEQ ID NO: 15706 - RNA, 1932 nt, Artificial Sequence
  derived and/or modified CDS sequence (opt11) from CCHFV(Kashmanov)__DQ211631.1__Gc
uuccucgacucaaucguaaaaggcaugaaaaacucucuaaacucgacaucccucgagacuucucuaagcaucgaggcaccauggggagcaauaaacguccaauccaccuuuaaacccacggucucaaccgccaauaucgcccucucaugguccagcguagaacaccgggggaacaaaauccucgucaccggacguagcgaaucaauuaugaaacucgaggaacggaccggcgucuccugggaccuaggugucgaagacgccuccgagucuaaacuccuaaccgucuccauaauggaccuaucacaaauguacuccccaguauuugaauaccuaagcggagacagacaagucgaagaguggcccaaagccacuugcaccggcgacugcccagagcgcuguggcugcaccucuagcacgugccuucacaaagaguggccacacagccgcaacuggcgcugcaaccccaccugguguuggggcgucggcaccggcuguaccugcugcggagucgacgucaaagaccucuucaccgaccacauguuugucaaauggaaggucgaguacaucaaaaccgaagcaaucguaugcgucgaacucacaucacaagaaagacaaugcucccuuauagaagcaggaacccgcuucaaccugggcccggucacaauaacucucuccgaaccccgaaacauccagcagaaacucccacccgagauaauuacccuccaccccaaagucgaagaaggcuucuucgaccuuaugcacguccaaaagguacuaucagcauccaccgucugcaaacuccaauccugcacacacggaauccccggcgaucuccagguuuaccacaucggcaaccuacugaaaggggaccgaaucaacggccaccucauacacaaaaucgaaccccacuucaacaccuccuggauguccugggacggaugcgaccucgacuacuacugcaacaugggcgacuggcccuccugcacauacaccggcguaacccaacacaaccacgcagcguucguuaaccuccugaacaucgagacagacuacacaaaaacauuccauuuccacucgaagcggguaacagcacacggagacacaccccaacuugacuugaaagcacgccccaccuacggcgcuggcgaaaucaccguucucgucgaagucgccgacauggaacuccacacaaagaaagucgagaucucaggacucaaauuugcaucucuagccugcaccggcugcuaugccugcucaagcggcaucuccugcaaagucagaauccacgucgacgaaccagacgaauuaaccguccacguuaaguccucagacccugacgucgucgccgcaucaacaucccuuauggcucgcaaacucgaguuuggaaccgacagcaccuucaaagccuucuccgccaugcccaaaaccagucucuguuucuacaucguugaacgggaauacugcaaaucaugcuccgaggaagacacccaaaaaugcguagacaccaaacuagagcaaccccaaagcauccuaauagaacacaaaggcaccauaauaggcaaacaaaacgauaccugcaccgccaaagcauccugcuggcucgaaagcgucaaauccuuuuucuauggccucaaaaacaugcucggauccgucuucggaaauuucuucauaggcauccuacuauuccuagccccauucguccuccuaguccucuucuucauguucggcuggaaaauacucuucugcuucaaaugcugcaggcgcacacgcggccuccuaaaauaccgccaccucaaagacgacgaggaaacuggauaccggcgcaucaucgaacgacuaaacaacaaaaagggcaagaaccgacuacuggacggggaacgccuagccgaccgaaaaauagcagaacucuucucaacaaagacacacaucggc

SEQ ID NO: 15707 - RNA, 1932 nt, Artificial Sequence
  derived and/or modified CDS sequence (opt11) from CCHFV(Oman)__DQ211632.1__Gc
uuucucgacagcaucgccaaaggcaugaaaaaccuacucaacuccacaucacucgaaacuucccuauccaucgaagccccauggggagccaucaacguccaguccaccuucaaaccaaccguauccaccgccaauaucgcccucuccugguccagcguagaacacagaggaaacaaaauccucguaucgggccguucggaauccaucaugaaacucgaagaacgcacaggaaucuccugggaccuggguguagaagacgccuccgaaagcaaacuucucaccguauccgucauggaccuaucacaaauguauucacccguuuucgaauaccucagcggcgaccgccagguggaagaauggcccaaagccacaugcaccggagacugccccgaacgcugcgguugcaccuccuccacgugccuacacaaagaguggccccacucgcgaaacuggagaugcaacccaaccugguguuggggagucggcaccggauguaccugcugcggauuagacgucaaagaccucuucacagacuauauguucguaaaguggaaggucgaguacauaaaaacagaggcgaucguaugcguugagcucacaucccaagaacgccaaugcucccucaucgaagcggguacccgcuuuaaccucggccccgucaccauuacacucucagaaccaagaaacauccaacaaaaacuaccaccagaaaucgucacacuccauccccgcauagaagaaggcuucuucgaccugaugcacguccaaaaaguacuaucagccucaacagucugcaaacugcaaucaugcacccacggcgucccaggugaccuccaagucuaccacaucgguaaccuccucaaaggcgacaaagucaacggccaccuaauccacaaaguagaaccccacuucaacacguccuggaugucuugggacggcugcgaccucgacuauuacugcaacaugggagacuggcccagcugcaccuacacaggcguuacacagcacaaccacgccgccuucgucaaccuccucaauaucgaaaccgauuacaccaagaauuuccacuuccacucgaagcgcgucaccgcgcauggcgacacaccccaacucgaccugaaagcccgccccaacuacggagccggagaagucacaguccuggucgaaguagcggacauggaacuucacaccaagaaaauugaaaucagcgggcuaaaauucgccucccuaaccugcaccggcugcuacgccugcuccuccggcaucuccugcaaaguccgcauccacguagacgaacccgacgaacucaccguccaugucaaaagcgaagaccccgacaucgucgccgcaucaucaucacucauggcccgcaaacucgaguucggaaccgacucaaccuucaaggcuuucucagccaugcccaaaaccucccucugcuucuacauagucgaacgcgaguacugcaaaaguuguucaaaagaagacacucagaaaugcguuaacgccaaacucgaacgcccccaauccauacuaaucgaacacaaaggaacaaucaucggcaaacaaaacgauaccugcaccgccaaggcuuccugcuggcucgagucagugaaaucguucuucuacggacugaaaaacaugcuaucaggcaucuucggcaacguauucauaggaaucuuccuauuccuggcccccuucauccuccucauccuauucuucauguucggauggcgcauccuauucugcuucaaaugcugccgccgcaccagagggcuauucaaauaccgccaccucaaggacgacgaagaaacaggauacagaaaaaucaucgaacgacuuaauaacaagaaaggcaaaaacaaacuacuagacggagaacgccucgccgaccgaaaaaucgccgaacucuucuccaccaaaacccacaucggc

SEQ ID NO: 15708 - RNA, 1932 nt, Artificial Sequence
  derived and/or modified CDS sequence (opt11) from CCHFV(SPU97/85)__DQ211633.1__Gc
uuccucgacucuauagucaaaggcaaaaagaaucuacucaacuccaccucccucgaaaccucccuauccauagaagcuccauggggcgcuaucaacguccaaagcaccuucaaaccaacagucuccgccgccaacaucgcucuauccuggagcucuguagaacaccgcgggaacaaaauacugguauccggccgauccgaguccauaaugaagcucgaagaacgaaccgggauauccugggaccucggagucgaagacgccuccgaaaguaagcuccugaccguauccgucauggaccucucccaaauguacagcccagucuucgaauaccucucuggagaccgacaggucgaagaauggccaaaggcuaccugcacuggcgacugccccgagcgcugcggaugcacaucaucaaccugccuccacaaggaauggccccacuccagaaacuggcgaugcaaccccacauggugcuggggcguaggaaccgguugcacgugcugcggccuagacguaaaggaccuauucacagauuacauguucguaaaauggaaagucgaguacauaaaaacagaagcuauagucugcgucgaacuaaccagccaagaaagacagugcucccuaaucgaagcuggcacacgcuucaaccucgggccaguaaccaucacccugagcgaaccccgcaacauccagcaaaaacugcccccagaaaucauaacccuccacccgcgcauagaagaaggcuucuucgaccucaugcacguccaaaaaguucucagcgccagcacaguaugcaaacuccaauccugcacccacggcgucccgggagaccuccaagucuaucacauaggcaaccuccucaaaggcgacaaggucaacggacaccugauccacaaaauagagccacacuuuaacacauccuggauguccugggacggcugcgaccuagacuauuacugcaacaugggcgacuggcccuccugcaccuacacaggcgucacacaacacaaccacgcggcuuucguaaacuuacugaacaucgaaaccgacuacaccaaaaacuuccacuuccacagcaaacgagucacagcacacggcgacacuccccaacucgaccuaaaagcaagaccaaccuacggcgccggagagguaaccguccuagucgaagucgccgacauggaauuacacaccaaaaagaucgaaaucagcggacucaaguucgccucgcuauccugcaccggaugcuacgcgugcuccuccggaaucagcugcaaaguccgcauacacguagacgaaccagacgaacucaccguacacgucaaaucagaagacccagauaucguagcagcaggaucuucacucauggcccguaaacuggaguucggugccgacagcaccuucaaagcauucuccgccaugcccaaaaccucacuaugcuucuacaucguggaacgggaauacugcaaaaguugcucccgagaagacacccaaaagugcgucaacacuaagcuagagcggccccaguccauccucaucgagcacaaaggcaccauaauaggaaaacagaacgacacaugcaccgcaaaagccuccugcuggcuagaauccguaaagagcuucuucuacggacuaaaaagcaugcucucaggaaucuuuggcaacgucuuuauagggauauuccuguucauagcaccauucguccuucucauccuauucuucauguucggcuggcgaauccuguucugcuucaaaugcugccgcagaacacgcggacucuucaaauaccgccaccuuaaagaugacgaagaaaccggauaccgcaaaaucauagaacgccucaacaacaagaaaggcaaaaacaaacuccucgacggcgaacgccuagcugaucgaaaaaucgccgaacucuucuccaccaaaagccacaucggc

SEQ ID NO: 15709 - RNA, 1932 nt, Artificial Sequence
  derived and/or modified CDS sequence (opt11) from CCHFV(SPU103/87)__DQ211634.1__Gc
uuccuggacaacauuguuaaaggcaugaaaaaccuccugaacuccacaucacucgaaacaucccucucgaucgaagccccguggggcgccaucaacguccaauccaccuacaaacccacggugagcaccgccaacauagcccucucaugguccagugucgaacaccgcggcaacaaaauccucgucuccggacgcuccgaaagcauaaugaagcucgaggaacgaaccggaauuucuugggaccuuggagucgaggacgcauccgaaagcaaauuacucaccguaagcgucauggaccuaagucaaauguacucacccguuuucgaauaccugucgggagaccgccaaguagaggaguggcccaaagcgaccugcacaggugacugccccgaacgcugcggcugcaccuccuccacgugccuacacaaagaauggccccacagccgaaacuggcgcugcaaccccaccuggugcuggggcguaggcacggguugcacuugcugcggacucgacguaaaagaccucuucaccgacuacauguucgucaaauggaagaucgaauacaucaaaaccgaagccaucgucugcgucgaacuuacaucacaagagcgacagugcucacucaucgaagccggaacgcgcuucaaccuaggacccguaacaaucacacucucugaaccccgcaauauacaacaaaaacuccccagugaaaucaucacccuccaccccaggauugaagaaggauucuucgaccugaugcacguccaaaaaguucucagcgccagcacugucugcaaacuacaauccugcacacacggcguacccggcgaccuacaaguauaccacaucgggaaccuccucaaaggagacaaagucaauggacaccucguccauaaaaucgaaccgcacuucaacaccuccuggaugagcugggacggaugcgaccucgacuacuacugcaacaugggagacuggccauccugcacauacacaggcgucacccaacacaaccacgcauccuucgucaaucuccucaacauagaaaccgacuacacaaagaacuuccacuuccacagcaaacgcguaacggcgcacggcgacacaccgcaacuagaccucaaagcccggcccaccuacggcgccggcgaaaucacggugcuagucgaagucgcagacauggagcuccacaccaagaaaauagaaauaagcggccugaaauucaccagccuuacaugcaccggcugcuacgcaugcuccagcggaauaucaugcaaaguccgcauccacgucgacgagccagacgaacucacaguacacguaaagucggacgaccccgacgucguagcagcaucauccucacucauggcccgcaaacucgaauuuggaaccgacuccaccuuuaaagcauucuccgcuaugcccaagacaucacucugcuucuacauagucgaacgagaauacugcaaaucaugcagugaagaagacacccagaaaugcguaaacaccaaacuagagcaaccccaaucaauccucaucgagcacaaagguacuauaaucggcaagcaaaacaauaccugcaaagcccgggccggcugcuggcuugaguccguuaaauccuucuuuuacggacuaaagaacaugcucuccggcauuuucggcaacguauucauaggcaucuuccucuuccuagcccccuucauccuacucauccuauucuucauguucggauggcgcauacuauucugcuucaaaugcugccgccgcacacgaggccucuucaaauaccgccaccugaaagacgacgaagaaaccggauaccggaaaauaaucgaacgcuuaaacaacaagaaaggcaaaaacaaacuucuagauggagaaagacuugccgaccgacgcauagcggaacucuucuccacaaaaacccacaucggc

SEQ ID NO: 15710 - RNA, 1932 nt, Artificial Sequence
  derived and/or modified CDS sequence (opt11) from CCHFV(SPU415/85)__DQ211635.1__Gc
uuccucgacuccaucguaaaagggaugaaaaaccuacuaaacucgacaucccucgagaccagccuaaguaucgaagcaccauggggcgcaauaaacguacaaucaacauucaaaccaaccgucagcgccgcaaacauagcccuauccugguccagcguggaacaccgcggcaacaagauccuggucuccggaagaucggagagcaucaugaaacucgaagaacgcaccggaauaaguugggaccuaggagucgaggacgccucagaaucaaaacugcucacggucagcgucauggaccuuagccaaauguacucucccguauucgaauaccucuccggagaccgccaagucgaagaauggccaaaggcaacauguaccggcgauugucccgaaagaugcggcugcacaagcagcacgugccuucacaaagaauggccccacucccgaaacuggcgcugcaacccaaccuggugcuggggcgucggcacaggcugcacaugcugcggccuagacgucaaagaucuauucacagacuacauguucgucaaauggaaaguggaauacauaaaaacagaagcaaucgugugcgucgaacugacaagccaagaacgccaaugcagccucauagaagccggaacacgcuucaaccucggacccguaaccaucacucucucagaaccccgaaauauacagcaaaaacuacccccugagaucauaacccuccacccacgcaucgaagaaggauucuucgaccucaugcacgugcaacgcguccugucagccagcacggucugcaagcuacaaagcugcacacacggcguccccggagaucuccaagucuaccacauaggcaaucuacucaaaggugacaagguaaacggccaccucauucacaagaucgaaccacacuucaacaccucguggaugagcugggacggcugcgaccuagacuauuacugcaacaugggggauuggcccuccugcacguacaccggugucacacaacacaaccacgcagcauucgucaaccuccucaacauagaaaccgacuacaccaaaaacuuccacuuccacuccaaaagagucaccgcccacggcgacaccccacaacuugaccucaaagcacgacccacauacggcgccggcgagguaacaguacugguagaggucgcagacauggaacugcacaccaaaaagauagaaauaucgggccucaaauucgccagcuuaacauguaccggcugcuacgcaugcagcagcgggaucagcugcaaagucaaaauccacguagacgaacccgacgagcucacgguccacgugaaaagcgaagaccccgacaucgucgcagcggggagcucccucauggcccgcaaacucgaauuuggcgcagacucaaccuucaaagccuucucagccaugccuaaaacaucccucugcuucuacaucguagagcgcgaauacugcaaguccugcuccagagaagacacacgcaaaugcgucaacaccaaacuagaucgaccccaaucuauacuaaucgaacacaaaggaaccaucaucggcaaacagaacaacacaugcaccgcgaaagcgucgugcuggcuagaauccguaaaaucauucuucuacggccuuaaaaacaugcuaagcgguaucuucggaaacguauucauaggcauauuccucuucaucgcacccuucguacuacucauccuauucuucauguucggcuggcgcauacucuucugcuucaagugcugccgccgaacccgaggucucuucaaauaucgacaucucaaagacgacgaagagaccggcuaccgcaaaaucauagaacgccuaaacaacaagaaaggcaaaaacaaacuacuagacggagaacgcuuagcagaccggaaaauugccgaacucuucagcaccaaaagccacauaggc

SEQ ID NO: 15711 - RNA, 1932 nt, Artificial Sequence
  derived and/or modified CDS sequence (opt11) from CCHFV(Turkey200310849)__DQ211636.1__Gc
uuccuagacucaauagucaaaggcaugaaaaaccuccuaaauucaacgucacucgaaaccucccuauccauagaagcccccuggggagcaauaaauguacaaagcaccuucaaacccgccguaagcaccgccaacauagcacuaagcuggagcagcguugaacaccgagguaacaaaauccucgucacuggacggagcgagagcauaaugaagcuagaagaacgcaccggcgucagcugggaccuaggggucgaggacgcuagcgaaagcaaacuacucacagugucaaucauggaccucucacaaauguacucgcccgucuucgaauaccuaagcggcgaccgacaagucgaagaguggccaaaggcaacaugcaccggcgacugccccgaacgaugcggaugcaccucaucgacaugccugcauaaggaauggccccacucccgcaacuggcgcugcaacccaacuuggugcuggggcgugggcaccggaugcacaugcugcggaguagacguaaaagaccucuucaccgaccacauguucguuaaguggaaagucgaauacaucaaaaccgaagcaaucgugugcgucgaacucaccagccaagaacgccaaugcucacuaaucgaagcaggaacgcgcuucaaccuaggcccuguuaccaucacacucuccgaaccccgcaacauccaacaaaaacucccaccagaaaucauaacacuacaccccaaaauagaagaaggauucuucgaccuaaugcauguccaaaaaguccuaucugcaucgaccguauguaaauugcaauccugcacccacggcaucccaggcgaccuccaagucuaccacauaggcaaccuccuaaaaggggaucgaguaaacggacaccucauccacaagauagaaucccacuucaacacgucguggaugagcugggacggaugcgaccucgacuacuacugcaauaugggagacuggccaucaugcacauacacgggagucacccaacacaaccacgccgccuucgucaaccuccucaacauagagacagacuacaccaagacauuccauuuccacucaaagcgcgucaccgcccacggcgacacaccccaacucgaccucaaagcacguccaaccuacggcgccggcgagauaaccguccucguagagguagccgacauggaacuccacaccaagaaagucgaaaucucaggccuaaaauucgccucccuugcaugcaccggaugcuacgccugcucgagcggcaucuccuguaaaguacgcauccaugucgacgagcccgaugaacuaaccguacacgucaaauccuccgaccccgacgucguagccgccucaacaagccuaauggcccgcaaacuagaguucggaaccgacagcacguucaaagcauucucggccaugccaaaaacaucccucugcuuuuacaucgucgaacgcgaauacugcaagagcugcucagaagacgacacccagaaaugcguugacacccgccuggaacaaccacaauccauccugaucgaacacaaaggaaccauaauaggcaaacaaaaugauaccugcaccgccaaagcaucaugcugguuagaaucagucaaaaguuucuuuuacggacucaaaaacaugcucggcucagucuuugguaaccucuucauaggaauacuacucuuccuagccccguucguacuccuaguacuauucuucauguuuggcuggaaaauccucuucugcuucaaaugcugccgccgcacacgaggccucuucaaauacagacaccucaaagacgacgaagagaccggcuaccgacgaauaauagaacgacugaacucuaagaaaggcaaaaaccgacuccuagacggcgaccgccucgcagacagaaaaauagccgaacucuucucaacgaaaacacacaucggg

SEQ ID NO: 15712 - RNA, 1932 nt, Artificial Sequence
  derived and/or modified CDS sequence (opt11) from CCHFV(Iran-52)__DQ446215.1__Gc
uuccucgacagcauaguaaaaggcaugaaaaaccuacugaacuccacaucacucgagaccucacuaucaaucgaagccccauggggagccaucaacguucaaucaacauacaaaccaaccguaagcaccgccaacaucgcccucagcuggagcagugucgaacaccgaggaaacaaagucuuagucuccggacgcucagagucuaucaugaaacucgaagaacgaacaggaaucucaugggaccuaggagucgaagacgcgucggaaagcaaacuccucacuguauccgucauggaccucagccaaauguacuccccggucuucgaguaucucagcggcgaccgccagguagaagaauggcccaaagccacuuguacaggcgacugccccgagcgcugcggcugcaccagcucaacgugccuacacaaggaguggccacauuccagaaacuggcguugcaaccccaccuggugcuggggcgucggcacaggcugcacaugcugcgggcucgauguaaaggaccucuucacggacuacauguucguaaaauggaaagucgaauacauaaagaccgaagcaaucguaugcgucgaacucaccucccaagaacgacagugcucccucauagaagcgggcacacgauucaaccucggcuccgucaccaucacccuuuccgaaccccggaacauacaacaaaaacucccgcccgagauaaucacccuacaccccaaaaucgaagagggauucuucgaccucaugcacguccaaaaaguccuuuccgccuccaccgucugcaaacuccaaucaugcacccacggaguucccggcgacuuacaagucuaccacaucggaaaccuccucaaaggagaccgaguaaacggacaccucauccauaaaaucgaacaacacuucaacaccuccuggauguccugggacggcugcgaccucgacuacuacugcaacaugggagacuggccaucaugcacguacacaggcgucacccagcacaaccacgccagcuucgucaaccuacucaauaucgaaacggacuacaccaaaacauuccacuuccacuccaaacgcguuaccgcccacggcgacaccccucaacucgaccuaaaagcacgccccaccuauggcgcgggcgaaaucaccguccuggucgaaguggcagacauggaacugcacaccaagaaaauugaaauauccggccucaaauucgcuggauuaacaugcaccgguugcuacgccugcuccucaggcaucuccugcaaaguacgaauacacgucgaagaacccgacgaacucacaguccacgucaaauccgacgacccggacgucguagcggccucgucgucccuaauggcucgcaagcucgaguucggcaccgacucgacauucaaagcauucuccgccaugcccaaaaccucccuaugcuucuacaucgucgaacgagaauacugcaaauccugcuccaaagaagacacacaaaaaugcgucaacaccaaacucgaacaaccccaaaguauccugaucgaacacaaagggaccaucaucggcaaacaaaacaacacgugcacagcaaaagcauccugcuggcuagaaucaguuaaaucauucuuuuacggccugaaaaacaugcuaggaggcaucuucggcaacgucuucaucggaauauucacauuccuaacccccuucauccuccucauacucuucuucauguuuggcuggcggauucuauucuguuucaagugcugccgacgaacccgcggacucuucaaauaccgccaccucaaagacgacgaagaaaccggcuaccgcaaaaucaucgagcgccucaacaacaaaaagggcaagaaccgacuucuagacggggaacggcuagccgauagaaaaauagcagaacucuucagcacaaaaacccacauagga

SEQ ID NO: 15713 - RNA, 1932 nt, Artificial Sequence
  derived and/or modified CDS sequence (opt11) from CCHFV(Iran-53)__DQ446216.1__Gc
uuccucgacucaaucgucaaaggcaugaaaaaccuccuuaacucaaccucccucgaaacaucacuauccaucgaagcccccuggggcgccaucaacguccaaaguaccuacaaaccgacggucagcaccgccaauaucgcacucuccuggucaagugucgaacaccgaggcaacaaaguacucgucucaggccguagcgaaagcaucaugaaacucgaagaacgaacaggcauaagcugggacuuaggaguagaggacgccuccgaauccaaacuacugaccguauccgugauggaccucucgcaaauguauucccccgucuucgaauaccuauccggcgaccgccaagucgaagaguggccaaaagcuacuugcacaggagacugcccagaacgcugcggcugcacguccucaaccugccuccacaaagaauggccccacucccggaacuggcgcugcaaccccaccuggugcugggguguaggcaccggcugcacaugcugcggacucgacgucaaagaccuauucaccgacuacauguucgucaaauggaaaguagaauacaucaaaaccgaagcgaucguaugcguagaacuaaccagccaagaacgccaaugcucccucauagaagccggaacccgcuucaaccuaggcucagucacaaucacccuaucugaacccaggaacauccaacagaaacugccacccgaaauaauaacccuccaccccaaaaucgaagaaggcuucuucgaccucaugcacguccaaaagguccuaucagcgagcacaguuuguaaacuccaaucaugcacccaugguguccccggcgaccuucaagucuaccacaucggaaaccuccugaaaggagaccgaguaaacggccaccucauccacaaaauagaacaacacuucaacacauccuggauguccugggacggcugcgaccuggacuacuacugcaacaugggcgacuggcccucgugcacauacaccggcguaacgcaacacaaucaugccagcuucgucaaccuacucaacaucgaaacagacuacacaaaaaccuuccacuuccacagcaaacggguaacagcccacggagacaccccacaacuagaccucaaagcacggcccacauacggugcaggagaagucaccguccuagucgaagucgccgacauggaacuacacacaaagaaaaucgaaaucuccggccugaaauucgcaggguugaccugcacaggaugcuacgccugcagcuccgguauaucaugcaaaguccguauccauguggacgaaccagacgaacucacuguucacguaaaaucagacgaccccgacgucgucgccgccucguccucacucauggcccgcaaacucgaauuuggaaccgacuccacauucaaagccuucuccgcaaugccaaaaaccucccucugcuucuacaucgucgaacgagaauacugcaaauccugcagcaaagaagauacccagaaaugcgucaacacgaaacucgaacaaccccaaucaauacucaucgagcacaaaggcacuaucaucggcaaacaaaacaauaccugcacagcgaaggcaagcugcuggcucgaauccgucaaaucauucuucuauggccucaaaaacaugcucggaggcauuuucggcaacguuuucaucggcauauucacauuccuaaccccuuucauccuccuaauccuauucuucauguucggcuggcgcauccuauucugcuucaaaugcugcagaagaacccgcggccuauucaaauaccgccaccucaaagacgacgaagaaaccggcuacagaaaaaucauagaacgcuugaacaacaagaaaggcaaaaaccgccugcuagauggcgaacgacucgccgaccgcaaaauugcagaacucuucagcacgaaaacccacaucggc

SEQ ID NO: 15714 - RNA, 1932 nt, Artificial Sequence
  derived and/or modified CDS sequence (opt11) from CCHFV(Kosova Hoti)__EU037902.1__Gc
uuucucgacucaaucguaaaaggaaugaaaaaccuccugaacuccacaucacucgagaccucccucucaaucgaagccccguggggagccauaaacguccaaucgacauucaaaccgaccgucagcaccgccaacaucgcgcuauccuggucguccgucgaacaccgagggaacaaaauccuagucacaggacggagcgaauccauaaugaaacucgaagaacgcacugggaucucaugggaucuaggcguagaggacgcguccgaaagcaaacuccucacagucagcauaauggaccucucccaaauguacucccccguguucgaauaccugagcggcgaccgccaaguagaagaauggccuaaagcgacguguaccggugauugcccccagcgcugcggaugcacauccaguaccugccuacacaaagaauggccucacagccgaaacuggcgcuguaacccaaccuggugcuggggaguagguacaggcuguaccugcugcggagucgacgucaaagaccucuucacagaccacauguuugucaaauggaaagucgaauacauaaaaaccgaggccaucgucugcguagaacugaccucacaggagagacaaugcucccuaaucgaagcaggcacccgcuucaaccugggccccguaacuauaacacuuagcgaaccaagaaacauacagcaaaaauuaccacccgaaauaaucacccuacacccgaaaauagaagaaggcuucuuugaccucaugcacguacaaaaaguccucucagccuccaccguaugcaaacuccaauccugcacccacggcaucccaggagaccuacaaguauaccacauagggaaccuacugaaaggugaccgcgucaacggacaucucauccacaaaaucgagccccacuucaacaccuccuggauguccugggacggaugcgaccucgacuacuacugcaacaugggcgacuggcccuccugcaccuacaccggcgucacccagcacaaucacgccgccuucgucaaucugcuaaacauagaaacagacuacaccaaaaccuuccacuuccacuccaaacgaguaacagcccacggcgacacaccccaacuagaccucaaagcccgcccgaccuacggcgccggcgagauaacgguacuggucgaaguagcagacauggagcuacacaccaaaaaggucgaaaucucgggccucaaauucgcaucacucgccugcaccgguugcuacgcaugcucauccgggauaucgugcaaaguccgcauacacguagacgaacccgacgaacucaccguccacguuaaguccucagaucccgaugucgucgccgccggaacuucccucauggcccgcaaacuagaguucggaaccgacucgacauucaaagccuuuuccgccaugccaaaaaccucccucugcuucuacauaguagaaaaagaauacugcaagagcugcuccgaagacgacacuaagaaaugcguagacaccaaacuagaacaaccccaaucaauacuuauugaacaccgcggcaccaucaucggcaaacagaacgacacgugcacagccaaagcauccugcuggcuugaaucaguaaaaucguucuucuacggccucaaaaauaugcucggauccguauucggcaacuucuucaucggcauccuccuguuccuggcccccuucguacuccuaguccuauucuucauguucggcuggaaaauccuauuuugcuucaaaugcugcaggcgaacccgcggccucuucaaauaucgucaccucaaagacgacgaagagaccggcuaccgccgcauaauagaacgacucaacaacaagaaaggcaaaaaccggcuacucgacggugagcgccuagccgaccgaaaaauagccgaacuauucucaaccaaaacacacaucgga

SEQ ID NO: 15715 - RNA, 1932 nt, Artificial Sequence
  derived and/or modified CDS sequence (opt11) from CCHFV(YL04057)__FJ562094.1__Gc
uuccuagacucuauagcaaaaggcaagaaaucccuccucaauuccaccucccucgaaaccucacucagcaucgaagcaccauggggcgccaucaauguacaaucgacuuucaaaccaacaguauccgcagccaacaucgcacucuccugguccuccgucgaacaccgcggcaacaaaauccucgucucaggacgcuccgaaucaaucaugaaacuagaagaacgaaccggcgucucguggaaccucggcgucgaagacgcauccgaaaguaaaacacucaccgucuccguaauggaccucagccaaauguacuccccaguauucgaauaccucagcggcgaccgccaaguagaagaauggcccaaagcaaccugcacaggagauugccccgaacgaugcggaugcaccuccuccacuugccuccacaaagaauggccccacucccgaaacuggcgcugcagcccgaccuggugcuggggcgucggcaccggaugcacaugcugcggucucgacgucaaagacuucuucacggacuacaugcucgucaaauggaaagucgaauacaucaaaacagaagccaucgucugcguagaacuaacaucccaggaacggcaaugcucgcucaucgaggccggaacccgcuucaaccugggaccaguaacaaucacccuauccgaaccacgcaacguccaacaacgccuacccccagagaucgucacccuacacccaaagauagaagaaggcuucuucgaccuaaugcacguccagaaaauauuauccgccucaaccgugugcaagcuacaaucaugcacccacggaguccccggcgacuuccaaguuuaccacguaggcaaccuccugcgcggagacaaaguaaacggccacuccauccacaagauugaaccacacuucaacacaucauggaugucaugggacggaugcgaccuagacuacuucugcaacaugggcgacuggccaucaugcaccuacaccggaguaacccaacauaaucgcgccgccuucaucaacaugcucaacauagaaaccgacuacaccaaaacuuuccacuuccacuccaagcgcgucaccgcucacggagacacgccccaacuagaucucaaagcgcguccugccuacggagccggagaagucaccguacucguggaggucgccgaccuugaacuacauaccaagaaacucgaaguaagcggccugaaaauagccagccucacaugcagcggcugcuacgcaugcucaucaggaaucucgugcaaaguccggauccacgucaacgaacccgacgaauuuaccguccacguccgcucauccgacccagacguagucgcagccggauccucucucauggccagaaaaauugaguucggcgccgacucgacauucaaagccuucagcuccaugccgaaagacucccuaugcuucuacauuguugaaaaagacuacugcuccuccuguaccgacgacgacacccaaaaaugcgucaacacaaaacucgaccacccccaaucgauccucaucgaacacaaaggaacaauaauaggcaaacaaaacgauaccugcucaaccaaaaccuccugcuggcuagaaagcgucaaaggcuucuucuacggccucaaaaacaugcuauccggaaucuuuggaaacgucuucuuaggcauccuccuauuccuagccccauuuguccuacucaucuucuucuucuucuucggguggcgacuacuauucugccuaaaauguugccgccguacacgcggucuccucaaguacaagcaccuuaaggacgaagaagaggccggcuacaagaaaauaaucgagcgucucaauggcaagaaaggaaaaucccaacucuucgacggcgaacggcuagccgaccgcaaaauagcugaacucuucuccaccaaaauccacauagga

SEQ ID NO: 15716 - RNA, 1932 nt, Artificial Sequence
  derived and/or modified CDS sequence (opt11) from CCHFV(V42/81)__GU477490.1__Gc
uuccucgacagcauaguuaaaggcaagaaaaaccuuuuaaacucaaccagccucgaaaccucccucuccaucgaagccccauggggagccaucaacauacaguccacauucaaacccaccgucuccgccgccaacauagcccuauccugguccuccgucgaacaccgcggcaacaagauccuagucucuggccgcagcgaaucaauaaugaaacucgaggaacgaaccggcgucucauggaaccuaggaguagaggacgccucagaaucuaaacuacucacggucucaaucauggaccuaucccagauguacucacccgucuucgaguaccuaucuggcgacagacaagucgaagaauggcccaaagcaaccugcacaggagacugccccgaacgcuguggcugcaccuccuccaccugucuacacaaagaauggccacacucccgcaacuggcggugcaaucccacaugguguuggggaguaggcaccggcugcacaugcugcggcgucgacgucaaagaucuguuuaucgaccacauguucguaaaguggaaagucgaauacaucaaaacggaggccaucgucugcguagaacuaaccucccaagagcgacaaugcagccuuaucgaagccgggacaagauucaaccuaggcccagugaccauaacacucucagaaccccgaaacauacagcaaaaacugcccccagaaaucaucacccuccaccccaaaauugaagaaggcuucuucgaccuaaugcacguccaaaaaguccuuuccgcuuccacagucugcaagcuacaaucaugcacgcacggcauacccggugaccuacaaguuuaccacaucggaaaccuucucaaaggcgaccgaguaaacggccaccucauccacaaaaucgaaccccacuucaacaccuccuggaugagcugggauggaugcgaucuagacuacuacugcaacaugggagacuggccauccugcaccuacaccggcguaacccagcacaaccaugccgcauucgugaaccugcucaacaucgaaacugacuacacuaaaaccuuccacuuccacuccaaacguguaacagcccacggagaaaccccgcaacuggaccuuaaagcccgcccagcauacggcgcaggcgagauaacagugcucgucgaaguagccgacauggaacuccacacgaagaaaguagaaaucucaggccuaaaauuugcaucacuagcuugcacaggcugcuacgccugcuccucaggcauauccugcaaaguccgaauacacguagacgaacccgacgaacucaccguccacgucaaauccaaugacccggacgucguagcagccuccaccuccuuaauggcacgaaaacuagaauccggcacagacuccaccuuuaaagccuucuccgcaaugcccaaaaccucacucugcuuuuacaucgucgaacgcgaauacugcaaauccugcagcgaagacgacacccaaaaaugcgucgagacaaaacucgaacaaccccaauccauccuaaucgaacacaaaggaacuaucaucggaaaacaaaacgauaccugcaccgccaaagcuagcugcugguuagaguccgucaaauccuucuucuacggccucaaaaacaugcucggcuccgucuucggcaacuucuuuauuggaauacuacucuuucuagcuccauucguacuccuaguccucuucuucauguucggauggaaaauccuauucugcuucaaaugcugcagacgcacgcgaggacucuucaaauaccgacaccucaaagaagacgaagagaccggauaccgccgaaucaucgagcgccucaacucaaagaaagggaaaaaccgccuucucgacggugaacgccucgccgaucgcaaaaucgcggaacucuucuccacgaaaacccacauaggc

SEQ ID NO: 15717 - RNA, 1932 nt, Artificial Sequence
  derived and/or modified CDS sequence (opt11) from CCHFV(79121M18)__GU477493.1__Gc
uuccucgacucaacagccaaaggaaugaaaagccuccuaaacucgacgucucuggaaaccucacucagcauagaagcucccuggggcgccauaaacguccaguccaccuucaaacccaccgugucagccgcaaauaucgcacuuagcugguccagcgucgaacaccgcggcaauaaaauccuggucucaggacgauccgaauccaucaugaaacucgaagaacgaaccggcgucagcuggaaccuaggagucgaagaugccuccgaaucaaaaacccuuacaguaucagucauggaccucucccaaauguacucacccguauucgaauaccuauccggcgaccgccaaguagaagaguggcccaaagcaaccugcaccggcgacugcccagagcgaugcgggugcaccuccucaaccugccuccacaaagaauggccacauagccguaacuggcgcugcaaccccaccuggugcuggggcgugggaaccggcugcacaugcugcggacuagacgucaaagacuucuucaccgacuacaugcuaguaaaauggaaagucgaauacaucaaaaccgaagcaaucgucugcguagaacucaccucacaagaacgccagugcucccuuauagaagcgggcacccgcuuuaaccuaggaccagucacgaucacgcucuccgaaccgcgcaacguccaacaacgccuaccaccggaaaucgucacccuucaccccaaaaucgaagaaggcuucuucgaccucaugcacguacagaaaauccucuccgcauccaccgucugcaaacuccaaucgugcacccacggcguccccggugacuuccaaaucuaccacgucggcaaccuccuacgaggugacaaaguaaacggacacuccauccacaaaauagaaccccacuucaacacuucguggaugucgugggacggcugcgaccuagacuacuucugcaacaugggcgacuggccauccugcacauauaccggcgucacccaacacaaccgcgccgccuucaucaacaugcuuaacaucgaaaccgacuauaccaaaaccuuccacuuccacagcaagcgaguaacagcucacggagacacaccccaacucgacuuaaaagccagaccagccuauggagcuggcgaaguuaccguccucgucgaagucgcagaccuagaacuucacaccaagaaacucgaagucuccggccucaaaaucgcaucacuuacgugcucaggcugcuacgccugcuccuccgggaucucaugcaaaguccgaauccacguaaacgaaccggacgaguucaccguccacguaagaucauccgaccccgacgucguagccgccggcuccuccuuaauggcccgcaaaauagaguucggcgccgacuccaccuucaaagcauucucgucaaugcccaaagacagccuaugcuucuacaucgucgaaaaggacuauugcagcagcugcaccgacgacgacacccaaaaaugcgucaacaccaagcucgaccacccccaauccauccucaucgaacacaaaggcacaaucaucggaaaacaaaacgauaccugcucgaccaaaaccucaugcuggcucgaauccgucaaggguuucuucuacggccucaagaacaugcucuccggaauauucggaaacguauuccugggcauauucuuauuccucgcacccuuugugcuccucaucuucuuuuucuucuucggcuggcgccuucuguucugccugaaaugcugccgcagaacccgcggccuacucaaguacaaacaccucaaagacgaagaagaagccggcuacaagaaaaucaucgaaagacucaauggcaagaaaggcaaaucccaauuauucgacggagaacgucuagccgaccgaaaaaucgccgaacucuucucaaccaaaauccacaucggc

SEQ ID NO: 15718 - RNA, 1932 nt, Artificial Sequence
  derived and/or modified CDS sequence (opt11) from CCHFV(Afg09-2990)__HM452306.1__Gc
uuccuagacagcaucgucaagggcaugaaaaaccuccucaacucgacaucccucgaaacaucgcucagcaucgaagccccauggggagccaucaacguccaauccacauacaaaccgaccgucagcaccgccaacaucgcacuuuccuggagcagcguagaacaucgcgggaauaagguccuagucuccggacgcucugaaagcaucaugaaacuagaagaacgaaccgguaucuccugggaccucggcgucgaagacgcgucggaaagcaaacuccuaaccgugucaguaauggaucuaucucaaauguacucaccagucuucgaauaccuaucaggcgacagacaaguagaagaguggcccaaagcgaccugcaccggcgacugcccagaacgcugcggcugcaccucuucaacaugccuccacaaagaauggccucacagccguaacuggcgcugcaaccccaccuggugcuggggaguagggaccggcugcaccuguugcggacuagacguuaaggaccuauucaccgacuacauguucgucaaauggaaaguagaauacaucaaaacagaggccauagucugcguagaacucacaagccaagagagacagugcucgcucauagaagcaggcaccagguucaaccuaggcuccgucaccaucacccucuccgaaccgagaaacauucaacaaaaacucccacccgagaucauaacucuccacccaaaaaucgaagaaggcuucuucgaccuuaugcacguucaaaaaguccucagcgcaucaacagugugcaaacuccaaucuugcacccacggcgucccaggagaccuacaaguauaccacauaggaaaccuccuaaaaggcgaccgcgucaacggccaccucauucacaaaauugagcaacacuuuaacacauccuggaugaguugggacggcugcgaccuagacuacuacugcaauaugggugacuggcccucaugcaccuacacaggagucacucaacacaaccacgccagcuucgucaaucuucuaaacaucgaaaccgacuacaccaaaaccuuccacuuccacuccaaaaggguaaccgcacacggugauacuccccaacucgaccugaaagcccgccccaccuacggagcgggcgaaauaaccguacugguagaagucgcugacauggaacuacacaccaaaaagaucgagaucagcggccuaaaauucgcaggccuaaccugcacgggcugcuacgccugcuccuccgggaucuccugcaagguccgcauccacguagacgaaccagacgaacucacaguucacgucaaauccgacgaccccgacguuguagcggcauccagcucgcucauggcccgcaaacuagaguucggaacagacagcaccuucaaagcguucuccgccaugcccaaaaccucccucugcuucuacaucguagaacgcgaauacugcaaauccugcagcaaagaagacacucaaaaaugcguuaacaccaaacucgaacaaccccaaaguauacugauagaacacaagggaacgaucaucggcaaacaaaacaacacaugcaccgccaaagcaucauguuggcucgaaagcguaaaauccuucuucuacggacucaaaaacaugcuaggaggcaucuucggcaacguauucaucggcauuuucaccuuucugaccccauucauacuacuaauacucuucuucauguucggauggcgcauccucuucugcuucaaaugcugccgaagaacacgcggacucuucaaguaccgccaccucaaagacgacgaagaaaccggcuaccgcaaaaucaucgaacgacuaaacaauaaaaagggcaaaaaccggcuacucgacggagaacgacucgcggacagaaaaaucgccgaacuauucuccacgaaaacacacaucggg

SEQ ID NO: 15719 - RNA, 1932 nt, Artificial Sequence
  derived and/or modified CDS sequence (opt11) from CCHFV(Sudan Al-Fulah 3-2008)__HQ378184.1__Gc
uuccuagacucaauagucaagggaaugaaaaaccuccuaaacucgacaucauuagaaaccucacugucgauagaagccccauggggcgccaucaacguucaaaguaccuacaaaccaacagugucaaccgccaacaucgcacuuuccuggucgucagucgaacaccggggcaacaagauccucguuagcggccguagcgaaucaaucaugaaacuagaggaaaggaccgggaucucaugggaccucggcgucgaagacgcguccgagagcaaacuacuaacagucuccguaauggaccucucacaaauguacucucccguauucgaauaucuauccggggaccgccaaguggaagaauggcccaaagccaccuguacaggagacugccccgaacgcugcggcugcacauccaguaccugccugcacaaggaauggccgcacagccgcaacuggcgcugcaaccccaccuggugcuggggagugggcacaggcugcaccuguugcggauuagacgucaaagaccuauucaccgacuacauguucguuaaguggaaagucgaguacaucaaaacagaggcaauaguaugcguagaacucaccucgcaagaacggcagugcucacucaucgaagccggaacuagauucaaccugggacccgucaccaucacccuguccgagccgcgaaacauccaacaaaaacucccacccgagaucauaacccuacacccccgcauagaagagggcuucuuugaccucaugcacguucagaagguccuuagcgccuccaccguaugcaaacuccaauccugcacccacggagucccaggcgaccuccaaguuuaccacaucggcaaccuucuaaaaggcgacaaagucaauggccaccuaauccauaaaaucgagccucacuucaacaccagcuggauguccugggacgggugcgaccuagacuacuacuguaacaugggagauuggcccuccugcacauacacgggcguaacacagcacaaccacgccagcuucgucaaccuccucaacaucgagacggacuacaccaaaaacuuccacuuccacucaaaacgagucacagcacacggugacacaccccaacuagaucuaaaagcccgacccacguacggcgccggcgaaaucaccguccuugucgaaguugcagacauggaacuccacacaaagaaaaucgaaaucucaggacuaaaauucgccucgcuaacaugcaccggcugcuacgccugcucaagcggcaucucaugcaaaguacggauccacgucgacgaaccagacgaacucacgguccacguaaaaagcgacgaccccgacguagucgcggcauccucaucucucauggcccggaaacucgaguucggaacugacuccacauuuaaagccuucuccgccaugcccaaaaccucacucugcuucuacauaguggaaaaggaauacugcaaauccugcuccgaggaagacacaaagaagugcgucaacacaaaacucgaacaaccccaaucuauccuaauagagcacaaaggaacgaucaucggcaaacaaaacuccacuugcacagccaaagucucgugcuggcuagagagcgcgaaaucauucuucuacggccucaaagacaugcucuccggaaucuucggaaacgucuucaucggcauauuccucuuucuggcccccuucguccuacucguucucuucuuuauguucggcuggcggauccuccuuugcuucagaugcugccgacgaacccguggacuuuucaaauaccgccaccucaaggacgacgaagaaaccggauaccgccgcauaaucgagcgucuaaacaacaagaaaggcaaaaacaagcuacuggacggcgagcgacuagcugacagaaaaaucgccgaacucuucagcaccaaaacacacaucggc

SEQ ID NO: 15720 - RNA, 1932 nt, Artificial Sequence
  derived and/or modified CDS sequence (opt11) from CCHFV(Sudan AB1-2009)__HQ378187.1__Gc
uuucucgauucaaucgccaaagguaugaaaaaccuacucaacucaaccucccucgagaccucucuauccaucgaggccccguggggcgcgauaaacguccagucgaccuacaaaccaacagucucuaccgcaaacauagcccucuccugguccucagucgaacaccgcggcaauaaaauccucgucucaggccgcuccgaauccaucaugaaacuagaggaacgcaccggcaucuccugggaccuaggcgucgaagacgccucugaaagcaaacuccuaacaguaucuguaauggaccucagccaaauguacuccccugucuucgaauaccucuccggggacagacaagucgaggaguggcccaaagccacaugcacaggagacugccccgagcgaugcggcugcacaucaagcacaugccuccacaaagaauggccacacagccgcaacuggagaugcaaccccacauggugcuggggaguagguaccggcuguaccugcugcggccuagacgucaaagaccuauucacugacuacauguucgucaaauggaaagucgaguacaucaaaacagaagcaaucgucugcgucgagcugacaucccaagagcgccaaugcucccucaucgaagcuggcacccgauucaaccuaggacccgucacaaucacacucucagaaccccgcaacauccaacaaaaacuacccccagaaaucaucacccuccacccacgaaucgaagaaggauuuuucgaccucaugcacguccaaaaaguacucagcgccucaaccguaugcaaacuacaguccugcacccacggaguacccggcgaccuacaggucuaccacauagggaaccucuuaaaaggcgacaaagugaacggacaucucauccacaaaaucgagccccacuucaacacuuccuggaugucaugggacggcugcgaccucgacuacuacugcaacaugggagacuggccaucaugcacauacaccggcgucacacaacacaaccacgcaucauucguaaaccuccuuaacaucgagaccgacuacaccaaaaacuuccacuuucacucuaaacgcgucaccgcacacggcgauaccccgcaacuagaccucaaggcucgccccaccuacggagccggcgaaauaacaguucucguagaagucgccgacauggaacuccacaccaagaaaaucgaaaucuccggccuuaaauucgccagccucacaugcacaggaugcuacgcauguucuuccggaaucuccugcaaaguccgcauccacguagacgagccggacgaacucaccguacacguaaaaagcgacgacccagacguagucgcagccucaagcucccucauggcccgaaaacucgaguucggcaccgacucaacauucaaagccuucucagccaugcccaaaacaucacucugcuucuacaucgucgagcgcgaacacugcaaauccugcaacgaagaagacacaaagaaaugcguaaacaccaaacuagaacaaccccaaucaauccucaucgaacacaaaggcacuaucaucggcaaacaaaacucaacgugcaccgcacgcgccucaugcuggcucgaaagcgugaaauccuucuucuacggccucaaaaacaugcuuuccggcaucuucggcaacguauucaugggcaucuuccuguuucuagcucccuucauccuccugauacucuucuucauguucggcuggagaauacuauucugcuucaaaugcugcaggcgcacacgcggccucuucaaauaucgacaccuaaaagacgacgaagaaacaggcuaccgccgaaucauugaacgacucaacaacaagaaaggcaaaaacaaacuccuagacggagagagacuagcagacagacgcaucgccgaacucuucagcaccaaaacacacaucggc

SEQ ID NO: 15721 - RNA, 1932 nt, Artificial Sequence
  derived and/or modified CDS sequence (opt11) from CCHFV(NIVA 118595)__JN572083.1__Gc
uuccuagacucaauaguaaaaggcaugaaaaaccuccucaacuccacuucacucgagaccucccucuccaucgaagcaccauggggcgcaauaaacgugcaauccacauacaaaccaacagugagcgccgcaaacauugcccucuccugguccucugucgaacaccgagggaacaaaauccucgucuccgggcgaucugaaagcauaaugaagcucgaagaaagaaccggcaucuccugggaccucggcguagaagaugcuucagaaucaaagcuacugaccgucuccgucauggaccucucucaaauguacucaccaguauucgaguaccucucaggcgaccgacaaguagaagaauggcccaaggcaacuugcaccggcgacugccccgaacggugcggcugcaccucgagcacaugccuccacaaagaauggccacacucccgaaacuggcgaugcaaccccaccuggugcuggggcguaggaacaggaugcacaugcugcggccuagacgucaaagaccuauucaccgacuacauguucgucaaguggaaaguagaauacauaaaaaccgaagccauugucugcgucgaacugaccucucaagaaaggcagugcagccucaucgaagcgggaacccgguuuaaccuaggaucggucaccauaacccucucagaaccucgcaacauccaacaaaaacucccgcccgaaaucaucacacuacacccccgcaucgaagaaggauucuucgaccucaugcacguacagaaaguccuaagcgcgagcacagugugcaaacuccaauccugcacccacgggguccccggcgaccuacagguauaccacaucggaaaccuccugaaaggagaccgaguuaacggacaccuaauacacaagaucgagcaacaccucaacaccuccuggauguccugggacggcugcgaccucgacuacuacugcaacaugggcgauuggccuagcugcaccuacaccggugucacccaacacaaccacgcuuccuucgucaaccuucucaacauagaaacagacuacacgaaaacauuccacuuccacucgaaacgagucaccgcccacggagacaccccacaacuggacuuaaaagcccgacccacguacggcgcgggcgaaaucacgguccucgucgagguggccgauauggaacuccacaccaaaaagaucgaaaucuccggccugaaauucgcaucccucuccugcaccggcugcuacgccugcuccuccggcauauccugcaaagucagaauacacguagacgaacccgacgaacuaacaguccacgucaaguccgacgaucccgacgugguagccgccucgucaagccucauggcacgaaaacucgaauccggaaccgacuccacguucaaagccuucuccgcaaugcccaaaaccucgcucugcuucuacauagucgaacgagaauacugcaaaggaugcaguaaagaagacacccaaaaaugcgucaacaccaaacuagagcaaccccaauccauacucauugaacacaagggcaccauaauaggcaagcaaaauaauaccugcaccgccaaagccuccugcuggcuagaauccguaaaauccuucuucuacggccucaagaacaugcucucuggaaucuucgggaacgucuuucuaggaaucuucucauuccuugccccauucguccuccuaauccuauucuucauguucggauggcgcauccuauucugcuucaaaugcugccgacgaacacgcggccuauucaaauaccgccaccucaaagacgacgaagaaaccggauaccggaaaaucauagaacgacucaacaacaagaaaggcaaaaacaaauuacucgacggagaacgacucgcagaccgaaaaaucgcggaacucuucuccacgaaaacccacaucggc

SEQ ID NO: 15722 - RNA, 1932 nt, Artificial Sequence
  derived and/or modified CDS sequence (opt11) from CCHFV(NIV 112143)__JN572085.1__Gc
uuccuagacucaaucgucaaaggcaugaaaaaccuccuuaacucgaccucacuagagaccucccuaagcaucgaagcacccuggggcgccauaaacguucaauccaccuacaaacccacagugagcgcggcaaacaucgcccuaucguggagcucagucgaacaccgcggcaacaaaauccuaguaucgggaagaagcgaauccauaaugaaacucgaagaacgcacagggauauccugggaccucggggucgaagacgccucugaauccaaacuacucaccgucucagucauggaccuaucccaaauguacucccccguauucgaguaccucagcggcgaccgccaagucgaagaauggccaaaagccaccuguaccggugacugcccagagcgcugcggcugcacaagcaguaccugccuacacaaagaauggccacacucccgcaacuggcgcugcaaccccacauggugcuggggaguaggcacuggcugcacaugcuguggccuagacguuaaagaccuauucacagacuacauguucguaaaauggaaagucgaauacauaaaaaccgaagccaucguaugcguagaacuaaccucucaagagcgccaaugcagccugaucgaagccggcacccguuucaaccucggaucaguuacgaucacccucuccgagccgcguaacauccaacaaaaacucccacccgaaaucauaacccuccacccccgcaucgaggaaggcuucuucgaccuaaugcauguacaaaagguucugucagcauccacagucugcaaacugcaaagcugcacccacggcguccccggcgaccuacaaguauaccacaucggcaaccuccucaaaggggaccgagucaacggccaccuuauccacaaaaucgaacaacaccuaaacacauccuggaugagcugggacgggugcgaccucgacuauuacugcaauaugggcgacuggcccuccugcaccuacaccggcgucacccaacacaaccacgcgagcuucgucaaccuacuaaacaucgaaaccgacuacaccaaaacguuccacuuccacucaaaaagggucaccgcacacggcgacacaccccaacucgaccugaaagcacgccccaccuacggagcaggcgaaaucaccguccucguggaagucgccgacauggaacuccacaccaagaaaauagaaauuuccggccucaaauucgccucacucuccugcaccggcugcuaugcaugcucgagcggcauaucaugcaaagugcgcauccauguggaugaacccgacgagcuaacgguccacgucaaauccgacgaccccgacgucgucgccgcaaguuccucccucauggcccggaaacucgaguucggaaccgacucaacauuuaaagccuucucagccaugcccaaaaccucccucugcuucuacaucguagaacgcgaauacugcaaaggaugcucuaaagaagauacccagaaaugcguaaacacaaaacucgaacagccgcaaucaauccugaucgaacacaaagguacaauuaucggcaaacaaaacaacacgugcaccgccaaagccuccugcuggcuagagagcgucaaauccuucuucuacggacucaaaaacaugcuaucgggcauauucggcaacguguuccucggcauauucuccuuccucgcccccuucguacuacucauccucuucuuuauguucggcuggcgcauacuauucugcuucaaaugcugcaggcgcacacgcggccuauucaaauaccgccaccucaaagacgacgaagaaaccggcuaccgaaaaaucaucgaacgcuuaaacaacaagaaaggcaaaaacaaacuauuagacggagaaagacuagcggaccgcaaaaucgcugaacucuuuagcaccaaaacccacauaggc

SEQ ID NO: 15723 - RNA, 1932 nt, Artificial Sequence
  derived and/or modified CDS sequence (opt11) from CCHFV(SCT ex Afghanistan)__KC344856.1__Gc
uuucucaacucaauagucaaaggaaugaaaaaccuccucaacuccaccaaccuugagaccagccucuccaucgaggcaccguggggcgccauuaacguccaguccaccuuuaaaccuaccgucucuacagccaacaucgcccuguccuggagcagcgucgaacaccggggcaacaaaauccuaguuucaggccgauccgaaagcauaaugaaacucgaggaacgaaccggcaucucgugggaccuaggagucgaagaugcuagcgaguccaaaagccuaaccgucagcgucauggaccucucccagauguacucacccgucuucgaauaccuguccggcgaccggcaaguagaagaguggcccaaagccacaugcaccggcgacugcccagaacgcugcggcugcaccucauccacgugccuccacaaagaguggccacacagccgaaacuggcgcugcaaccccaccuggugcuggggagucggcaccggcuguaccugcugcggacuagacgucaaggaccuguucacagacuacauguucgucaaauggaaagucgaguacaucaaaacagaagccauagucugcgucgaauugacuucgcaagaacgccaaugcucacuaauagaagcgggcacccguuucaaccuaggccccguuacaaucacacucuccgaaccccggaacauccaacaaaaacuaccaccagaaaucaucacccugcacccccgcauagaggaaggcuucuucgaccucaugcacguccagaaaguacucagugcaucaacaguaugcaaacuucaaagcugcacccacggggucccaggagaccuccaggucuaccacauaggcaaccuacucaaaggagacaagcuaaacggucacaugauacacaaaaucgagccccacuucaacacgucauggaugagcugggacggcugcgaccucgacuacuacuguaacaugggggacuggcccucgugcacauacaccggaguaacacaacacaaccacgcagccuucgucaaccuccuaaacaucgaaacagauuacaccaagaacuuccacuuucacucaaaaagagucaccgcccacggcgacacaccccaacuagaccuaaaagcccgacccaccuacggcgccggcgagaucacaguauugguagaagucgcagacauggaauuacauacgaagaaaaucgacauaucgggacucaaauucgccucacucacaugcgcaggcugcuacgccugcucauccggcaucucuuguaaaguccgcauccacgucgacgaacccgacgagcuaacaguccacguaaaauccgaagaccccgacaucguugccgccuccacuucccucauagcccgaaaacuagaacucggaacggacucaaccuucaaagcguuuucagccaugcccaaaacuucccucugcuucuacaucguggaacgagaauacugcaaauccugcuccaaagaagacacacaaaaaugugucaacaccaaacucgaacacccccaaggcauccuaauugaacacaaaggaaccaucaucggcaaacaaaacgacacaugcaccgccaaagccggcugcuggcuagaaucggucaaaucguucuucuacggacucaagaacaugcucucaggaauauucggcaacgucuucaucgguaucuuccuauuccuagcccccuucguacuccucauacucuucuucauguucggguggcgacuacuauucugcuucaaaugcugccgaagaacuagaggacucuucaaauaccgccaccucaaagaagacgaagaaaguggauaccgccggaucaucgaacgauuaaacaacaaaaaggggaaaaauaagcuccuagacggagaacgacuggccgaccgccguaucgccgagcuguucuccaccaaaacacauaucgga

SEQ ID NO: 15724 - RNA, 1932 nt, Artificial Sequence
  derived and/or modified CDS sequence (opt11) from CCHFV(Zahedan 2007)__KC867273.1__Gc
uuccucgacucuauaguaaaagacaugaaaaaccugcucaacagcacaucacuugaaacaucccucagcauagaggcacccuggggcgccaucaacguucaguccaccuacaaaccgacagucagcaccgcuaacaucgcccucaguuggucaagcgucgaacaccgcggcaacaaaguccuugucuccggccgcuccgaauccauaaugaaacucgaagaaaggacaggcauuucaugggaccuaggcgucgaagacgccagcgaaagcaaacugcuaacugugagcguaauggaccugucccaaauguacagccccgucuucgaguaccucagcggagaccgccaagucgaagaauggcccaaagcuaccugcaccggagacugccccgaacgaugcggcugcaccuccuccacuugccugcacaaagaauggccccacucacguaacuggaggugcaaccccaccuggugcuggggaguuggcaccggauguaccuguugcggccuggacgucaaagaccuauucaccgacuacauguucgucaaauggaaagucgaguacauaaagaccgaagcaaucgucugcguggaacuaaccucgcaagaacgccagugcucccucaucgaagccggcacacgcuucaaccugggcucugucaccaucacccucucggaacccagaaacauucaacaaaagcucccaccagaaauuaucacccuccaccccaaaauagaggagggcuucuucgaccuaaugcacgugcagaaaguacuuuccgcguccacaguuugcaagcuccaaucaugcacacacggaguucccggcgaccuccaagucuaccacaucggcaaccuacucaaaggcgaccgcgucaacggccaccuaauccacaagaucgaacagcacuucaacaccagcuggaugucaugggacggaugcgaccucgacuacuacugcaacaugggagacuggccaucaugcacuuacaccggcguuacccaacacaaccacgcuagcuucgucaaccuccuuaacaucgaaacggacuauaccaaaaccuuccacuuccacuccaaacgagucaccgcccauggcgacacaccucaacuggaccuaaaagcccggcccacauacggagcaggcgaaaucacuguccuaguagaaguagccgacauggaacuacauaccaaaaagaucgagaucuccggccucaaauucgcaggccucacaugcaccggcugcuacgcauguucgucuggaaucucaugcaaggugcguauacacguagacgaacccgaugaacuaacuguacaugucaagagcgacgaccccgacgucgucgccgcuuccuccucccuaauggccagaaagcucgaguucggaacggacuccaccuucaaagccuucagugccaugccaaaaacaucacucugcuucuauaucgucgaacgcgaauacugcaaaucaugcucaaaggaagacacccaaaaaugcgucaacacuaaacucgaacaaccccaaucuauccuaaucgaacacaagggaaccaucaucggcaaacagaacaauaccugcacugccaaagcauccugcuggcuggaaagcgugaaauccuucuucuacggccucaaaaacaugcugggaggcaucuucggcaacgucuucauaggaaucuucaccuuccucaccccuuucauccuccuaaucuucuucuuuauguucggauggcgaauccuauucuguuucaagugcugccgacgcacccgcggccucuucaaauacagacaccucaaagacgacgaagaaaccggauaccgaaaaauaaucgaacgacucaacaacaagaaagguaaaaacagacuacuagacggagaacggcuagccgaccgcaaaaucgccgaacuauucuccaccaaaacccacaucgga

SEQ ID NO: 15725 - RNA, 1932 nt, Artificial Sequence
  derived and/or modified CDS sequence (opt11) from CCHFV(SPU 44/08)__KJ682805.1__Gc
uuccuagacuccaucgucaaaggcaugaagaaccuacucaacagcacaucccuagagaccucccucagcaucgaagcccccuggggagccaucaacguccaaagcacuuucaaaccaaccgucuccgcagccaacaucgcgcucucaugguccuccgucgaacacagaggaaacaaaauccuagucucgggacgcuccgagagcaucaugaaacuagaagaacgcaccggcaucuccugggaccucggcgucgaggacgcauccgaaucaaagcugcugacagucagugugauggaucuaucccaaauguacucaccagucuucgaauaccucucaggcgaccggcaaguagaagaauggccaaaagcaaccugcaccggagacugcccagaacgaugcggcugcaccuccucaacuugccuacacaaggaauggccccacucacgaaacuggcgcuguaacccgaccuggugcuggggcgugggcaccggcugcacgugcugcggccucgacgucaaggaccuauucacagacuacauguucgucaaauggaaaguagacuauaucaaaaccgaagccauagugugcguagagcucaccagccaagaacggcaaugcucccucaucgaagccggcacccgauucaaccuaggaccagucaccaucacucuuucagaaccacgaaacauacagcaaaaacuaccacccgaaaucgucacccugcacccccgcauagaagaagguuucuucgaccucaugcacauacaaaaaguacucuccgcguccaccgucugcaaacuccaaucaugcacccacgguguccccggagaccuccaaaucuaccacaucggcaaccuuuuaaaaggagacaaggucaacggacaccucauccacaaaauagagccccauuucaacaccucguggaugucgugggacggcugcgaccuagacuacuacugcaacaugggcgacuggcccucaugcuccuacaccggcgucacccaacacaaccacgccgcauucguuaacaugcucaacaucgagacagacuacaccaaaaauuuccacuuccacuccaagcgcgucacggcacacggcgacacaccccagcucgaccucaaagccagacccaccuacggcgccggcgaaaucaccguccucgucgaaguugcggacauggaacuccacaccaaaaagauugaaauaagcggccuaaaguucgcgucgcuaaccugcaccggcugcuacgccugcagcuccggcauuucaugcaaaguccggauccacgucgacgaaccagacgagcucacaguccacgucaaaagcgaagacccagacaucgucgcugccucuagcucgcucauggcccggaaacuugaguucggcacagacuccaccuucaaagcauucuccgccaugcccaaaaccucacucugcuucuacaucgucgaacgagaauacugcaaauccugcuccaaagaagacacacagaaaugcgucaacaccaaacuagaacaaccccaauccaucuuaaucgaacacaaaggaaccauuaucgggaaacaaaacgacacauguaccgcaaaagccuccugcuggcuagaaucaaucaagagcuucuucuacggacuuaaaaacaugcugucaggcaucuuuggcaacgucuucauagguaucuuccuauuccuagccccuuucaucaugcucauccuuuucuucauguucggcuggcgcaucuuauucugcuucaaaugcugccgccgcacccgcggccuuuucaaauaccgccaucucaaagaugacgaagaaaucggcuacagaaaaauaauagaacgucucaacaacaagaaaggcaaaaacaaacuccucgacggggaacgacuagcagaucgaaaaauagccgaacuauucucaaccaaaacacacauuggc

SEQ ID NO: 15726 - RNA, 1932 nt, Artificial Sequence
  derived and/or modified CDS sequence (opt11) from CCHFV(SPU 383/87)__KJ682806.1__Gc
uuccucgacuccauagucaaaggcaugaaaaaccuccuuaacuccacaucccuugaaaccagccucuccaucgaagcccccuggggagccaucaacguccaaucgacguucaaacccaccgucagcgcugcaaacaucgcccuaucauggagcagcgucgaacacagaggcaacaaaauccucgucagcggccgaagcgaguccauaaugaaacucgaggaacgcaccggaaucuccugggaucuaggagucgaagacgcgagcgaauccaaacuccuuaccguaagcgucauggaccucucucaaauguacucgcccgucuucgaauaccuaaguggcgaccgccaagucgaagaauggccuaaggcgaccugcaccggcgacugcccagaacgcugcggaugcaccuccuccacaugccuccacaaagaauggccacacagccgaaacuggcgcugcaaucccacauggugcuggggcgucggcacaggcugcacuugcugcggccucgacgucaaagaccucuucaccgauuacauguucguaaaauggaaaguagacuacaucaaaaccgaagccauagucugcguugagcucaccucccaagaacgucaaugcucccucaucgaagcgggcacccgauucaauuuaggaccaguaacgaucacccuaagugagccacgcaacauccaacaaaagcuaccgcccgaaaucgucacacuccacccccgcaucgaggaaggcuuuuucgaccuuaugcacauccaaaaaguccucagcgccuccacugucugcaaacuccaguccugcacccacggaguccccggagaccuccaaaucuaccacaucggcaaccuacuuaaaggcgacaaaguaaacggccaccugauccacaaaauugagccccauuucaacaccucauggauguccugggacggcugcgaccucgacuacuacugcaacaugggagacuggcccuccugcuccuacacaggagucacccaacacaaccacgccgccuuugucaacaugcuaaacauagaaacagacuacaccaaaaacuuccacuuucacagcaaaagagucaccgcucacggcgacacaccccaacuggaccucaaagcccggccaaccuacggggccggagaaauaacgguccuggucgaggucgcagacauggaacuccacaccaagaaaauagaaauaucaggccucaaauucgcaucgcuaaccugcacaggcugcuacgcaugcuccagcggcaucuccugcaaaguacgaauccacgucgacgaaccagacgaacucacaguacacgucaaaagcgaggaccccgacauaguugccgccuccucaucccucauggcccgcaagcucgaguucggcaccgacucaaccuucaaagccuucucagccaugcccaaaacaucacugugcuucuacaucgucgaaagagaauacugcaaguccugcuccaaagaagauacccaaaagugcguaaacaccaaacuggaacaaccccaaucaauacucaucgaacacaaaggcacgauauucggcaagcaaaaugacacaugcacagccaaagccuccuguuggcucgaaagcgucaaauccuucuucuacggacuaaagaacaugcuaagcggaauauucgguaacgucuucaucggcgucuuccucuuccuggcacccuucaucaugcuaauccucuuuuucauguucggcuggcgaauacuauucugcuucaagugcugcaggcgcacccgcggccucuucaaauaccgccaccucaaagacgacgaagagauaggauaccgcaagaucaucgaacgucugaacaauaagaaaggcaaaaacaaacuacuugauggagaacgccucgcagacagaaaaaucgccgaacuauucuccaccaaaacccacaucggc

SEQ ID NO: 15727 - RNA, 1932 nt, Artificial Sequence
  derived and/or modified CDS sequence (opt11) from CCHFV(SPU 130/89)__KJ682807.1__Gc
agccuagacuccauaguaaagggcaugaagaaccuccugaacuccaccucccuagaaaccucacucuccauagaagcccccuggggcgcaaucaacguccaaagcacauucaaacccacugucucagccgcaaacaucgcccugagcuggucauccguugaacaccgcggcaacaaaauacucgucucuggacgcucagaauccaucaugaaacuagaagaacgcacaggcauaucaugggaccuaggagucgaagacgcguccgagucaaaacuccucacagugucaguaauggaccuaucccagauguacucacccguauucgaguaccucuccggcgaccgucaggucgaagaguggccgaaagcaaccugcacuggcgauugccccgaacgcugcggcugcacauccagcacaugccugcacaaagaauggccccacagccgcaauuggcgaugcaaccccacguggugcuggggcgucgggaccggaugcacuugcugcgggcuggacgucaaagaccucuucacggacuacauguucguaaaauggaaaguagacuacaucaaaaccgaggccauaguaugcguggaacuaacaucccaggaacgccagugcucccugaucgaagccgguacccgcuucaaccuaggccccgucacuauaacacucucagagccccguaacauccaacaaaaacucccacccgaaauagucacgcuucacccgcggaucgaagaaggcuucuucgaccucaugcacauccaaaaaguccucagcgccuccacagucugcaagcuccaaagcugcacccacggcguaccgggagaccuccagaucuaccacaucgguaaccuacuaaaaggagacaaagucaacggccaccugauacacaagaucgaaccucacuucaacacauccuggaugucaugggacggaugugaccuagacuacuacugcaacaugggcgacuggccguccugcucauacacgggagucacucaacacaaccacgccgcauucgucaacaugcucaacaucgaaacagacuacacuaagaauuuccacuuccacucaaaacgcgucaccgcccacggcgacacuccccaacuugaccucaaagcaagaccaacguacggagcaggcgaaaucacgguccucgucgaagucgcggacauggaacuccacaccaaaaagguugaaauaagcggccucaaauucgcaucccuaacaugcaccggcugcuacgccugcucauccggcaucagcugcaaaguccgcauccaugucgacgaacccgacgaacuaacgguacacguaaaauccgaagacccagacaucgucgccgcaagcuccucgcuaauggcacgcaagcuggaguucggcaccgacagcaccuucaaagcguucagcgccaugcccaaaaccucacucugcuucuacaucguagaacgagaacacugcaaaagcugcuccaaagaagacacccaacgcugugucaacaccaaacucgaacaaccgcaaucaauccucauagaacacaaaggcaccaucaucgggaaacagaacgacaccuguacagccaaagcauccugcuggcuagaaucuauaaagagcuucuucuacggacuuaaaaauaugcucucaggcaucuucggcaacgucuucaucggaguauuccucuuccuagcucccuuuaucauccuaauccuuuucuucauguucggauggagaauccuguucugcuucaaaugcugccgccgaacccgcggccuacucaaauaccgacaccucaaagacgacgaagagauuggcuaccggaaaaucaucgagcgacucaacaacaagaaaggcaaaaacaaacuacuagacggagaacgccuggccgaccgcaaaaucgcagaacuauucagcacaaaaacccacauaggc

SEQ ID NO: 15728 - RNA, 1932 nt, Artificial Sequence
  derived and/or modified CDS sequence (opt11) from CCHFV(SPU 497/88)__KJ682808.1__Gc
uuucuggacagcauagucaaaggaaugcgaaaucuucuaaacucuacaucacucgaaacaucacuaagcaucgaagcacccuggggcgccauaaacguacagucaaccuucaaacccaccgucuccgcagccaacaucgcccucuccugguccagcguagaacaccgaggcaauaaaauauuagucucgggccgcuccgagucaauuaugaaacucgaagaacgcacaggcaucucuugggaccucgggguagaagacgccucagagucaaagcuccuaaccgucagcgucauggaccuaucacagauguacagccccguauucgaauaccuuuccggcgaccgccaagucgaagaauggcccaaagcaaccugcacaggagacugccccgaacgaugcggaugcaccucaagcacaugccuccacaaagaauggccacacucacgaaacuggcgcugcaaccccaccuggugcuggggagucggcacgggcuguaccugcugcggccuagacgucaaggaccucuucacagacuacauguucgucaaguggaaaguugacuacaucaagaccgaagccauagucugugucgagcucacaagccaagaaagacaauguucccucauagaagccggcacccgauucaaccuuggcccaguaaccauuacacuuuccgaaccaagaaacauccagcaaaagcuaccacccgaaaucgucacucuccacccacgcauagaagagggcuucuucgaccucaugcacauacaaaagguucuauccgccuccacagucugcaaauuacaauccugcacacacggcguucccggagaccuacaaaucuaccacauagguaaccuccuaaaaggggacaaaguaaacggccaccucauccacaaaaucgaaccccacuucaauacuucuuggauguccugggacggaugcgaccuagacuacuacugcaacaugggcgacuggccaagcuguucauacacgggcgucacccaacacaaucacgccgccuucgucaacaugcucaacaucgaaaccgacuacaccaaaaacuuucacuuccacucaaaacgcgucaccgcacacggcgauacaccccaacuagaucuaaaagcccgcccaaccuacggcgcgggagaaaucaccguccuagucgaagucgccgacauggagcuccauacaaagaaaauagagaucuccggacucaaauucgccucccucacaugcacgggcugcuaugccugcagcuccgguaucuccugcaaaguccgcauacacguggacgaacccgaugaacucaccguccacgucaaaucagaggacccggacaucguagccgccuccuccucgcuaauggcacgaaaacuagaguucggaaccgacuccaccuucaaagccuucuccgccaugccaaaaaccucgcuaugcuucuacaucguagagcgagaauacugcaaauccuguagcaaagaagacacucaaaaaugcgucaacacaaaacuggaacaaccccaauccauacuaauagaacacaaaggcacaauuauaggcaaacaaaaugauaccugcaccgcccgagcaagcugcuggcuagaguccaucaaaucguucuucuauggccucaaaaacaugcuaucgggaaucuucgguaacgucuucaucggaaucuuccuauucuucgcacccuuuauuaugcucauccucuucuucauguucggauggcgcauacuauucugcuuuaaaugcugccgccgaacccgaggccuauuuaaauaccgucaccuaaaagacgacgaagaggugggguaccgcaaaaucauagagcgacucaacaacaagaaaggcaaaaacaaacuccucgacggagaacgccucgccgacaggaaaaucgccgaacuauucagcacaaaaacccacaucgga

SEQ ID NO: 15729 - RNA, 1932 nt, Artificial Sequence
  derived and/or modified CDS sequence (opt11) from CCHFV(SPU 18/88)__KJ682810.1__Gc
uuccucgacucaaucguuaaaggcaagaaaaaccuacuaaacucgaccucccucgaaaccucccuauccauugaggccccuuggggugccauaaacguccaauccacuuucaaaccaaccguuagcgcggccaacaucgcacucuccuggucuuccgucgaacaccgcggaaacaaaauccucgucuccggccgcuccgaaagcaucaugaaacuugaagaaagaaccggaaucaguugggaccuaggagucgaagacgcgagugaguccaaacuucuaaccgucucaguaauggaccuaucccaaauguacuccccagucuucgaauaccucuccggugaccgacaagucgaagaauggcccaaagcaaccugcacaggcgacugcccggagcgcugcggaugcaccuccuccacaugucuccauaaagaauggccacacagccgcaacuggcgcugcaaccccaccuggugcuggggcgucggcacaggaugcaccuguugcggacucgacgucaaagaccuuuucacagacuacauguuugucaaauggaagguggacuacauaaaaacggaagccaucgugugcguagaacuaacaagccaagaacgccaaugcucacucaucgaagccggaacccguuucaaucucggaccagucacaauaacgcucucagaaccacgcaacauccagcagaaacugcccccagaaaucgucacccuccacccacggauagaagaaggauucuucgaccuaaugcacauucaaaaaguacugagcgccuccacggucugcaaacuccaaagcugcacacacggcguaccaggcgaccuccagaucuaccacaucgguaaccuccuaaaaggcgacaaaguaaacggccaccugauacacaaaaucgaaccccacuucaacacauccuggauguccugggacgggugcgaccucgacuacuacugcaacaugggggacuggccauccuguuccuacaccggagucacccaacacaaccacgccgccuucguaaacaugcuuaacauagagaccgacuacaccaaaaacuuccacuuccacuccaaacgagugacagcacacggugacacaccgcaacuagaccucaaagcacgccccacauacggugcaggcgaaaucaccguacucgucgaagucgcggacauggaacuacacacaaagaaaaucgagauaucaggacucaaauucgcaucccucaccuguaccggcugcuacgccugcucauccgggaucucaugcaaaguccgcauccacguagacgaaccggacgaacuuaccguacacguaaagucagaggaccccgacauagucgccgccuccucuucacuaauggcacgcaaacucgaguuuggcaccgacuccaccuucaaagcauucuccgccaugccaaaaacaucacuaugcuucuacauuguggaacgcgaauacugcaaaagcugcagcaaagaagacacccaaaaaugcgucaacaccaaacucgaacaaccgcaaucaauccucauugaacacaaaggaaccauaaucggcaagcaaaacgauaccugcaccggcaaagccgggugcuggcuagaaucaaucaaaucauucuucuacggacucaaaaacaugcucuccggaauauuuggaaacguuuucaucggcauauuccucuuccuggcccccuuuaucaugcuaauccuauucuucauguucggguggcgcauucucuucugcuucaaaugcugccgccguacgcgcggccucuucaaauaccgccaccuaaaggacgacgaagaaaucggcuaccgcaaaaucaucgagcgccuuaaaaauaagaaaggcaaaaacaaacuacuugacggagaacgccucgccgaccgcaaaauagcugaacucuucucuaccaaaacccauaucgga

SEQ ID NO: 15730 - RNA, 1932 nt, Artificial Sequence
  derived and/or modified CDS sequence (opt11) from CCHFV(SPU 431/85)__KJ682812.1__Gc
uuccucgacagcaucguuaaaggccgcaaaaaccuacugaacuccaccucacucgagaccucgcucagcauagaagccccguggggcgccauaaacgugcaaucaacauucaaacccacggucagcgcugccaauaucgcccuauccugguccagcguagaacaccgcggcaacaagauccucguaucaggaagaucagaauccaucaugaagcucgaagaacgcacuggaaucucaugggaccuugguguagaagacgcauccgaaagcaagcuccucaccguguccgucauggaucucucucaaauguauuccccaguauucgaauaccucagcggagaccgccaaguagaagaauggcccaaagcuaccugcacgggagacugccccgagcgcugcggcugcacuucaagcacaugccuucacaaagaauggccccacagccgcaacuggagaugcaauccgacauggugcuggggagucggcaccggcuguaccugcugcggccucgaugucaaagaccuauucaccgacuacauguucgucaaauggaaaguagaauacaucaaaaccgaagccaucguaugcguagagcucaccucacaagagcgccaaugcagccucaucgaagccggaacgcgauucaaccugggccccguaaccaucacccuaucagagccccgcaacauacaacaaaagcugcccccagaaaucauaacccuccacccacgcaucgaagagggauucuucgaccucaugcacguccaacgaguacuaagcgccucaaccgucugcaaacugcaaucaugcacacacgguguuccgggagaccuucaagucuaccacauaggcaaccuccucaaaggggacaaggucaacggacaccuaauacacaagauagaaccacacuucaacaccagcuggaugagcugggacggaugcgaccucgacuacuacugcaacaugggggacuggccaucaugcaccuacacgggcgugacucagcacaaccacgccgccuucgucaaucuccucaacaucgaaaccgacuacacuaaaaacuuccacuuccacuccaaacgcgucacagcacacggcgauaccccgcaauuagaccucaaggcacgccccaccuacggcgccggcgaagucacuguacucgucgagguagccgacauggaacuccacaccaagaaaaucgaaauauccggacuaaaauucgcuucacuaaccugcacaggcugcuacgcgugcuccuccggcaucucaugcaaaguaaagauccacguagacgaaccagacgaacuaacaguccacguuaaaagcgaagacccggacaucguagccgccggcagcucgcucauggcccguaaacuagaguucggcgcggacucgaccuucaaggccuucucugccaugcccaaaaccucucucugcuucuacauaguggaacgcgaauacugcaaaucaugcagcagggaagacacacgcaaguguguaaacaccaaacuagaccgcccacaaucgauacucaucgaacauaaaggcacuauaaucggcaagcaaaacaacacaugcacagcaaaagccucaugcuggcucgaaagcguaaaaucauucuucuacggccucaaaaacaugcuuucaggaauauucggcaacgucuucaucggcauauuccuuuucauagccccauucguacuccucauccuguucuuuauguucggcuggcgaauccuauucugcuucaaaugcugccggcgcacacgaggccuuuuuaaauauagacaccuaaaggacgacgaagaaaccgguuaccgaaagaucaucgagcgucucaacaacaagaaaggcaaaaacaaacugcucgacggugaaaggcuagccgaucgcaaaauagcagagcuauucuccaccaaaucacacaucggc

SEQ ID NO: 15731 - RNA, 1932 nt, Artificial Sequence
  derived and/or modified CDS sequence (opt11) from CCHFV(SPU 48/90)__KJ682813.1__Gc
uuucgcgacaguauagucaagggaaugaaaaaccuccuaaacuccacaucgcuagaaaccucgcuuucgauagaagcccccuggggagccauaaacguacaaucaacauauaaaccaaccgucagcacagccaacaucgcccuuuccuggucauccguggaacaccgaggcaacaaaauccucgucucaggccgaucagagaguauaaugaaacuagaggaacgcaccgggaucucgugggaccuaggcgucgaggaugcgagcgaaagcaagcuacuaaccguaagugucauggaccucucgcaaauguauucacccgucuucgaauaccuaucaggagaccgacaaguagaggaauggcccaaagccacaugcacaggggacugcccugaacgcuguggcugcacaucgagcacuugccugcacaaggaauggccccauucccgaaacuggcguugcaacccaaccuggugcuggggcgucggcacgggcugcacaugcugcgggcucgacgucaaggaccucuucacugacuacauguucgucaaguggaaagucgaauauaucaaaacggaagccaucguaugcgucgaacuaacaucccaagaacgucaaugcucccugauagaagccggaacccgcuucaaccuaggaccagucaccaucacccucagcgaaccacgcaacauccaacaaaaacuaccgccggagaucauaacguugcacccccgaaucgaagagggcuuuuucgaccucaugcacguacaaaagguacugagcgcuucaacggucugcaaacugcaauccugcacgcacggcguccccggcgaccuccaagucuaucauauaggcaauuuacugaaaggcgacaagguaaacggacaucucauacacaagaucgaaccccacuucaacaccucauggaugagcugggacggaugugaccucgacuacuacugcaacaugggagacuggcccucaugcacauacacaggcgucacccaacacaaccgagcguccuucguaaacuuacucaacaucgaaacagacuacaccaagaacuuccacuuccacuccaaacgcgucacugcccacggugacaccccacaacucgaccucaaagccagaccaaccuacggugcaggggaaaucaccguccugguugaggucgccgacauggaacuccacacaaagaaaaucgaaaucuccgggcucaaauucgcgucgcuaacaugcaccggcuguuacgccugcuccucaggcaucucaugcaaaguccgaauccacgucgacgagcccgacgagcucacgguccacgucaaaucagacgaccccgacgucgucgccgcuucaucaucacucauggcaagaaaacucgaguucgguacagacuccaccuucaaggccuucagcgccaugccaaaaaccucccucugcuucuacaucguagaaaaagaauacugcaaauccugcagcgaagaagacaccaagaaaugcguuaacaccaaacuagaacaaccccagucaauacugaucgaacacaaaggcaccaucauaggcaaacaaaacuccacaugcaccgccaaagucuccugcuggcucgaauccgccaaauccuucuucuacggccucaaggauaugcuauccggcauauucggcaacgucuuuauaggaaucuuccucuuccuagcacccuucauccugcugauccuguucuucauguucggauggcgcauacuacuaugcuucaaaugcugccgccgcacacgcggccuauuuaaauaccgccaccucaaagacgacgaagaaaccggguacagacgaauaaucgaacgccucaacaacaagaaaggcaaaaacaagcuccuagauggagaacgacucgccgacaggcgcauagccgaacucuucagcacgaaaacccacaucgga

SEQ ID NO: 15732 - RNA, 1932 nt, Artificial Sequence
  derived and/or modified CDS sequence (opt11) from CCHFV(SPU 187/90)__KJ682814.1__Gc
uucuuagacuccaucgucaagggcaugaaaaaccuacucaacucgaccucccuagaaaccucuuuguccaucgaagcccccuggggcgccauaaacguccaauccaccuacaagccaaccguaucaacagcgaacaucgcacucuccuggucauccgucgaacaucgaggcaacaagauacucguaucuggccgcagcgaaagcaucaugaagcucgaagaaagaaccggaaucucaugggaccucggagucgaagacgcuuccgaaagcaaacuccucaccgucagcgucauggaccucucccaaauguacucccccgucuucgaguaccucuccggcgauagacaaguggaagaauggccaaaagcuaccugcacaggcgacugccccgaacgcugcggcugcacauccucaacaugccuccacaaggaauggccccauagccgaaauuggcgaugcaacccuacauggugcuggggcguaggaacaggcuguaccugcugcggacucgacgucaaagaucucuucacagacuacauguucguuaaguggaaagucgaguacauaaaaaccgaagccaucgucugcguggaacucacuucccaagagcgccaaugcucccuaaucgaagccggcacccgcuucaaccucggcccaguaaccaucacgcucucggaaccacguaacauccaacaaaaacucccacccgaaauuaucacccuacacccccgaaucgaagaaggcuucuucgaccuaaugcacguccaaaagguacucucagccagcacagucugcaaacuacaaagcugcacacacggaguccccggcgaccuacagguauaccacaucggcaaccuucucaaaggagacaagguaaacggccaccugauccauaaaauagagccccacuucaacaccucuuggaugucgugggacggcugcgaccucgacuacuacugcaacaugggcgacuggccaucaugcaccuacaccggcguaacacagcacaaucaugccagcuucgucaaucuccuaaacauagaaaccgauuauacaaagaacuuccacuuccacucuaaacgcgucacugcccacggagacacaccacaacuugaccucaaagcccgccccaccuacggcgccggggaaaucacaguccuaguagaagucgcagacauggaacuacacacgaagaaaaucgagaucucgggacuaaaauucgcaucgcuaaccugcacaggauguuaugccugcaguaguggcauaucaugcaaaguccgaauccacgucgacgaaccagaugaacucaccguccacgugaaauccgacgaucccgacgucguagcagcauccuccucccucauggccaggaaacucgaguucggcacugacucaauauucaaagcauucucggccaugccaaaaaccucacuaugcuucuacaucguagaacgcgaacacugcaaauccugcuccgaagaagacaccaagaaaugcgucaauaccaaacuugaacaaccgcaaaguaucuugaucgaacacaaaggaacgauaaucggcaaacaaaacagcaccuguaccgccaaaaccuccugcuggcuagaauccguaaaauccuucuucuacggacucaaaaacaugcucucaggcaucuucggcaacguauucaucggcaucuuccuguuccuagcccccuucauccuacucauccucuucuucauguucggcuggcgaauccucuucugcuucaaaugcugccgccguacccgcggacucuucaaauaucgccaccucaaagacgacgaagaaaccggauaccgacgaaucaucgagcgccucaacaauaagaaaggcaaaaauaaacuccuggacggcgaacgccuggccgaccgccgaaucgcggaacucuucagcaccaaaacacacaucggc

SEQ ID NO: 15733 - RNA, 1932 nt, Artificial Sequence
  derived and/or modified CDS sequence (opt11) from CCHFV(Haskovo-V46/13)__KR092379.1__Gc
uuucuugacuccaucgucaaaggaaugaagaacuuacuaaauucaacaucccucgaaaccagccuaucaaucgaagccccauggggugcaaucaacguacaaucaacauucaaaccaaccgucucaaccgccaacaucgcccucuccuggagcuccguugaacaccgaggcaacaaaauccucguaaccggccgcagcgaguccauuaugaaauuagaggaacgcaccggcgucucaugggaccuaggcgucgaagacgccagcgagucaaagcuacucaccguaagcaucauggaccuaucccaaauguacucacccgucuucgaauaucuaucaggcgaccgccaagucgaagaauggccuaaggcaaccugcacuggcgacugccccgagcgauguggcugcaccuccagcaccugucuacacaaagaauggccacacucccgaaacuggcgcugcaaccccaccuggugcuggggcgucggcaccggcugcacaugcugcggcgucgacgucaaagaccuauucaccgaucacauguucgucaaauggaaagucgaauacaucaaaacagaagccauagucugcgucgagcugaccucccaagaacgucaaugcagccucauagaagccggcaccagguucaaccucggccccgucaccauaacccuguccgaaccccgcaacauacaacaaaaacugcccccagaaauaauaacucuccaccccaagaucgaagaagguuucuucgaucucaugcacguccaaaaaguccucagcgcgagcaccgucugcaagcuccaauccugcacacacggcauaccaggcgaccuccaaguauaccacaucggcaaccuucuaaaaggagaucgaguaaacggccaccucauccacaaaaucgaaccccacuucaacaccuccuggaugucuugggauggcugcgacuuagacuacuacugcaacaugggagacuggcccuccugcacauacacgggcgucacucaacauaaccacgcugccuucguaaaccuucuaaauaucgaaacagacuacaccaaaacauuccacuuccacuccaaacgagucaccgcccacggggacacuccacaacucgaccucaaagcaagaccuacauacggcgccggcgagauuacaguccucguagaagucgccgacauggaacuccacaccaagaaagucgaaaucagcggccuaaaauucgcaucacucacaugcaccggcugcuacgcauguagcagcggcaucucaugcaaaguccgcauccaugucgacgaaccagacgaacucaccguacacguaaaauccuccgaccccgacgugguugccgcgggaaccucacucauggcccgaaaacuagaguucggaacagacucaaccuucaaagccuucuccgccaugccuaaaaccagccuaugcuucuacaucgucgaacgcgaauacugcaaauccugcucagaagaugacacccaaaagugcgucgacaccaaacucgaacaaccccaauccauucugauagagcacaaaggcaccauaaucggcaaacaaaacgacacaugcaccgcccgugcguccugcuggcuagaguccgucaaauccuuuuucuacggacucaaaaacaugcucggcucagucuucgggaacuuccuaaucgguauacuccuauuucucgccccauucguccuccuagugcuauucuucauguuuggcuggaaaauccuauucugcuucaagugcugccgccgcacccgcggccuuuucaaguaccgccacuuaaaggacgacgaagaaacuggauaccggcgaaucaucgaacgccucaacuccaagaaaggcaaaaaccggcuccucgacggagaacgacuggccgaccgcaaaauagcagagcuauucucaacgaaaacccacaucgga

SEQ ID NO: 15734 - RNA, 1932 nt, Artificial Sequence
  derived and/or modified CDS sequence (opt11) from CCHFV(24-R-2012)__KR814856.1__Gc
uuccucgacagcauagucaaaggcaugaaaaaccuccuuaacagcacuucccucgagaccucacucuccaucgaagcgcccuggggugcuaucaacguacaauccaccuucaaaccuaccgucucaaccgcaaacauagcacucucgugguccuccguugagcaccgcggaaacaaaauucuagucaccggacgcucagaguccaucaugaagcucgaagaacgcaccggggucuccugggaccucggcgucgaggacgcaucagaaagcaaguuacucaccgucagcauuauggaccuaucacaaauguacucccccgucuucgaauacuuaucaggagaccggcaagucgaagaauggccuaaagccacuuguaccggcgacugccccgaacgcugcggaugcacaagcucaaccugccuucacaaggaauggccacacucccguaacuggcgaugcaaccccacauggugcuggggagucggcacaggcugcacuugcugcggaguagacgugaaagaccucuuuaccgaccacauguucguaaaguggaaaguagaauacauaaaaacagaagccaucgucugcguagagcuaaccucccaagaacgacaaugcucccucaucgaagccggcacccgcuucaaccugggccccgucaccauuacccucuccgagcccagaaacauccaacaaaaacucccacccgaaaucaucacccuccauccuaaagucgaggagggcuucuucgaucuaaugcacguacaaaaaguucucagugcaucgaccguaugcaaacuccaauccugcacacacggcauaccuggcgaccuucaaguauaccacaucggcaaccuccucaaaggagaccgcgucaacggccaccucauccacaaaauugaaccacacuucaacaccuccuggauguccugggacggcugcgaccuagacuacuacuguaacaugggugacuggcccucaugcaccuacaccggagugacacaacacaaccacgcugcauucgucaaccuccucaacaucgaaacagacuacaccaagacauuccacuuccacucgaaacgcgucaccgcccacggcgacacaccccagcucgaccucaaagcucggcccaccuacggagcaggagaaauaaccguccuaguagaaguagccgacauggaacuccacacuaagaaaguagaaaucuccggccucaaauuugccucacuagcgugcaccggcugcuacgcaugcuccuccggaaucuccugcaaagucagaauacacguagacgaaccagacgaacucacaguccacgucaaauccaacgacccagacguggucgcagcguccacaucacugauggcccggaaacuagaguucggcacagacuccacauucaaagcguucucggcuaugccaaagacaucgcucugcuucuacaucgucgagcgcgaauacugcaaaucuugcuccgaagaggauacccaaaaaugcguugacacuaaacucgaacaaccacaaagcauccucaucgaacacaaaggaacaaucaucggaaaacagaacgacaccuguaccgccaaggcaucaugcuggcucgaguccgucaaaucauucuucuacggccucaagaacaugcucggcagcguauucggcaacuucuucauaggcauccuccuauuccuggcccccuucguucuucucgucuuauucuucauguucggcuggaaaaucuuauucugcuucaaaugcugccgcaggacccgcggccuacuaaaauaucgccuccucaaagacgacgaagaaacuggcuacagacgaaucaucgaacgccuuaacaacaagaaaggcaaaaaucgacuucuggacggcgaacgacuagccgaccgcaaaaucgcggaacuauucagcacaaaaacccacaucggc

SEQ ID NO: 15735 - RNA, 1932 nt, Artificial Sequence
  derived and/or modified CDS sequence (opt11) from CCHFV(36-ST-2014)__KR814857.1__Gc
uuccucgacuccaucgucaaaggcaugaaaaaccuucuaaacuccaccucucucgaaaccucacucuccaucgaagccccauggggagcuaucaacguacaauccaccuucaaacccacagucagcaccgcgaacaucgcacuuuccuggucauccgucgaacacagggggaacaaaauccucguaaccgggcgcucagaaagcauaaugaaacuagaggaaagaacuggcgucucaugggaccuuggcguagaagacgcaucggaaagcaaacuacuaacggugagcaucauggaccuuucacaaauguacuccccagucuucgaauaucuaagcggcgaccggcaaguagaagaauggccuaaagccacaugcacuggggacugccccgaacgcugcggaugcaccuccuccacaugccuccacaaggaauggccccacagccgaaacuggcgcugcaaccccacuuggugcuggggugucggcacaggcuguaccugcugcggcguagaugucaaggaccucuuuaccgaccacauguucaucaaauggaaagucgaauacaucaaaacugaagccauagucugcgucgaacugacaucccaagaacgacaaugcucccuaauagaagcaggcacacgauucaaccucggcccagucacuaucacccuauccgaaccacgcaacauccaacaaaaacucccacccgaaauaaucacucuacaccccaaaauugaagaagguuucuucgaccucaugcacguucaaaaaguacucuccgccagcaccgucugcaaacuacaauccugcacccacggcauacccggcgaccuccagaucuaccacaucggaaaccuacugaaaggggaucgacuaaacggacaccucauccacaaaauagaaccccacuucaacaccuccuggaugagcugggacggcugcgaccucgacuacuacugcaacaugggggacuggcccagcugcacguacaccggaguuacacagcacaaccacgccgccuucguaaaccuccucaacauagaaacagacuacacaaaaaccuuccacuuccacuccaaacgcgucacagcacacggagauacgccccaacuagaccucaaagcccgcccaaccuacggcgccggcgagauaaccguccucguggaagucgcagacauggaacugcacaccaaaaagguagaaaucagcggacuaaaauucgcaucucuagccugcacaggcugcuacgccugcucgucagguaucucaugcaaaguccgaauccacguagacgaacccgacgaacuaacaguucacgucaaauccuccgaccccgacgucguggccgccuccacaucauuaauggccagaaaacuggaguucggcaccgacagcaccuucaaagccuucucagcuaugccaaagacaucacuaugcuucuacauaguagaacgcgaauauugcaaauccugcagcgaagacgacaccaagaaaugcguagacaccaaacucgaccaaccgcaauccauccuaauagaacauaaaggaaccauaauaggcaagcaaaacgauaccugcacugccaaggccuccugcuggcucgagucagucaaauccuucuucuacggccuuaaaaacaugcuaggcagcguauuuggcaacuucuucgugggcauacuccucuuccuggcacccuucguacuacucguacucuucuucaugugcggcuggaaauuccucuuuugcuucaagugcugccgccgaacacgaggacucuucaaguaccgccaccuuaaggacgacgaagagaccggauaccgccguaucaucgagcgccucaacucgaagaaaggcaaaaacagacuacuagacggggaaaggcucgccgaccgcaaaaucgccgaacuauucuccaccaaaucccacauaggc

SEQ ID NO: 15736 - RNA, 1932 nt, Artificial Sequence
  derived and/or modified CDS sequence (opt11) from CCHFV(37-R-2013)__KR814858.1__Gc
uuccucgacagcaucgucaaaggaaugaaaaaccuccuaaacucaacaucacuagaaacaucacuuuccaucgaggccccuuggggcgccaucaacguacaaucaacauucaaacccaccgucuccaccgccaacaucgcacuauccugguccuccguagaacaccggggcaacaaaauccuugucaccggacgcuccgaguccauaaugaaauuagaggaacgcaccggcgucuccugggaccucggcgucgacgacgcauccgaaaguaaacugcucacagucagcaucauggaccucucccaaauguacucuccuguauucgaguaccucuccggggacagacaggucgaagaauggccuaaagcgaccugcaccggcgauugccccgaacgcugcggcugcaccucaucaacgugccuucacaaagaauggccccacucccggaacuggcgcugcaaccccacauggugcuggggaguaggcaccggcugcacaugcugcggcgucgacguaaaagaccuauucacggaccauauguuugucaaauggaaagucgaauacaucaaaaccgaagccauuguaugcguagaacucaccucgcaagaaagacaaugcucccucaucgaggccggcacucguuucaaucuuggaccagucaccauaacucucucggaaccgcgcaacauccaacaaaaacucccacccgaaaucaucacgcugcacccuaaagucgaagaaggcuucuucgaccuaaugcacguccagaaaguccucagcgccucaaccgucugcaaacuccaauccugcacgcacgguaucccaggcgaccuccaagucuaccacaucggaaaccuccugaaaggcgacagagucaacggacaccucauccacaagauagaaccccacuucaacacaucuuggauguccugggacggcugcgaccucgacuacuacugcaacaugggagauuggccaaguugcaccuacaccggcgucacccaacacaaccacgccgcauucgucaaccuccucaauauagaaacugauuacacaaaaacauuccacuuccauucaaaacgcgucaccgcucacggagacacaccccaacuagaccuaaaagcacgccccaccuacggggcaggcgaaauaaccguccucguggagguugcagacauggaacuacauaccaagaaagucgaaauaucaggccucaaauucgcgucgcucgccugcacaggaugcuacgcauguuccagcggcaucagcugcaaaguuaggauccauguagacgaaccagaugaacuaaccguccacguuaaauccaacgacccugacguggucgcagccuccaccagccucauggcccguaaacuagaguucggcacugacuccaccuucaaggcuuuuucugccaugcccaagaccucgcuaugcuucuacauagucgaaagagaauacugcaaaucaugcagcgaagaagacacacagaaaugcgucgacacaaaacuugaacaaccccaaucaauccuuaucgaacacaaaggcaccaucaucggcaaacaaaacgucacaugcacagcaaaagccucaugcuggcucgaguccgucaaauccuucuucuacggccucaaaaacaugcuaggauccgucuuuggcaacuucuucaucgggauacuacucuuccucgcgcccuucguccuacugguccuauucuucauguuuggcuggaaaauccucuucugcuucaaaugcugccgccgaacccggggccucuuaaaauaccgacuccuaaaagacgacgaagaaaccggcuaccgcagaaucaucgaacgacucaacaacaagaaaggcaaaaaccgccuacucgauggcgagaggcuugccgaccgcaaaaucgcagaacuuuucuccaccaaaacccacauagga

SEQ ID NO: 15737 - RNA, 1932 nt, Artificial Sequence
  derived and/or modified CDS sequence (opt11) from CCHFV(44-ST-2010)__KR814859.1__Gc
uuccuggacucaaucguaaaaggcaugaaaaaccuccucaacagcacaagccuugagacaucgcuaucaaucgaagccccauggggcgccaucaacguccaaucgacguucaaacccacagucagcaccgccaacaucgcacucucuugguccuccguagaacaccgcgggaacaaaauucucgucaccggccgcucagaguccaucaugaaacucgaagaacgcacgggcgucagcugggacuuaggagucgaagacgccucagaaagcaagcuacuaacagucucaaucauggaccuaucacaaauguacuccccaguauucgaauaccuaucaggcgaucggcaaguggaggaauggccaaaggcaaccugcacaggcgacugcccagaacgaugcggcugcaccucaucaacaugccuacacaaagaauggccccacagccgcaacuggcgcugcaaccccaccuggugcuggggcguaggcaccggcugcacaugcugcggcguugacguaaaagaccucuucacugaccauauguucaucaaauggaaaguagaauacauaaagaccgaagccaucgucuguguagaacucacgucccaagaacgacaaugcucacucaucgaagccggcacgcgcuucaaucuaggccccgucacaaucacccucucugagccccggaacauccaacaaaaacuacccccagagaucaucacacuccauccaaaaaucgaagaagguuucuucgaccuuaugcacguccaaaaaguccuuagcgccuccacuguaugcaaacuccaguccuguacccacggcauccccggggaccuacaaauauaccacaucggaaaccuacuaaaaggcgaccgccuuaacggccaccucauccacaaaaucgagccucacuucaacaccuccuggaugucaugggacggcugcgaccucgacuacuacugcaacaugggcgacuggcccuccugcaccuacacaggagucacccaacacaaccacgccgccuucguaaaccuccucaacaucgaaacagacuacacaaagaccuuccacuuccacucuaaacgcgucacggcacacggcgacaccccacaacucgaccuuaaagcacguccaaccuacggcgccggcgaaaucacaguacucguagaaguggccgacauggaacuccacaccaaaaagguggaaauaucaggccuaaaauucgccucccuugccugcaccggaugcuacgccugcucguccggcaucucgugcaaaguucggauacacgucgacgaaccagacgaacucacuguccacgucaaaagcuccgacccagacgucgucgccgccagcacuagccucauggcccgaaaacucgaguucggcaccgacagcacauucaaagccuucucagcuaugcccaaaaccucucuuugcuucuacaucguggaacgcgaauacugcaagucaugcucagaagacgacaccaaaaagugcgucgacaccaaacucgaccagccccaaagcauccucaucgaacacaaggguaccaucaucggcaaacaaaacgacacaugcacagccaaagccucaugcuggcucgaaagcguuaaauccuucuucuacggacucaaaaacauguuaggcuccguauucggaaacuucuucguaggcauccuacuauuccuagcccccuucguccugcuaguacuauucuuuaugugcggcuggaaaauccuuuucuguuucaaaugcugccgucgcacccgcggccuauucaaauacagacaccucaaagacgacgaagaaaccggcuaccgaagaauaaucgaaagacucaacagcaagaagggcaaaaaccgccuccuugauggagaaaggcucgccgacagaaaaauagcagaacuuuucuccaccaaaucacacaucgga

SEQ ID NO: 15738 - RNA, 1932 nt, Artificial Sequence
  derived and/or modified CDS sequence (opt11) from CCHFV(46-ST-2012)__KR814860.1__Gc
uuccuagacagcauugucaaaggcaugaaaaaccuccucaacuccaccucacucgaaaccagccuaucaaucgaagcccccuggggcgccaucaacguacaaucuaccuucaaacccaccgugagcaccgcaaacauagcacucagcuggucuucagucgaacaccgaggcaacaaaauccuagugaccggacgcagcgaaucaaucaugaaacuugaggaacgaaccggcgucuccugggaccucggcgucgaagacgcuuccgaauccaaacuccuaacagucuccaucauggaccucucccaaauguacagcccagucuucgaguaccuuuccggcgaccgacaagucgaagaauggccaaaagcaaccugcacuggcgacugccccgaacgcugcggcugcaccucaaguaccugccuccacaaagaauggccccacucccgcaacuggcgcugcaacccaaccuggugcuggggugucggcaccggcugcacaugcugcggcguggacgucaaagaccuauucaccgaccacauguucguaaaguggaaggucgaauacauaaaaaccgaggccauagucugugucgagcucaccucccaagagagacaaugcucacucaucgaggccggcacccgcuuuaaccucggccccguaacgaucacccuaagcgaaccccgcaacauacaacaaaagcucccacccgaaauaaucacacuacaccccaaaguagaggaaggcuucuucgaccuuaugcacguacagaaaguacuaucagccucaaccgucugcaaacuccaaucaugcacacauggcauucccggagaccuacaggucuaccacaucggcaaccuccucaaaggcgacagaaucaacggccaccucauccacaaaauugaaccccacuucaacacguccuggauguccugggacggaugcgaccucgacuacuacugcaacaugggggacuggcccuccugcaccuacacuggcguaacacaacacaaccacgccgccuuugucaaccuccucaacauagaaacggauuacacuaagaccuuccauuuccacucaaaacgcgucacagcccacggggacacgccccaacucgaucuaaaagcccgaccgacauauggcgccggagaaaucaccguacucgucgaaguagccgacauggaacuccacaccaagaaagucgaaaucucaggccucaaguucgccucccuagcuugcacuggcugcuacgccuguucuagcggcaucucaugcaaagucaggauacacguggacgaaccagacgaacucacaguccacgucaaauccuccgacccagacgucgucgccgccucgaccucccucauggcgcguaaacuggaguucggaacugacuccaccuucaaagccuucuccgcuaugcccaaaacuucacucugcuucuacaucgucgaaagagaauacugcaaaucuugcucagaagaagacacgcaaaagugugucgacacacgccuugaacaaccccaaagcauacuaaucgaacacaaaggcacaaucaucggcaaacaaaacgauaccugcacugcaaaagccuccugcuggcucgaaucaguaaaaucauucuucuacggccuuaaaaacaugcucggcuccguauucgguaacuucuucaucggcauccuccucuuccucgcccccuucguacuacucguccucuucuuuauguucggcuggaaaauccucuucugcuucaaaugcugcagacggacccgaggccuucucaaauaccggcaccuaaaagacgacgaagaaaccgguuaucgccgaaucaucgaaagacugaacaacaaaaagggaaagaaccgccuccucgacggcgaaagauuagccgaccgaaagaucgcagaacuauucuccacaaaaacacacaucgga

SEQ ID NO: 15739 - RNA, 1932 nt, Artificial Sequence
  derived and/or modified CDS sequence (opt11) from CCHFV(47-ST-2013)__KR814861.1__Gc
uuccuagacuccaucgucaaaggaaugaaaaaccuccucaacagcaccucacucgaaacgucccuuuccaucgaagcacccuggggagccaucaauguucaaucaaccuucaaaccaaccgucuccaccgccaacaucgcacucagcuggucgucaguagaacaccgaggcaacaaaauacugguuacaggacgcagcgaauccauaaugaaacuagaagaacggaccggcguaucaugggaccuaggcguagaagacgccagugaauccaaacuccucacaguaagcaucauggaccuuucacaaauguacuccccagucuucgaguaccuaucaggcgaccgccaagucgaagaauggccaaaggcuaccugcacaggagaaugccccgaacgcugcggcugcaccagcagcacaugcuuacacaaggaguggccccacucccgaaacuggcgaugcaaccccacguggugcuggggagucggaaccggaugcacaugcugcggcgucgacgucaaagaccucuuuaccgaccacauguucaucaaauggaaagucgaauacaucaaaaccgaagccauaguaugcguagaacucaccucacaagaacgccaaugcagccucaucgaggccgguaccagauucaaccucggccccgucaccaucacccuaagcgaaccccgcaacauccaacaaaagcuacccccagagaucaucacacuccaccccaaaaucgaagaaggguucuucgaccuuaugcacguacaaaaaguucuaucagcguccaccguaugcaaacuucaaucaugcacccacggaauccccggcgaccuacaaauauaccacaucggcaacuuacucaaaggagaccgaguaaauggccaccucauccacaaaaucgagccccacuucaacaccagcuggaugagcugggacggcugugaccuagacuacuacugcaacaugggcgacuggcccagcugcaccuacacaggcgucacacaacacaaccacgcggccuucgucaaccugcuaaacaucgaaacagacuacaccaaaaccuuccacuuccacagcaaacgcgucaccgcacacggcgacacaccccaacuugaccucaaggcccgcccaaccuacggcgccggcgaaaucacaguccuaguagagguagccgacauggaacuccacacgaagaaagucgaggucagcggucuaaaauuugcaucccucgccugcaccggcugcuacgccugcucaucggggaucucaugcaaaguucggauucacguagacgaaccagacgaacucaccguccacgucaaaagcucagacccagacgucguagccgccagcacaucacuaauggcccgaaaacuagaguucggaaccgacuccaccuucaaagccuucuccgccaugccuaaaacaagccucugcuucuacaucguugaacgcgaauacugcaaauccugcucggaagacgacaccaagaaaugcguagacacuaaacuagaacaaccgcaaucaauacuaaucgaacacaaaggaacuaucaucggcaaacaaaacgacacaugcacagccaaagcauccugcuggcucgaauccguaaaaucauucuucuacggccucaaaaacaugcucggauccguauucggaaacuucuucgucggcauacugcuguuccucgcucccuucguccuccuaguccuauucuucauguucggcuggaaaauccuauuuugcuucaaaugcugccgacgcacgcgcggccucuucaaauaccgacaccugaaagaugaugaagaaacaggauaccgccgcaucaucgaacgccucaauucgaagaaaggcaaaaaccgacuccuagacggagaacgacuugcagaccgaaaaauagccgaacuauucucuaccaaaacgcauaucggc

SEQ ID NO: 15740 - RNA, 1932 nt, Artificial Sequence
  derived and/or modified CDS sequence (opt11) from CCHFV(52-R-2014)__KR814862.1__Gc
uuccuggacagcauagucaaaggaaugaaaaaccuccucaacucaaccucucucgagaccucccucucgaucgaagccccguggggcgccauaaacgugcaaagcaccuucaaacccaccgucagcaccgcaaacaucgcacuaagcuggucgaguguagagcacagaggcaacaaaauccugguuacaggaagaagcgaauccaucaugaaacuagaggaacggaccggcgucucgugggaccucggagucgacgacgccucagaauccaaacuccuuacagugagcauaauggaccucagucaaauguacucacccgucuucgaauaucuaucuggagaccgccaagucgaagaauggcccaaagccacaugcacaggcgacuguccagaacgcuguggaugcaccuccuccacaugccuucacaaggaauggccccacagccgaaacuggagaugcaacccaacuuggugcuggggcguaggcacgggaugcacgugcugcggagucgacgucaaggaccucuuuacagaccacauguucguaaaguggaaaguagaauacauaaaaaccgaagccaucguuugcgucgaacucaccucccaggaacgacagugcagccuaaucgaagcaggcacacgcuucaaccuaggcccaguaacuauaacucuauccgaaccacgcaacauacagcaaaaacucccacccgagauaauaacccuacaccccaaaguagaggaaggcuucuucgaccucaugcacguccaaaagguacucuccgcaagcacagucugcaaacuccaaucgugcacccacggcauccccggagaccuacaaguauaccacaucggaaaccuacugaagggagacagaguaaacggccaucucauccacaaaaucgaaccccacuucaacaccuccuggauguccugggacgggugugaccucgacuacuacugcaacaugggcgauuggcccucgugcaccuacaccggggucacccaacacaaucacgccgccuucgucaaccuccucaacauagaaaccgacuacaccaaaaccuuccacuuccacagcaaacgcgucacagcccacggcgacaccccacaacuagaccucaaagcccgaccaacauacggcgccggcgaaaucaccguccuaguagaagucgcugacauggaacuccacacgaagaaaguagaaaucagcggccucaaauucgccucacuagcuugcaccgggugcuacgccugcuccuccgguauauccugcaaaguacgcauacacguugacgaacccgacgaacucacaguccacguaaagagcaacgacccagacgucgucgccgcuucaacaucccuaauggcccggaagcuagaguucggcaccgacucaacuuucaaagccuucuccgccaugccaaaaaccucacuaugcuucuacaucgucgaacgcgaauacugcaaauccugcuccgaagaagacacccagaaaugcgucgacaccaaacucgagcaaccacaaucgauacucaucgaacacaaaggaaccaucauaggaaaacaaaacgauaccugcacggcaaaggcaggaugcuggcucgaaucgguaaaauccuucuucuacggccuuaagaacaugcuagggucuguguucggcaacuucuucaucggcauccuccuguuccuagcccccuucgugcuccucguccuauucuucauguucggauggaaaauccucuucugcuucaaaugcugccgccgcacacgcggacuccucaaauaccgccuccuaaaggacgacgaagaaaccggcuacaggcgaauaaucgagcgccucaacaacaagaaagggaaaaaccgccuacucgacggcgagcgccuggcagaccgcaaaauagcagaacucuucucaacaaaaacccacauaggc

SEQ ID NO: 15741 - RNA, 1932 nt, Artificial Sequence
  derived and/or modified CDS sequence (opt11) from CCHFV(75-R-2012)__KR814863.1__Gc
uuccucgacagcaucgucaaaggcaugaaaaaccuccuaaacagcacaucacucgaaacaucacuaucuaucgaagcccccuggggcgccaucaacguccaaagcacauucaaacccacuguguccaccgccaacaucgcccucuccuggagcagcgucgaacaccguggcaacaagauauuagucacgggccguuccgaauccaucaugaagcucgaagaacgcacuggcgucagcugggaucugggagucgaagacgcauccgaaucaaaacuacucacgguaagcaucauggaccucagccaaauguacucccccguguucgaauaccucagcggagaccgacaaguggaagaguggcccaaagcaaccugcaccggggacugccccgaacgaugcggaugcacaucaucaaccugccugcacaaagaauggccccacucucgaaacuggcgaugcaaccccacauggugcuggggcgugggcaccggcuguaccugcugcgggguggacguaaaggacuuauucacagaucacauguucguaaaguggaaaguagaauacaucaaaaccgaagccaucguaugcgucgaacucaccucacaggaacgacagugcucacucaucgaagccggaacccgauucaaccuaggcccaguaacaaucacgcucuccgaaccucgcaacauacaacaaaagcucccacccgaaaucauaacccuacaccccaaagucgaggaagguuucuucgaccuuaugcacguacaaaaaguacucuccgcauccaccgucugcaagcugcaauccugcacacacggcauccccggcgaccuccaagucuaccacauaggaaaccuucuaaaaggagaccgcgugaacggacaccucauccacaaaaucgaaccacacuucaacacauccuggauguccugggacggcugcgaccuagacuacuacugcaacaugggagacuggccaucaugcaccuacaccggcgucacccaacacaaccacgccgccuucgucaaccuacuaaacaucgagaccgacuacacaaagaccuuccacuuccauucaaaacgcgucaccgcccacggcgacacaccccaacucgaccucaaagcacgcccaaccuauggcgccggcgagaucaccguacugguagaggucgcagacauggaacuucacaccaagaaaguagagauaagcggccucaaauuugccucacuagccugcaccggcugcuacgcaugcuccucaggcauaucaugcaaaguacgcauacacgucgacgaacccgacgaacucaccguucacgucaaaucauccgauccugacgucgucgcugccucaaccucacuaauggcccgcaaacuggaguucggcacagacucaaccuucaaagcauucucagccaugccaaaaacuucccucugcuuuuacauuguagaacgcgaauacugcaaauccugcuccgaggaagacacccaaaaaugugucgacaccaaacuagagcaaccccaaucgauccuaauagaacacaaaggcacaaucaucggaaaacagaacgacacaugcacagcuaaagccucaugcuggcuagaaagcguaaaaucguuccuguacggucuuaagaacaugcucggcucaguauuuggcaacuucuucauaggcauccuccuguuccucgcacccuucguccuccuuguucucuucuucauguucggauggaaaauauuauucugcuucaaguguugucggcguacccgaggacuccugaaguaccgccuccuaaaagacgacgaagaaaccggauaccgccgcaucaucgagcggcucaacaacaagaaaggcaaaaaccgacuccucgacggagaaagacucgccgaccguaaaauagccgaacuuuucuccaccaaaacacacaucgga

SEQ ID NO: 15742 - RNA, 1932 nt, Artificial Sequence
  derived and/or modified CDS sequence (opt11) from CCHFV(75-ST-2010)__KR814864.1__Gc
uuccucgacagcaucgucaagggcaugaagaaccuacucaacucaaccucccuagaaacaagccuuuccaucgaggccccguggggagcaauaaacguccaauccacuuucaaaccgacuguaagcacagcaaacaucgcacuaagcugguccucgguagaacaccguggcaacaaaauccucgucacaggccgauccgaguccaucaugaaacuugaagaacgaaccggcguauccugggaccuaggagucgaggacgccuccgaaucaaaacuccucacggucagcauaauggaccuuucgcaaauguacucacccgucuucgaauaccuaagcggcgaccgccaaguugaagaauggcccaaggcaacaugcaccggcgacugccccgaacgcugcggcuguaccuccucaaccugccuccacaaagaauggccccacucaagaaacuggcgaugcaacccaaccuggugcuggggcgucggaaccggcuguaccugcugcggcgucgacgucaaagacuuauucacggaccacauguucgucaaauggaaaguugaguacaucaagacggaagcaauaguaugcguggagcucacaucccaagaacgacaaugcucccucauagaagccgguacgcgcuucaaccugggaccaguuacaauaacccuauccgaaccacguaacauccaacaaaagcucccacccgagauaauaacccuccauccaaaaguggaagaaggauucuucgaccucaugcacguccaaaaaguccuaucagccagcacuguaugcaaacuccaaucaugcacccacggcauccccggcgaccuccaaguauaccacaucggcaaccuacuaaaaggcgaccgggucaauggacaccucauacacaagaucgaaccacacuucaacaccuccuggaugagcugggacggcugcgaccucgacuacuauugcaacaugggcgacuggcccucaugcaccuacaccggcgucacacagcacaaccacgcagcauucgucaaccuccuaaacaucgagaccgacuauaccaaaaccuuccauuuccauucaaagcgugucacagcccacggcgacacuccccaauuagaccucaaagcacgcccaaccuacggagcgggcgaaaucacagugcucguagaggucgccgacauggagcugcacaccaagaaagucgaaaucaguggccucaaauuugcuagccucgcuugcaccggcugcuacgcaugcuccaguggaauaucaugcaaaguacgaauacacgucgacgagcccgacgaacuuaccguacaugucaaguccagcgacccagacgucguagcagcaucaaccucccucauggcccgaaagcucgaguucggaaccgacuccaccuucaaggccuuuucagccaugcccaaaaccucccucugcuucuacaucguagaacgagaauacugcaagucaugcagcgaggaggacacacaaaaaugcgucgacacuaagcucgaacaaccccaauccauccucauagaacacaagggaaccaucauuggaaagcaaaacgauaccugcacggccaaagccucauguuggcuagaauccguaaaaucauucuuuuacggacucaaaaauaugcuagggagcgucuucggcaacuucuuuaucgggauccuccuguuccuagccccguucguccuccuaguccuauucuucauguucggcuggaaaauacucuucugcuucaaauguugccgucgcgcccgcggacuccucaaauaccgacaccucaaggacgacgaagaaaccggcuaccgaaaaaucaucgaaagauugaacaacaagaaaggaaagaacaggcuacuagacggcgaacggcucgccgaccgcaaaaucgccgaacucuucagcaccaaaacccacauaggc

SEQ ID NO: 15743 - RNA, 1932 nt, Artificial Sequence
  derived and/or modified CDS sequence (opt11) from CCHFV(3756-ST-2007)__KR814866.1__Gc
uuccucgacagcauaguaaaaggcaugaaaaaccuccuaaacuccacaucgcuugaaaccucccuaagcauagaagcccccuggggcgcgaucaacguucaaucaacauucaaacccaccguaagcacagccaauaucgcacucuccuggucaucaguagaacaccguggcaacaaaauccuagucaccggccgaagcgaaagcaucaugaaacuagaagaacgaaccggcgucuccugggaccucggcguagaggacgccagcgaaagcaaacuacucaccgucagcauaauggaccuaucgcagauguauucccccguauuugaauaucucucaggcgaccgccaaguggaagaguggcccaaagcaaccugcaccggcgacugcccagaacguugcggcugcaccagcucuaccugccuccauaaagaauggccccacuccagaaacuggcgaugcaaccccaccuggugcuggggugucggaaccggcuguaccugcugcggagucgacgucaaagaccucuucaccgaccacauguuuaucaaauggaaagucgaguacaucaaaaccgaagcaauagucugcgucgaacucaccucucaagaacgacagugcucccucaucgaagccggaacacgauucaaucuaggcccagucacgauaacacucuccgaaccccgcaacauacagcagaaacucccacccgaaaucaucacccuacaccccaaaaucgaggaaggcuucuucgaccuuaugcauguccagaagguccucuccgccagcacagucugcaaacuacaaagcugcacacacggcaucccaggagaccuccaaauauaccacaucggcaaccuacucaaaggcgaccgagucaacggccaccucauucacaaaaucgaaccccacuucaacacaucguggaugagcugggacggcugcgaccucgauuacuacugcaacaugggcgacuggcccucaugcaccuacaccggcgugacccagcauaaccacgccgcauuugucaaucuccucaacauagaaaccgacuacaccaagaccuuccacuuccacagcaagcgcgucaccgcccauggagauaccccucaacucgaccugaaggcucgcccgacauacggagcaggagaaaucaccguacuugucgaagucgccgacauggaacuccacaccaagaaaguagagaucucaggccucaaauucgccucccuuaccugcacaggcugcuacgcaugcucgucugguaucagcugcaaaguacgcauucacgucgacgaacccgacgaacuaacaguccacgucaaaagcucugacccagacguuguagcagcaucgaccucacucauggcccgaaaacuagaguucggcaccgacuccaccuuuaaggcuuucuccgccaugccaaaaacuucccucugcuucuacaucguggaacgcgaauacugcaaaagcugcucagaagacgacaccaagaaaugcgucgacacuaaacuagaacaaccccaauccauacugaucgaacacaaaggcaccauaaucggcaaacagaacgauaccugcacggccaaagccagcugcuggcucgagucaguuaaaucauucuuuuacggccucaagaacaugcuaggcucaguguucgggucauucuucgugggcauccuccuauuccuaacccccuucgugcuacucguccucuucuucauguucgguuggaaaauccuauucugcuucaaaugcugccgucgcacccgaggacucuucaaauaccgacaccucaaagacgacgaagagacagguuaccgccgcauaaucgaacgucuaaacuccaagaaagggaaaaaccgccuccuagacggugaacgccucgccgaccgcaaaaucgcugagcucuuuucaacgaaaacgcacauuggc

SEQ ID NO: 15744 - RNA, 1932 nt, Artificial Sequence
  derived and/or modified CDS sequence (opt11) from CCHFV(3809-ST-2007)__KR814867.1__Gc
uuccucgauagcaucguaaaaggcaugaaaaaccuucuaaacucuacaucccucgaaaccucccucucaauagaagccccauggggcgccaucaacguccaauccaccuucaaacccacagucuccaccgcaaacauagcccucucaugguccuccgucgaacacagaggaaacaaaaucuuaguaaccggccgcuccgaaagcaucaugaaacuagaagaaagaaccggaguauccugggaccugggcgucgaagacgccuccgagucaaaacuccuaacagucuccauaauggaccucucccaaauguacucccccguuuucgaguaucucuccggcgaccgucaagucgaagaguggccuaaagcaaccugcaccggagacugcccggaacgcugcggaugcaccucaaguaccugccuacacaaagaauggccgcacucccgcaacuggcgcugcaaccccaccuggugcuggggcgucggcaccggauguaccugcugcggcguagacgucaaggaccucuucaccgaccacauguucgucaaauggaaaguagaauacaucaaaacggaagccauaguaugcgucgagcuuaccucccaagaacgccaaugcucccucauugaggccggaacccgcuucaaccucggccccgucaccauaacccuauccgaaccccgaaacauccaacaaaaacucccacccgaaauaauaacauugcaccccaaagucgaagagggauucuucgaucuaaugcacguacagaaaguacuuuccgccagcaccgucugcaaacuacaauccugcacccacggcauacccggggaccuucaaguguaccacaucgguaaccuccucaagggugaccgcgucaacggacaccucauccacaagaucgaaccccacuucaacaccagcuggaugagcugggacgguugcgaccuagacuacuacugcaacaugggcgacuggcccuccugcacauacacaggagucacccagcauaaccacgccgcuuucguaaaccuacuaaacaucgaaacggacuacacaaaaacauuccacuuccacucaaaacgggucaccgcccacggcgacaccccacaacuugaccuaaaagcacgacccaccuacggugcaggagaaauaacaguucugguagaagucgccgacauggaacuccacacgaagaaaguagaaauuucaggacucaaauucgccagccuagcaugcacuggcugcuacgccugcucgagcgguaucucguguaaaguacgcauccacgucgacgaaccagaugaacuaacaguccacgucaaaucauccgacccggacguaguagccgccucgacaucccucauggcccgcaaacuggaguucggcacagacucaacauucaaagcauucucagcaaugcccaaaaccagccucugcuucuacaucguggaaaaggaauauugccgaucauguuccgaggaagacacacagaaaugcguagacacaaaacucgaacaaccacaaagcauccugaucgaacacaaaggaacuauaauaggcaagcaaaacgauaccugcaccgcaaaagccucaugcuggcuggaauccgugaaauccuuuuucuacggccucaaaaacaugcuaggcucggucuucggcaauuucuucaucggcauccuacucuuccuaacccccuucguacuccucguacuauucuucauguucggauggaaaauccuauucugcuucaagugcugccgccgcacacgcggacuccuaaaauaccgacaccuuaaagacgacgaagaaacgggcuauagacgcaucaucgaacggcucaauaacaagaaaggcaaaaaccggcuccucgacggagaacgccuagcagaccgcaagauugcagaacucuucucaacaaagacccacaucggc

SEQ ID NO: 15745 - RNA, 1932 nt, Artificial Sequence
  derived and/or modified CDS sequence (opt11) from CCHFV(3820-ST-2007)__KR814868.1__Gc
uuccucgacucaauagugaaaggaaugaaaaaccuccucaacuccaccagccucgaaacgucccucucaaucgaagcacccuggggcgcaauaaacgugcagagcaccuucaagccaacaguaagcacugccaacaucgcacucucaugguccagcgucgagcaccgcggaaacaaaauccucguaacgggacgauccgaaagcaucaugaaacuagaagaacgcaccggcgucucgugggaccuaggcgucgaagacgcaucagaaucgaaacuacuaacaguaagcauaauggaccucucccaaauguacucgccaguauucgaauaccuauccggcgacagacaaguagaagaguggcccaaagcaaccugcaccggcgacugcccggaacgcugcggcugcaccuccucuaccugccuccacaaagaguggccccacucccgcaacuggcgcugcaaccccaccuggugcuggggagucggcaccggcugcacaugcugcggcgucgacguuaaagaccucuuuaccgaccacauguucaucaaguggaaagucgaguacauaaaaaccgaagccaucguaugcguagagcucaccucccaagaacgacagugcucgcucaucgaagccgguaccagauucaaccuagggcccguaacgaucacccugagcgagccacggaacauccagcaaaaacucccgccagaaaucauaacucuccacccgaagauugaggaaggcuucuucgaccugaugcacguacaaaaaguacucucagccucaaccguuugcaaacuccaaucgugcacacacggcauccccggcgaccuacaaaucuaccacauaggcaaccuacucaaaggagacagagucaacggccaccucauccacaagaucgaaccccacuucaacaccuccuggauguccugggacggcugcgacuuagacuacuacugcaauaugggcgacuggcccuccugcacauacaccgguguaacccagcacaaccacgccgccuucguuaaccuccucaacaucgaaaccgacuacaccaaaacauuccacuuccacucgaaacgcguaacugcccacggcgacacuccccaacucgaccuaaaagcccgacccaccuacggcgcaggagaaauaacgguccucgucgaagucgccgacauggaacuccacacuaagaaagucgaaauauccggccuaaaauucgccucccucaccuguacuggcugcuacgccugcucguccgggaucagcugcaaaguucgcauacauguugacgaacccgacgaacucaccguccacgugaaauccucagacccugauguagucgccgccuccaccucccuaauggcccgcaaacuagaguucggcaccgacuccaccuucaaggccuuuuccgcaaugcccaaaacaucccucuguuucuacauagucgaacgcgaauacugcaaauccugcuccgaagacgacacaaagaaaugcgucgacaccaaacucgagcagccccaaucaauccuaaucgaacacaaagggaccaucaucggaaaacaaaaugacacaugcaccgccaaagccuccugcuggcucgaaucagucaaguccuucuucuacggacucaaaaacaugcuuggaucaguauucgggagcuuuuucgucggaauccuacucuuccuagcacccuucgucuuacuuguccucuucuucauguucggauggaaaauccucuucugcuucaaaugcugccgccggacccgcggccuuuucaaauaccgacaccucaaggacgacgaagaaaccggcuaccgccgcaucaucgaacgacucaauuccaagaaaggcaaaaaccgccuccucgacggcgaacgccucgccgaccgcaaaaucgccgagcuauucagcacgaaaacucauauaggc

SEQ ID NO: 15746 - RNA, 1932 nt, Artificial Sequence
  derived and/or modified CDS sequence (opt11) from CCHFV(4495-ST-2008)__KR814869.1__Gc
uuccuagacagcauagucaaggguaugaaaaaucuccucaauucaaccucucuggaaacaucacuaucaaucgaagcccccuggggcgccaucaauguccaauccacauucaaacccaccgucuccaccgcaaauauagcccucucguggucaaguguggaacaccgagggaacaaaauccuaguaaccggcagaagcgaaucaauaaugaaacuagaggaacgaacaggcaucucaugggaccuaggcgucgaagaugcaagcgaaagcaaacuccucaccgucuccaucauggaccuuucacaaauguacucccccgucuucgaguaccuaagcggcgaucgacaaguagaagaauggcccaaagcaaccugcacuggcgacugccccgaaagaugcggcuguaccuccaguacaugccuucacaaagaauggccacacagccgcaacuggcgcugcaacccuaccuggugcuggggcguaggcaccggcuguaccugcugcggcguagaugucaaagaccuauucacagaccacauguuugugaaauggaaagucgaguauauaaagaccgaagccaucgucugcgucgaacucacaucccaagaacgccaaugcucccucaucgaagccgggacccgauucaaccucggccccguaaccaucacacucucagaaccccgcaacauccaacaaaaacuaccucccgaaaucaucacccuucaucccaaagucgaagaaggcuucuucgaccucaugcacguccaaaaaguacuaucagccuccaccgucugcaaacuacaaagcugcacccacggcaucccaggcgaccuccaaguauaccacauaggcaaccuacugaaaggggaccgaguaaacggccauuuaauccacaaaaucgaaccccacuucaacacaucauggauguccugggacggcugcgaccuagacuacuacuguaacaugggcgacuggcccucaugcaccuacaccggcguaacacaacacaaccacgccgcuuucgucaaccuccucaacaucgaaacggacuacaccaaaacauuccacuuccacagcaaacgugucacagcccacggcgacaccccacaacuugaccucaaagcuagaccaacauacggagcaggcgaaaucacaguccuggucgaagucgcagacauggaacugcacacgaagaaaguugaaaucagcggccucaaauucgcaucacucgcuugcaccggcugcuacgccuguucgaguggcaucuccugcaaaguacggauccacgucgacgaaccagacgaacuaaccguccacguuaaaaguuccgacccggacgucgucgccgccuccaccucacuaauggcccgcaaacucgaguucggcaccgacucaaccuucaaggccuucuccgccaugcccaaaaccucccucugcuuuuauaucguggaacgagaauacugcaaaagcugcagcgaagaagacacacaacgaugcgucgacaccaaacuggaacaaccgcaaucaauacuaauagaacacaagggcacaaucaucggcaaacaaaacgauaccugcacagccaaagccucauguuggcuagaaagcgucaaaucguucuucuacggacucaaaaacaugcuaggcuccguauucggcaacuucuucaucggaauccuccucuuccucgccccguucguccuacugguccuauuuuucauguucggcuggaaaauccucuucugcuucaaguguugccgucgugcccgcggccuccucaaauaccgacaccuaaaagacgacgaagaaaccggcuaucgaaaaaucaucgaacgccucaacaacaagaaagguaaaaacagacuacucgacggagaacgccuagccgaccgaaaaauagccgaacucuucucaacaaaaacucacauuggc

SEQ ID NO: 15747 - RNA, 1932 nt, Artificial Sequence
  derived and/or modified CDS sequence (opt11) from CCHFV(4691-ST-2009)__KR814871.1__Gc
uuccuagacucaaucguaaaagguaugaaaaaccuccucaacucaaccucucuagaaacaucccuauccaucgaagcacccuggggagcaauaaaugugcaaagcaccuucaaacccgccgucucaacagccaacaucgcccucucgugguccuccguagagcaccgcggcaacaaaauacucgucaccggcaggucagaaagcaucaugaaacuagaagaaagaacgggaguauccugggaccuaggagucgaggacgcauccgaaagcaaacuccuaaccguauccauuauggaucucucgcaaauguacucgccagucuucgaguaucucucuggagaccgacaagucgaagaauggcccaaagccacaugcacaggcgacugccccgaacgaugcggaugcacgucauccacuugccuucacaaagaauggccacacagccgcaacuggcguugcaaccccaccuggugcuggggcgugggcaccggaugcacaugcugcggcguagacguaaaagaccucuuuacugaccacauguuuaucaaauggaaagucgaauacaucaaaacagaagccaucguaugcguagaauuaaccucccaagaacgacaaugcucccucaucgaagccggcaccagauucaaccucggccccgucaccaucacccucucggaaccccgaaacauccagcaaaaacucccacccgaaaucauaacccuccaccccaaaaucgaagagggcuucuucgaccucaugcacguccaaaaaguacuuucagcaagcaccguuugcaaacuccaauccugcacacauggcauacccggugaccuucaaaucuaccacaucggcaaccuacucaagggcgacaggguaaacggacaccucauacacaaaauagaaccgcacuucaacacaagcuggauguccugggacggcugcgaccucgacuacuacugcaacaugggagacuggcccucaugcaccuacaccggcgucacacaacacaaccacgccgcauuugucaaucuccucaacaucgaaaccgacuacacuaaaaccuuccacuuccacagcaaacgggucacggcccacggcgacacaccccaacuagaccucaaagcccgcccuaccuauggagcgggcgaaauaaccguccucgucgaagucgcugacauggaacuccacaccaagaaaguagaaaucucaggccucaaauucgcgucucucgccugcaccggcugcuacgccugcucgagcgggaucuccugcaaaguacggauccacguagacgagccagaugaacucacaguucacgucaaaucgucagaccccgacguagucgccgccagcaccucccucauggcacgcaagcucgaguucggaaccgacagcaccuucaaagccuucucagccaugcccaagaccucacucugcuucuacauagucgaacgcgaauacugcaaauccugcuccgaagacgacaccaagaaaugugucgauacaaaacucgaacagccccaguccauacucaucgaacacaaagguaccauaaucggaaaacaaaacgauaccugcaccgcaaaggccucaugcuggcucgaaucagucaaauccuucuucuacggccugaaaaacaugcuaggcucagucuucggcaacuucuucgucggcauccuacuuuuccucgccccuuucguccuccucguucucuucuucauguucgguuggaaaauccucuucugcuucaagugcugccgacguacccgcggccucuucaaguaccggcaccuaaaggacgacgaagaaaccggauaccgacgcaucaucgaacgauugaacuccaagaaaggcaaaaacagacuccucgacggagagcggcuagcagaccgcaaaaucgcagaacuauucucaaccaaaacccacaucggc

SEQ ID NO: 15748 - RNA, 1932 nt, Artificial Sequence
  derived and/or modified CDS sequence (opt11) from CCHFV(4701-ST-2009)__KR814872.1__Gc
uuccuagacucaauagucaaaggcaugaaaaaccuacuaaacucaacaucacucgaaaccucacuuuccaucgaagcaccauggggcgcaauaaacguccaauccaccuucaaacccacaguauccaccgcaaacaucgcacucagcuggucauccguagagcaccgaggcaacaaaauccuagucaccggccgaucagaaagcaucaugaaacucgaagaacgcacagguguuucaugggaccucggagucgaagacgcaucagaaagcaagcuacucaccgucuccaucauggaccucucccaaauguauucaccaguuuucgaguaccucucaggcgacagacaagucgaagaguggccaaaagcgaccugcacaggagacugccccgaacgaugcggaugcacaagcucaaccugccuacacaaggaauggccccacucccgcaacuggcgaugcaacccaacauggugcuggggugucggcaccggcugcacaugcugcggcguugacgucaaagaccucuucaccgaccauauguucauaaaauggaaagucgaauacaucaagacugaagccauaguaugcgucgaacugacuucccaagagcgacaaugcagccucaucgaagccggaacacgguucaaccucggccccgucacaauaacgcucucagagcccagaaacauccaacaaaaacucccacccgaaauaaucacgcuccaccccaaaaucgaagaaggcuucuucgaccucaugcacguacaaaagguacuuucugcuuccaccguaugcaaacuacaaucuugcacccacggcauccccggagaucuccagaucuaccacaucggcaaccuccucaaaggcgaccgcguuaacggccaccucauccacaaaauagagccccacuucaacaccagcuggauguccugggacggcugcgaccuagacuacuacugcaacaugggugacuggccaucaugcaccuacaccggcguuacccaacauaaccacgccgccuucguaaaccuacucaacauagaaacagacuacacaaagaccuuucacuuccacucaaaacgcgucaccgcacacggagacaccccucaacucgaccuaaaagcacggccgaccuacggcgccggcgaaaucacaguccugguagagguagccgacauggaacugcacaccaagaaagucgagauauccggccucaaauucgccagccucaccuguacuggcugcuacgccugcuccuccggcauaagcugcaaaguccguauccacgucgaugaaccagacgaacuaaccguccacgucaaauccagcgacccagaugucguagccgccucuacaucccucauggcacgcaagcucgaguucggaaccgacucuacauucaaagcguucuccgcaaugcccaaaaccucgcucuguuucuacauagucgaaagggaauacugcaaauccugcuccgaagacgacaccaagaaaugcgucgacacaaaacuagaacagccccagucaauccucaucgaacauaaagggaccaucaucggaaaacagaacgacacgugcaccgccaaagcaagcugcuggcucgaaagcgucaagagcuucuucuacggccucaaaaacaugcuaggcuccguguucggggguuucuucguagguauccuccuauuccuugcccccuucguccuucucguccuuuucuucauguucggcuggaaaauacuauuuugcuucaaaugcugccggagaacccgaggacuauucaaguaccgacaccucaaggacgacgaagaaaccggcuaccggcgcaucauagaaagacucaacagcaagaaaggcaaaaaccgacugcuagacggcgaacgccucgcagaccgcaaaauugccgagcuauucagcaccaaaacccacaucgga

SEQ ID NO: 15749 - RNA, 1932 nt, Artificial Sequence
  derived and/or modified CDS sequence (opt11) from CCHFV(Oman-199809166)__KR864901.1__Gc
uuccucgacucaaucgcuaaaggcaugaaaaaucuacucaacucaacaagccucgagaccucucucuccaucgaagcccccuggggcgccaucaacguacaauccacauucaaaccaaccguaagcacagccaacauagcucucuccuggagcaguguggaacaccgcggaaacaaaauacucgucagcggacgcagcgaauccaucaugaaacucgaagaacgcacaggcauauccugggaccuaggagucgaggacgccuccgagagcaaacuccugaccgucagcgucauggaccucucccagauguacucacccguguucgaauaccucagcggagaccgacaaguagaggaauggccgaaagcaaccugcaccggagacugucccgaacgaugcggcugcaccucaucaacaugccuccacaaggaauggccccacucccggaacuggcguugcaaccccacauggugcuggggcgucggcaccggaugcacuugcugcggacucgauguaaaagaccuauucaccgacuacauguucgucaaauggaaaguagaguacaucaaaacggaagccaucgugugcguagaacugacuucccaagagcgccaaugcuccuuaaucgaagccggaacucgcuuuaaccuaggcccugucacuauaacgcuuucagaaccucggaacauccagcaaaagcuacccccagaaaucguaacccuccauccgcgcauagaagaaggcuucuucgaccucaugcacguccaaaaaguacuaagcgccuccaccguaugcaaacuacaauccugcacccacggcgucccaggcgaccuacaagucuaccacaucgguaaucuacucaaaggagacaaagucaacggccaccucauccacaaggucgaaccacacuucaacacuuccuggauguccugggacggcugcgaccuagauuacuacugcaauaugggagacuggcccucaugcaccuauaccggggugacacaacacaaccacgccgccuucguaaaccuccucaacauagaaaccgacuacaccaaaaauuuccacuuccacuccaaacgagucaccgcccacggagacacaccccaacuagaccucaaagcacgcccaaacuacggcgcuggcgaaauaacaguacuggucgagguugccgacauggaacuacacaccaagaaaaucgaaaucuccggccucaaauucgccucgcuaaccugcaccggaugcuacgccugcucuagcggaaucuccugcaagguccgcauucacgucgacgaaccggacgaacucaccguccacgucaaauccgaggacccggacaucgucgccgccucauccuccuuaauggcccgcaaacuagaguucggcaccgacucaaccuuuaaagcauucuccgccaugccuaaaaccucgcucugcuucuacauaguugaaagagaauacugcaaguccugcucaaaagaagacacccaaaaaugcgucaacgccaaacuagaacgaccccaaucgauccucaucgaacauaaaggaaccauuaucggcaaacaaaacgauacauguaccgccaaggcaucaugcuggcucgaauccguaaaaucauucuucuacggacucaagaacaugcucucaggaaucuucggaaacgucuucauagguaucuucuuauuucuggccccauucauccuccuaauccuguucuucauguucggauggcgaauccuauucugcuucaaaugcugccggcgcacccgcggccucuucaaauaccgccaucucaaagacgacgaagaaaccggcuaccgcaaaauaaucgaacgccucaacaacaagaaaggcaaaaacaaacucuuagauggcgaacggcucgccgacagaaaaauagccgagcuauucaguacaaaaacacauaucggc

SEQ ID NO: 15750 - RNA, 1932 nt, Artificial Sequence
  derived and/or modified CDS sequence (opt11) from CCHFV(200406546-Turkey)__KR864902.1__Gc
uuucucgacuccaucgucaaaggcaugaaaaaccuacucaacuccacaagccuagaaacaucccugagcauagaagcccccuggggcgccaucaacguccaaucaacauucaaacccaccguaagcaccgccaacaucgcucucagcugguccuccaucgaacaccgcggcaauaaaauccucgucaccggccgcucugaauccaucaugaaacuagaagaacgaaccggcgucuccugggaccuaggaguagaagacgcaagugaguccaaacuccucacagugucaauaauggaccucucgcagauguacuccccgguguucgaauaccucuccggagaccgccaagucgaagaauggcccaaagcaaccugcaccggagacugucccgaaagaugcggcugcaccuccucaacaugccuacacaaagaauggccccauucccgaaacuggcgauguaaccccaccuggugcuggggaguaggcacgggcuguaccugcugcggagucgacgucaaagaccucuucaccgaccacauguucgucaaauggaagguggaauacaucaaaaccgaagccaucguuugcgucgaacucaccucucaagaacgucaaugcagucucaucgaagcaggcacgcgauucaaccucggcccuguaaccaucacccucuccgaaccccgaaacauucaacaaaaguuacccccagaaaucauaacccuucaccccaaaguagaagaaggcuucuucgacuuaaugcaugugcaaaaaguccucagugccucuacaguaugcaaacuccaauccugcacccacggaaucccaggcgaccuccaaguauaccacaucggaaaccuacuaaagggcgaucgcguuaacggacaucuaauccacaaaaucgaaccccacuucaacacuagcuggaugaguugggacggcugcgaccucgacuacuacugcaauaugggugacuggcccuccugcacauacaccggaguaacccagcacaaccaugccgccuuuguaaaccuauugaacauagaaacagacuacaccaaaaccuuccauuuccauucaaaacgaguuaccgcccacggcgauacaccccaacuagaccucaaagcacgacccaccuacggcgccggcgagauaaccguccuagucgaaguagcagacauggaacuccacaccaagaaagucgaaauuuccggccucaaauucgcuucccuggccugcacaggcugcuacgcaugcuccagcggcauaucuugcaaaguccgcauacacguagacgaaccagacgaacucacaguccacguaaaauccucagaccccgacgucguagccgccucaacuucgcuaaccgcccgcaaacuggaguucggcaccgacucaaccuucaaagcauucucggcaaugcccaaaaccucccuaugcuucuacaucguggaaaaagaauacugcaaaagcugcaacgaagaugacacacaaaaaugcguagacaccaagcucgagcaaccacaaucaauccuaaucgagcacaagggcacgaucaucggcaaacaaaacgacacgugcaccgccaaagccuccugcuggcuggaaagcguaaaaucguucuucuacggucuuaaaaacaugcucggcuccguauuugguaacuucuucaucggaauccuacuguuccuagccccauucguacuccuaguccucuucuucauguucggcuggaaaauacucuucugcuucaaaugcugcagacgcacccgaggacuauucaaauaccgacaccuaaaagacgacgaagaaacaggcuauaaacgcaucauagaacgccuaaacaacaagaaaggcaaaaaucgccuccucgacggcgaacgacuagccgaccgcaaaauagccgaacuauucuccaccaaaacacacaucggc

SEQ ID NO: 15751 - RNA, 1932 nt, Artificial Sequence
  derived and/or modified CDS sequence (opt11) from CCHFV(1-CR/HU-2015)__KU161584.1__Gc
uucuuagacagcauaguaaaaggaaugaaaaaccuacuaaauucaacgagccuagaaaccagccucucaaucgaagcaccguggggagcuauaaacguucaaucaacguucaaaccaaccgucucuacggccaacauugcacucuccugguccagcgucgagcaccgcggcaauaaaauacucgucaccggacgcucagagucaauaaugaaacuagaggaacgaacuggaguauccugggaccuaggcgucgaagacgccucagaauccaaacuccuaaccgugucaaucauggaccucucccaaauguacucgcccguauucgaauaucuaagcggggaccgccaagucgaagaauggccaaaagcaaccugcacaggcgacugccccgaacgcugcggaugcacaagcagcaccugucugcacaaagaauggccucauucacgcaacuggcgcuguaaccccacaugguguuggggcgucgguaccggaugcacauguugcggcguagacgucaaagaccucuuuacagaccacauguucgucaaauggaaagucgaauacauuaaaaccgaagcaaucgucugcguggaacugaccucccaagaacgccaaugcagccuaauagaagcuggcacacgcuucaaccucggacccguaacaauaacccucuccgaaccacgcaacauccagcaaaaacuuccucccgaaaucaucacacuacaccccaaaaucgaagaaggcuucuucgaccuaaugcacguacaaaagguccugucagcauccacgguaugcaaacugcaaucgugcacacacggcauacccggagaccuacaggucuaccacaucggaaaccuacuaaaaggugaccgagucaacggacaccuaauacacaaaaucgaaccccacuucaacaccuccuggaugagcugggacgggugcgaccucgacuacuacugcaacaugggggacuggccgagcuguacauacacaggagugacccaacacaaucaugcagccuuugucaaccuccucaacaucgaaacagacuacacaaaaaccuuccacuuccacagcaaacgcgucaccgcacacggagacacgccccaacuugaccuaaaagcccggcccaccuacggagcaggcgaaauaaccgugcuggucgagguugcggacauggaacuucacacgaagaaagucgaaaucuccggacucaaauucgccucacucgcuugcacaggcugcuacgccugcuccuccggcaucucaugcaaagugcguauccacguagacgaacccgacgagcuaaccguccacgucaaaagcucagacccugacguaguagcugcauccacaucgcucauggccagaaaacucgaguucggcacagacucaacuuucaaagccuucagcgccaugccaaaaacuucccucuguuucuacaucgucgaacgggaauacugcaaaagcugcagcgaagacgacacaaagaaaugcgucgacaccaaacuggagcaaccccagagcauacucauagaacacaaaggaaccaucaucggcaagcaaaacgauaccugcacagccaaggcuucaugcuggcuggaguccgucaaaucauucuucuacggccugaaaaacaugcucggcuccgucuucggcaacuucuucauuggaauacuccuauuccucgccccguucguccuacugguccuauucuucauguucggcuggaaaauccuauucuguuucaaaugcugccgacgaacacgaggccucuucaaauaccgccaccugaaggacgacgaagaaacaggcuaccgucgcaucauagaacgccucaacaacaagaaaggcaaaaaccgacuauuggacggcgaaagacucgcagaccgcaaaauagccgaacucuucagcacaaaaacccacaucggc

SEQ ID NO: 15752 - RNA, 1932 nt, Artificial Sequence
  derived and/or modified CDS sequence (opt11) from CCHFV(Gaib)__KX013445.1__Gc
uucagugacuccauagucaaaggcaugaaaaaucuacucaauucaacuagccucgagaccucacuaucgauugaagcacccuggggcgcaaucaacguccaauccacuuucaaacccaccgucagcacugccaauaucgcacuauccuggagcuccaucgaacaccgaggcaacaaaauccuggucuccgggcgcagcgaaagcaucaugaaacucgaagaacgaaccggcauaucuugggaucugggagucgaagacgcaagcgaguccagacuccucacagucaguguaauggaccucucgcaaauguacucgcccguuuucgaguaccucuccggcgaccgccaagucgaagaauggcccaaagcaacaugcaccggggacugccccgaacgcugcggcugcaccuccucaaccugcuuacacaaagaguggccacacucccgcaacuggagaugcaacccgaccuggugcuggggcguaggcaccgguugcacaugcugcggccuagacgucaaggaccucuucacggacuauauguucgucaaguggaaagucgaguacaucaaaacggaagccaucgucugcgucgaacucacuucccaagaacgccaaugcucucucauagaagcaggcacacgcuucaaccucggccccgucacgauuacucuauccgaaccccgaaacauccaacaaaaacucccacccgaaaucauaacccuacacccccgcaucgaagaaggcuucuucgaccuaaugcacguccaaaaaguccucuccgccuccaccgucugcaaacuacaaucauguacacacggaguaccgggcgaccuccaagucuaccacauaggcaaccuccucaaaggcgacaaaguaaacggacaccucauccacaagauagagccccacuucaacacauccuggaugagcugggacggcugcgaccucgacuacuacugcaacaugggcgacuggcccucaugcaccuacaccggcgucacacaacacaaccacgcggccuucguaaaccucuuaaacaucgaaaccgacuacaccaagaacuuccacuuccacucaaaacgaguaacugcacacggugacacuccccagcucgacuugaaagccagaccgaccuacggcgccggcgaaaucaccgugcucgucgaggucgccgacauggaauugcacaccaaaaagaucgagaucucaggacucaaauuugccucccuaacgugcacuggaugcuacgccuguuccuccggaaucagcuguaaaguacgcauccacgucgacgaaccggacgaacucacaguccauguuaaaagcgaagacccagacauagucgcagccuccucaucacucauggcccgcaaacuugaauuuggcacggacuccaccuucaaagccuucucggccaugccaaaaacaucucuuugcuucuacaucguagaacgcgaauacuguaaauccugcuccagagaagacacccaaaaaugcguaucaaccaaacuggaacaaccccaauccauccucauugagcacaagggcacgaucaucgguaaacaaaacaauaccugcaccacaaaaacaacaugcuggcucgagagcgugaaauccuucuucuacgggcuuaaaaacaugcucuccuccaucuucggcaacgucuucguuggcaucuucuccuuucucgccccauucauccuccucauccuuuucuucauguucggcuggcgcauauuauucugcuucaaaugcugccgacgcacacgaggccuguucaaauaccgccaccuuaaagacgacgaagagaccggguaccgacgcauaauugagcgucuaaacaacaagaaaggcaaauccaaacugcuggacggcgaacgccuagccgaccgaaaaauugcugaacucuucucaacaaaaacccauaucggc

SEQ ID NO: 15753 - RNA, 1932 nt, Artificial Sequence
  derived and/or modified CDS sequence (opt11) from CCHFV(Hodzha)__KX013448.1__Gc
uuccucgacuccauuguaaaaggcaagaaaaaccuacuaaacucaacaucccucgaaaccucccuuuccaucgaagccccauggggagccaucaacguccaauccaccuacaaaccaaccgucaguaccgccaacauagcccuaucgugguccucugucgaacaccgcggcaacaaaauccugguauccggcagauccgaauccauaaugaaacuagaagaacgaaccggcaucucgugggaccucggcgucgaagacgccucagagagcaaacuacucaccguuuccgucauggaccuaucacaaauguacucgccaguauucgaauaccuaucaggagaccgacagguagaagaauggcccaaggcgacaugcaccggggacugcagugaacgcugcggcugcaccuccucaacaugccuucacaaagaguggccccacucacgcaacuggcgauguaaccccaccuggugcuggggcguaggaacaggcugcaccuguugcggucucgacgucaaagaucuauuuacggauuacauguucgucaaauggaaagucgauuacaucaaaacggaagcaaucgucugcgucgaauugaccucgcaagaacgccagugcucacucgucgaagccggcacacgauucaaccucggcccaguaacaaucacgcucuccgaaccacgcaacauccaacaaaaacuacccccugaaaucauaacccuccacccccgaauagaagaaggcuuuuucgaccucaugcacguccaaaagguacucuccgcaaguaccguaugcaaacuucaaaguugcacacacggaguuccaggagaccuucaaguguaucacaucggaaaccuccuaaaaggagacaaagucaacggccaucuaauccacaaaauagaaccccacuucaacaccucguggaugucaugggacggcugcgaccucgacuauuacugcaacaugggagacuggcccuccugcaccuacacgggagucacucaacacaaccacgccucauucgucaaccuacugaacaucgaaacagacuacacaaaauccuuccacuuccacuccaaacgagucaccgcccacggugacaccccacaacucgaucuaaaagcccgccccacguacggcgccggcgaaaucaccguccuaguagaagucgcggacauggaacuccacacuaagaaaaucgagaucaccggccucaaauucgccucacugaccugcaccgggugcuacgccuguuccucaggcauaucaugcaaaguccgaauccacgucgacgaaccagacgaacuuaccguccacguaaaaagcgacgaccccgacguaguugccgccagcucaucccuaauggcccguaaacucgaguucggcacagacagcaccuucaaagcauuuuccgccaugcccaaaaccucucucugcuucuacauagucgaacgagaauauugcaaauccugcuccaaagaagacacccaaaaaugcguuaacacaaaacuagaacaaccacaauccauccuuaucgaacaaaaaggaacaaucauuggcaaacagaacaauaccugcacagccaaagccuccugcuggcuugaaagugucaaauccuucuucuacgggcuuaaaaacaugcuauccggcauauuuggcaacguuuucguaggaaucuuccuauuccuagcaccauucauacuacucauacuguuuuucauguucgguuggcguauccuuuucugcuuuaagugcugccgacgcacacgcggccuuuuuaaauacaagcaccugaaggacgacgaagagaccgguuaccgccgcaucaucgaacgccuaaacaacaagaaaggcaaaaacaaacuccucgacggagaaagacucgccgaccgccgcaucgcagaacucuucagcaccaaaacacacaucgga

SEQ ID NO: 15754 - RNA, 1932 nt, Artificial Sequence
  derived and/or modified CDS sequence (opt11) from CCHFV(IbAn7620)__KX013451.1__Gc
uuucucgacucaaucgcaaaaggcaugaaaaacccccucaacucuacuagccucgaaaccucccucuccaucgaggccccguggggagccaucgacguacagucaacauacaaaccaaccguaagcaccgcaaauaucgcccucucuuggagcagcguggaacaccgcggcaacaaaauccuggucucaggccgauccgaaucaauaaugaaacucgaagaacggacagggaucucuugggaccuaggagucgaagacgcgagcgaauccaaacuacucaccgucuccgucauggaccucucgcaaauguacucgccagucuucgaauaccucagcggcgaccgacaagucgaagaguggccgaaagcgaccugcaccggcgacugucccgaacgcugcggaugcacuucguccaccugucuacacaaagaauggccacacagucgcaacuggcgcugcaaucccaccuggugcuggggcguaggaacaggaugcacaugcugcggccucgacguuaaagaucuauucacagauuacauguucgucaaauggaaagucgaguacaucaaaaccgaagccaucgugugcgucgaacucacaucccaagagagacagugcucacuaauagaagcaggcacucgcuucaaccuuggacccgucaccaucacccucucugaaccucgaaacauacaacaaaaacuaccgccggagaucaucacacuacacccacgcaucgaggaaggcuucuucgaccuuaugcacguccagaaaguccucucagcauccaccgucugcaaacuacaauccugcacccacggcguacccggcgaccuccaaguauaccacaucggcaaucuacuaaaaggcgacaaagucaacggccaccucauccacaaaaucgaaccccacuucaacaccucguggaugagcugggacggaugcgaucucgacuauuacugcaauaugggcgacuggcccucaugcacguacacaggaguaacccagcacaaccacgcgagcuuugucaaccuccuaaacaucgaaacagacuacaccaaaaauuuccacuuccacuccaaacgagucacagcccacggcgauacaccccaauuagaccuaaaagcccgcccaaccuauggagccggagaaauaaccguccucguagaagucgccaacauggagcugcacaccaagaaaaucgaaauuuccggcuuaaaauucgccucccugaccugcaccggcugcuaugccugcucauccgggaucucaugcaaagucaggauccacgucgacgaacccgacgaacucacgguccacguaaagucagacgauccugacgucgucgccgccagcuccucacucauggcccgcaaacucgaguucggcaccgacucgacauuuaaagcauucuccgccaugcccaagaccucccuaugcuuuuacaucguagaacgcgaacacugcaagagcuguagcgaagaagacaccaaaaagugcguaaacaccaaacucgaacaaccccaaagcauucuaauagagcacaaaggcaccaucaucggcaaacaaaauucgaccugcaccgccaaggccuccugcuggcuagaauccguaaaauccuucuucuacggccucaagaacaugcucucaggcaucuucgggaacguauucaugggcaucuuucucuuccucgccccauucauccuccuaauccuguucuucauguucggcuggcgcauacucuucugcuucaaaugcugccggcgcacacgcggacuuuuuaaauaccgccaucucaaagacgacgaagaaaccggauaccgacgcaucauugagcgccuaaacaacaagaaaggcaaaaacaaacuccucgacggcgaacgcuuagcggaccggcgaaucgccgaguuauucucaacaaaaacacacauagga

SEQ ID NO: 15755 - RNA, 1932 nt, Artificial Sequence
  derived and/or modified CDS sequence (opt11) from CCHFV(K128_76)__KX013454.1__Gc
uuccaagacuccaucguaaaaggcaugaaaaaccuccugaacucaaccucacucgagaccagucucagcaucgaagccccauggggcgccauaaacguccaaagcaccuacaaacccgccguaagcgccgccaacaucgcccucuccuggucauccguagaacaccgagggucuaagauacucguaucaggucgaucagaguccauaaugaaacucgaggaacgaaccggaaucucgugggaucuaggaguagaagacgcaagcgaaagcaaacuccuuaccgucagcguaauggaccucucccaaauguacagccccguauucgaauaccugagcggggaccgccaagucgaggaauggccaaaagcaacuuguaccggggacugcccggaacgcugcggcugcaccucuuccacuugccuccacaaggaauggccacacuccaggaacuggcgaugcaaccccacauggugcuggggcgucggcacuggcuguaccugcugcggacucgacgucaaggaccuauucacggacuacauguucguuaaauggaaagucgaauacauaaaaaccgaagccaucgugugcguagaacucacaucacaggaacgccaaugcucacuaauagaggcgggcacacgauucaaccuaggaccuguaaccaucacccucuccgaaccaagaaacauccaacaaaagcucccucccgaaaucauaacacugcacccacgaaucgaagaaggauucuucgaccucaugcacgugcaaaaaguccuaagugcgagcacagucugcaaacuacaauccugcacccacggagucccaggcgaccuccaggucuaucacauaggcaaccuccuaaagggcgaccgagucaacggccaccuaauccauaagaucgaaccccacuucaacaccuccuggauguccugggacggaugcgaccucgauuacuacugcaacaugggagacuggcccagcugcacguacaccggcgucacccagcacaaccaugccagcuuuguaaaccuacuaaacaucgaaaccgacuacaccaagagcuuccacuuccacuccaaaaggguaacagcacacggagacaccccucaauuagaccucaaagcacggccgaacuacggugcaggcgaaauaaccguccugguagaagucgcagacauggaacuacacacgaagaaaaucgagaucucgggucucaaauucgcuucacuaaccugcacgggcugcuacgcaugcucaagcggaaucuccugcaaaguacggauccacgucgacgaaccggacgagcuaaccguucacguaaaaagcgacgacccggacguagucgcagcuuccucaagccucauggcccgcaaacuagaguucggaacggacucaacauucaaagccuucuccgccaugcccaaaaccagccuaugcuucuacaucgucgaaagggaauacugcaagagcugcuccaaagaagacacccagaaaugcgucaacacaaaacucgaacaaccacaauccauccucaucgaacacaagggcacaaucaucggcaagcaaaacaauaccugcacggcaaaaacuuccugcuggcuagaaagugugaaaucauucuucuacggacugaaaaacaugcucucaggaauauucggcaacgucuucgucggaauauuucucuuccucgccccauucauacuccuaauccuauucuucauguucggcuggcgaauacucuucugcuucaaaugcugccggcgcacacgcggucucuucagauacaaacaccucgaaaacgacgaagaaaccggguaccggagaauaauagaacgacugaacaacaagaaaggcaaaaacaaacuccuagacggcgaacgccuagcggacaggcgaauagcagaacuuuucuccacgaaaacccacaucggc

SEQ ID NO: 15756 - RNA, 1932 nt, Artificial Sequence
  derived and/or modified CDS sequence (opt11) from CCHFV(K168_40)__KX013457.1__Gc
uuccucgacggcauagucaaagguaugaaaaaccuccucaacucuaccucccuagagacaagccucuccaucgaagcccccuggggcgcaaucaacguccaauccacuuacaaaccaaccguaagcgcagccaacauagcacuuuccugguccagcguagaacaccgcggaaacaaaauccucguaaguggcagaagcgaaagcaucaugaaacucgaggaacgcacagggauauccugggaccucggcgucgaggacgcauccgaaagcaaacuauuaacagucucagucauggaccucucacaaauguacucacccgucuucgaguaccuaucaggcgaccgccaaguagaggaauggcccaaagccacaugcacuggagacugccccgaaagaugcggcugcaccagcagcacaugccuacacaaagaauggccccacucacggaacuggagauguaaccccacauggugcugggguguaggcaccggcuguaccugcugcggccuagacguaaaagaccuauucacagacuacauguucguaaaauggaaaguagaauacaucaaaaccgaagcaaucgucugcguagaacucacaagccaagagcgccagugcucgcucaucgaagccggaacacguuucaaccuaggccccgucaccauaacacucuccgaaccacgcaacauucagcaaaagcucccacccgaaaucauaacccuacacccccgaaucgaagaggguuucuucgaccucaugcacguccaaaaaguacuaucugccagcacaguaugcaaacuccaaucaugcacccacggcgucccaggcgaucuccaggucuaccacaucggaaaucuccuaaaaggcgacaaagucaauggucaccucauccacaagaucgaaccgcacuucaacaccuccuggaugucgugggacggcugcgaccuagacuacuacugcaacaugggagauuggcccucaugcaccuacacuggcgugacccaacacaaccacgccuccuucaucaaccuacucaacauagaaaccgacuacaccaaauccuuccacuuccacuccaaaagaguaacggcccacggcgacaccccgcaacucgaccucaaagcccgaccgaacuacggagcaggcgaaaucacgguccucgucgaagucgccgacauggaacuacacacgaagaaaauagaaaucucaggccugaaauucgccucgcuuacaugcaccggaugcuaugccugcuccucaggaaucagcugcaaagucaggauccacgucgacgaaccagacgaacuaaccguccacgugaaaagcgacgaucccgacguggucgccgccucaagcucccucauggcgagaaaacucgaguuuggcacggacucaaccuucaaggcuuucucggccaugcccaagacauccuugugcuucuacaucgucgaacgagaauacugcaaaagcugcuccaaagaagacacccaaaaaugcgucaacaccaagcuagagcacccucaaucaauccuaaucgaacacaaagguacaaucauaggcaaacaaaauaacacgugcacugcaaaaacaucaugcuggcucgaaagcgucaaauccuucuucuacggacucaaaaacaugcucagcggaauauucggcaacgucuuugugggaaucuuucuauuccucgcccccuucauccuccucauccucuucuucauguucgguuggcgcauccuauucugcuucaaaugcugccgacgaacccgaggccuauuccgcuacaaacaccucgaggacgacgaagagaccggcuaccgacgcaucaucgagagacuuaacaacaagaaagguaaaaacaaacuucuagacggagaacgccucgccgaccgucgaaucgccgaacucuucagcacaaaaacacauauaggc

SEQ ID NO: 15757 - RNA, 1932 nt, Artificial Sequence
  derived and/or modified CDS sequence (opt11) from CCHFV(K168_125)__KX013460.1__Gc
uuccucgacucaaucgucaaaggcaagaagaaccuccucaacuccaccucccucgaaaccagccucuccaucgaagccccguggggcgcaaucaacguccaauccaccuacaaaccaaccguaucugccgcaaacaucgcacucuccugguccagcgucgaacaccgcggcaacaagauacuugucuccggucgcagcgaaagcauaaugaaacucgaagaacgcacaggcaucaguugggaccuaggagucgaggacgcaagcgagaguaaacuccugaccguauccgucauggaccuaucacaaauguacuccccagucuucgaauaccucucuggcgacagacaagucgaagaauggcccaaagcaaccugcaccggcgacuguccugaacgaugcggcugcaccucaucaaccugccuacacaaagaauggccccacucccgaaacuggcgaugcaaccccacauggugcuggggcgucggcaccggcugcacaugcugcgggcucgacguaaaagaucuuuucaccgacuauauguucguaaaauggaaaguagaauacaucaaaacagaagcgaucgucugcguggaacuaaccucccaagaacgccaaugcucacucauagaagcgggcacccgcuucaacuuaggcccggugaccauuacccuauccgagcccagaaacauucaacaaaaauuacccccagaaaucaucacacuccacccacgaaucgaagaaggcuucuucgaccucaugcacguccaaaagguccuaagcgcaucaaccgucugcaaacuacaauccugcacacacggagucccuggcgaccuccagguguaccacaucggaaaccuccuaaaaggcgacaaagucaacggacaccucauccacaaaauugagccccacuucaacacaaguuggaugagcugggauggaugcgaccucgauuacuacugcaacaugggagacuggcccuccugcacauacaccggagucacccagcacaaccacgccagcuuuaucaaccuccuuaacaucgaaacagacuacaccaagagcuuccacuuccacuccaaacgggucaccgcacacggcgacacgccccaacuagacuugaaagcccgcccaaacuacggcgcaggcgaaaucaccguccucgucgaaguagcagacauggaacugcacaccaaaaagaucgagaucuccggccucaaguucgccucccuaacgugcacgggcuguuacgcgugcucaagcggcaucucgugcaaaguuagaauccaugucgacgaacccgacgaacucaccguacaugucaaauccgaugaccccgacguaguagcagccucgucaucccuaauggcccgcaaacucgaguucgggaccgacucgaccuucaaagccuucagcgcaaugccaaaaaccucccucugcuucuacaucguagaacgggaauacugcaaaagcugcuccaaagaagacacccaaaaaugcgucaacaccaagcucgaacacccccaauccauccucaucgaacauaagggaaccaucaucggcaaacaaaacaauaccugcacagcgaagaccucgugcuggcucgaauccguaaaaucguucuucuacggacuuaagaacaugcucucaggcaucuucggcaacguauucgucggcaucuuccuauuccuugcaccauucauccuucucauccucuucuucauguucggcuggcgaauacuauucugcuucaaaugcugccgccgcacacgcggccucuuccgcuacaaacaccucgaagacgacgaagaaacgggauaccgacgcaucaucgaacgccugaacaacaagaaaggcaaaaacaaacuccuagacggcgaacgccucgcggaccgccgaaucgcagaacucuucagcacgaaaacccacaucggc

SEQ ID NO: 15758 - RNA, 1932 nt, Artificial Sequence
  derived and/or modified CDS sequence (opt11) from CCHFV(K229_194)__KX013463.1__Gc
uuucucgacagcaucgucaaaggcaagaaaaaucuucugaacagcaccucccucgaaaccagccucuccaucgaagccccauggggcgcaauaaauguccaguccacauuuaaaccaacagucagcacagccaacaucgcccuauccugguccuccguagagcaccgcgggaacaagauccuaguaacuggacgguccgaaagcaucaugaaauuagaagaacgaaccggcgucuccugggaccucggggucgaagacgccuccgagucaaaacuccucaccgucucaauaauggaccucagccaaauguacucccccgucuucgaauaccucucaggcgaucgccaagucgaagaguggcccaaagcaaccugcacuggcgacugccccgaaagaugcgggugcacauccucaacaugccuacacaaagaauggccccacucaaggaacuggcgaugcaaccccacauggugcuggggcguaggaaccggcuguaccugcugcggcguagauguaaaagaccuguucaccgaccacauguucaucaaauggaaaguagaguauaucaagacagaagccauagucugcguagaacucaccucccaagaaagacagugcagccucaucgaggccggcacccgauucaaccucggccccgucacaaucacucuaagcgaacccagaaacauacaacaaaaauuacccccagaaauaaucacacuccaccccaaaaucgaagagggcuucuucgaccucaugcacguccagaaaguccucagcgccuccacugucugcaaacuucaaagcugcacccacggcauccccggcgaccuacagauauaucacauaggaaaccuccuaaaaggcgaccgacucaacggccaccucauccacaagaucgaaccacacuucaacaccaguuggaugucaugggacggcugcgaccuagacuauuauugcaacaugggagacuggcccuccugcaccuacaccggcgucacccaacacaaccacgccgcauucgucaaccuccucaacaucgaaaccgacuauacaaaaacauuccacuuccacucgaaacgagugacugcacacggagacacuccccagcuagaccuaaaagcccgccccaccuacggagccggcgaaaucacaguccucguagaaguagcagacauggaauuacacacgaagaaagucgaaaucuccggacucaaauucgcgucccuagccugcaccggcugcuacuccugcuccucuggcauuucuugcaaagucaggauccacguagacgaacccgacgaacuaaccguccacgucaaaaguuccgacccagacguagucgcugccagcacaucacucauggcccgcaaacucgaguucggcaccgacuccaccuucaaagccuucucagcaaugccuaaaacaucucucugcuucuacaucgucgaacgcgaauacugcaaauccugcuccgaagacgacacuaagaaaugcgucgacacuaaacuagaacagccccaauccauccucaucgaacacaaaggcaccaucaucggcaaacaaaacgacacgugcacagccaaagccuccugcuggcuagaaagcgucaaauccuucuuuuacggacucaaaaacaugcuaggcucagucuucggcaacuucuucgucggcauccuccuguuccucgcucccuucguccuacucguccuguucuuuauguucggcuggaaaaucuuauucugcuucaaaugcugccgacgcacccgaggccucuucaaauaccgccaccucaaggacgacgaagaaacaggcuaccgaaaaaucaucgaacgccucaacucaaagaaaggcaaaaaucgccuacucgacggugaaagauuagcagaccgaaaaauagccgaacucuucagcaccaaaacucacaucggc

SEQ ID NO: 15759 - RNA, 1932 nt, Artificial Sequence
  derived and/or modified CDS sequence (opt11) from CCHFV(K229_243)__KX013466.1__Gc
uuccuagacucaaucguaaaaggaaugaaaaaccuccucaauagcacaucacucgaaacaucccuaaguaucgaagcccccuggggcgccaucaacguccaaagcaccuucaaacccaccgucucaaccgccaacaucgcgcucagcugguccuccgucgaacaccguggcaacaagauccuggucacaggacggagcgaauccauaaugaaacucgaggaacggacgggcguaucgugggaccucggcguagaagacgcauccgaaagcaagcuccucacagucuccaucauggaccucucacaaauguacucgccaguauucgaauaucucucaggcgacagacaggucgaagaguggcccaaagcgaccugcacuggugacugcccagaacgcugcggcugcacuuccucaaccugccugcacaaagaauggccacacagucgcaacuggcgcugcaaucccaccuggugcuggggaguagggacaggcugcacaugcugcggcgucgacgucaaagaccucuucaccgaccacauguucguaaaauggaaaguagaauacaucaaaaccgaagccauagucugcgucgaacucaccucccaagagagacaaugcucacucaucgaggccggcacccgcuucaaccuaggccccguaacgaucacacucucggaaccucggaauauucaacaaaagcuacccccagaaauaauuacccuccacccaaaagucgaagaaggcuucuucgaccucaugcacguacaaaaaguccucucagcaucgacagucugcaaacuccaauccugcacccacggcauuccaggcgaccuccagguuuaccacaucggcaaccuacucaaaggagaccgcguaaacggccaucuaauccacaaaauagaaccccacuucaacaccucauggaugucgugggacggcugcgaccuagacuauuacugcaacaugggcgacuggccauccugcaccuacaccggcgucacacaacacaaucacgccgccuucgucaaccuccugaacauagaaaccgacuacacaaagaccuuucacuuccacuccaaacgcguaaccgcccacggagacacaccccaacuagaccuaaaagcucgcccgaccuacggcgccggcgaaaucaccguacucgucgaagucgcagacauggaacuacacaccaagaaagucgagaucucaggacucaaauuugcaucacucgcuugcaccggcugcuacgccugcuccuccggcaucagcugcaaagugagaauccacguugacgaaccagacgaacucaccguacacgucaaaucauccgaucccgacgucguagcagccucaaccucacuaauggcucgcaaacuagaguucgguacggacucaacauucaaagccuucucagccaugccaaaaaccagccucugcuucuauaucguagaaaaagaauacugcaaauccugcuccgaagaagacacacaaaaaugcgucgacaccaaauuagaacaaccccaauccauccucaucgaacacaaaggaacaaucaucggcaagcaaaacgacaccuguacagccaaagccucgugcuggcuagaaagcgucaagucauucuuuuacggccucaaaaacaugcucggcucaguguucggcaacuuuuucauagggauccuccucuucuuaaccccauucguucuccucgugcuauucuucauguucggauggaaaauacucuucugcuucaaaugcugccgccgaacacgcggacugcucaaauacagacaucuaaaagacgacgaagaaaccggauaccgccgaaucaucgaacgccugaacaacaagaaaggcaaaaaccgccuccucgacggagaacgccuugccgaccgaaaaaucgccgaacucuucagcaccaaaacccacaucgga

SEQ ID NO: 15760 - RNA, 1932 nt, Artificial Sequence
  derived and/or modified CDS sequence (opt11) from CCHFV(K315_14)__KX013469.1__Gc
uuucuagacaguaucgucaaggguaugaagaaacuccuuaacagcaccagucucgagaccucgcuauccaucgaagccccguggggagcaaucaacguccaaucaacuuucaaacccaccguaagcacggccaacaucgcccuaaguugguccagcguagagcaccgaggcaacaaaauccucgucaccggccgauccgaaucuaucaugaaauuagaagaacgcacaggcguauccugggaccucggcgucgaagacgcuucagaauccaaacuccucaccgucucgaucauggaccuaagccaaauguacucacccguauucgaauaccuauccggagaccgacaaguagaagaauggcccaaagcaaccugcaccggcgacugcccagagcgaugcggaugcacuucauccacaugccuacacaaagaauggccccacucccgcaacuggagaugcaacccuaccuggugcuggggagugggaaccggcuguaccugcugcggagucgacgucaaggaccucuucacagaccacauguucaucaaauggaaggucgaguacaucaaaaccgaggccauaguuugcgucgaacucacgucccaagaaagacaaugcucgcucaucgaagccggcacacgguucaaccuaggccccguaaccaucacccucuccgagccccgaaacauacagcaaaaauuaccgcccgagauaaucacccuacaccccaaaauagaagaaggcuucuucgaccucaugcacguccaaaaaguacucuccgccuccacgguaugcaaacuccaaucaugcacccacggcauccccggggaccuacaaauauaccauauaggaaaccuacucaaaggcgaccgcguaaacggccaccuaauccacaagaucgaaccccacuucaacacgagcuggaugagcugggacggaugcgaccuagauuacuacugcaacaugggcgacuggcccagcugcaccuacaccggugucacacaacacaaccacgccgccuucguaaaccuccucaacaucgaaaccgacuacacaaaaacauuucacuuccacuccaaacgcgucacugcccacggcgacacaccccaacucgaccucaaagcccgaccaaccuacggcgccggcgagaucaccguccuagucgaaguagccgacauggaacuccacaccaagaaaguugagaucagcggccuaaaauucgccucacuaaccugcacaggcugcuacgcaugcuccucaggcaucucauguaaaguccgcauccacguugacgaaccagacgaacuaaccguccacgucaaaagcuccgacccagacgucguggcugccuccaccucccuaauggcacgcaaacuugaguucggcaccgacucuacguucaaagcauucucagcuaugcccaaaaccagccucugcuuuuacauuguggaacgagaauacugcaaaagcuguuccgaagacgauacaaagaaaugugucgacacuaaacucgaacaaccccaguccauacucaucgaacauaaaggcacaauaaucggcaagcaaaacgauaccugcacagcgaaagccuccugcugguuagaauccgucaaaucauucuucuacggacucaaaaacaugcuaggcagcgucuucgguucguucuucguaggcauccuacuauuccucgccccauucguccuccucguccucuucuuuauguucggcuggaaaauacucuucugcuucaaaugcugccgccgcacccggggccucuucaaauaccgccacuuaaaagacgacgaagaaacugguuaccgccgaauaauagaacgccuaaacucaaagaaaggcaaaaaccgacuccuagacggcgaacgccucgcggaccggaaaaucgccgagcuguuuucaaccaaaacacacauuggc

SEQ ID NO: 15761 - RNA, 1932 nt, Artificial Sequence
  derived and/or modified CDS sequence (opt11) from CCHFV(K323_27)__KX013472.1__Gc
uuucuugacagcaucgccaaggguaugaagaaccuucuaaacucaaccucacucgaaaccucacuaagcaucgaagcccccuggggggccaucaacguacaaucaaccuucaaaccuacagucuccacggccaacaucgcccucucaugguccuccgucgaacaccguggaaacaaaauccuugucacaggacgcuccgaauccauaaugaagcucgaagaacggaccggcguauccugggaccucggcgucgaagacgccagcgaaucgaaacuccugaccguaagcaucauggaccucucucaaauguacucgccggucuucgaauaccuaucuggcgaccgacaagucgaagaguggcccaaagccaccugcaccggcgacugccccgaacgcugcggaugcacauccuccacaugccuacauaaggaauggccacacucacgcaacuggcgaugcaaucccaccuggugcuggggcgucggcaccggcugcaccugcugcggagucgacgugaaagaccuauucacagaucacauguucaucaaauggaaagucgaauacauaaaaacugaagcgauagucugcgucgaacucacgggccaagaacgccaaugcagccuaaucgaagcaggcacccgcuucaaccucggcccggucaccaucacacucucagaaccccgcaacauacagcaaaagcucccacccgaaaucaucacccuccaccccaaaaucgaagaaggauuuuucgaccucaugcacguacagaagguacuaucggccagcacuguauguaaacuucaauccugcacacacgggauacccggagacuugcagaucuaccacaucggaaaccuccugaaaggugaccguguuaauggacaccucauccacaaaaucgaaccacacuucaacacaucguggauguccugggacggaugcgaccucgacuacuacugcaacaugggcgacuggcccuccugcaccuauacgggcgucacccaacacaaccacgcagcuuucgucaaccuacugaacaucgaaacagauuacaccaagacauuccacuuccacucaaaacgcgucaccgcacacggcgacaccccacaauuagaccugaaagccagacccacuuacggcgcaggcgaaauaaccguccucgucgaagucgccgacauggaacuccacaccaaaaaagucgaaaucucgggccucaaauucgccucgcuaacaugcaccggcuguuaugcgugcuccuccggaauaucgugcaaagucaggauucacguagacgaaccagacgagcucaccguacacguaaaaucauccgacccagacgucgucgccgcauccaccagccuaauggcccgcaaacuggaauucggaaccgacucgaccuucaaagccuucucagcaaugcccaaaaccucccuaugcuucuacaucguagaacgcgaauacugcaaaucaugcuccgaagacgacacaaagaaaugcguagacaccaaacucgaacaaccacaauccauacuaaucgaacacaaaggcaccaucaucgggaaacaaaacgacaccugcaccgccaaagccuccugcuggcucgaaagcguaaaauccuucuucuacggacuaaagaacauguuaggaucagucuucggaucauucuucgucggcauccugcuauuccucgccccauucguccuccuaguacucuuuuucauguucggcuggaaaauacuuuucugcuucaaaugcugccgacgaacgcgcggccucuucaaauaucgccaccucaacgacgacgaagaaaccggcuaccgccgcaucaucgaacgacucaacuccaaaaagggcaagaaucgccuccuagauggugaacgccucgccgaccgaaaaauagccgaacuauucuccaccaaaacacacaucggg

SEQ ID NO: 15762 - RNA, 1932 nt, Artificial Sequence
  derived and/or modified CDS sequence (opt11) from CCHFV(K340_6)__KX013475.1__Gc
ucccuagauucaaucgucaaagggaugaaaaaccuccucaacagcacaucccuagaaaccucccucagcaucgaagccccauggggcgcaaucaacgugcaaucuaccuucaaacccacagucucaaccgcuaacauagcacuuuccuggucguccguggaacaccgcggaaacaagauccugguaacaggccguucugagagcauaaugaaacucgaagaacgaaccggggugucuugggaccugggcguagaagacgccagcgaaucaaaacuacuaaccgucuccaucauggaccuaucccaaauguacucccccgucuucgaguaccuuuccggugacaggcaagucgaagaauggcccaaagcaaccugcaccggcgauugccccgaacgcugcggcugcaccuccagcacgugccuccacaaagaauggccccauucccgcaacuggcgcugcaaccccacguggugcuggggcgucggcaccggaugcacaugcuguggggucgacgucaaagaccuguucaccgaccacauguuuauaaaauggaaagucgaauacauaaaaacugaggccaucgucugcguagaauuaaccucccaagagcgccaaugcucacuaaucgaagccggaacccgauucaaccuaggccccgucaccauaacacucuccgaaccccgcaacauccaacaaaaacucccucccgagaucaucaccuugcaccccaagauagaagaaggcuucuucgaccucaugcacgugcagaaaguacuauccgccagcacaguuuguaaacuacaauccugcacacacggaauccccggcgaccuccagauauaucacaucggaaaccuacucaaaggcgaccgcgucaauggccaccucauacacaaaaucgagccccacuucaacaccucauggauguccugggacggcugcgaccucgacuacuacugcaacaugggcgauuggcccucgugcacguacaccggcguaacccaacacaaccacgccgccuucguaaaccuucugaacauagaaaccgacuacaccaaaaccuuccacuuccacucuaaacgugugaccgcccacggagacacaccccagcucgaccugaaagcacgccccaccuacggcgccggcgaaaucaccguccuaguggaggucaccgacauggaacuacacacaaagaaagucgaaauauccgggcucaaauuugccucccucacaugcaccggaugcuaugccugcucauccggaaucucaugcaaaguccgcauccacguugacgagcccgacgaacuaaccguacacguaaaaagcagcgacccagacgucgucgccgccuccaccucacuaauggcccgcaaacucgaguucggaaccgacagcacuuucaaagccuucagcgccaugcccaaaaccucccucugcuucuacauaguugaacgcgaauacugcaaaucaugcagcgaagacgacaccaagaaaugcguagacaccaaacucgaacagccgcaauccauccugauagagcacaaaggcaccaucaucggcaaacaaaacgauacuugcaccgccaaagccucaugcuggcuagaaagcguaaaauccuucuucuacggacucaagaacaugcugggcucagucuucggcagcuucuucgucggaauacuccucuuccuagcacccuucguccuccuaguccuuuucuucauguucggauggaaaauccucuucuguuucaaaugcugccgcagaacccgcggacucuucaaauaucgacacuucaaagacgacgaggaaaccggauacaggcgcaucaucgaacgacugaacuccaagaaaggcaaaaaccgccuccuagacggagaacgacuagccgaccgaaaaaucgcagaacuauucuccacaaaaacgcacauaggc

SEQ ID NO: 15763 - RNA, 1932 nt, Artificial Sequence
  derived and/or modified CDS sequence (opt11) from CCHFV(Mamon)__KX013478.1__Gc
uuccuggacagcaucgucaaaggcaugaaaaaccuacucaacucuacaucccucgaaaccucccucucaauagaagccccauggggcgcaaucaacguccaauccaccuuuaaacccaccgucagcaccgcaaacauagcacuuucauggucauccgucgaacaccgcggaaacaaaauccucguaaccggccguucagaauccauaaugaagcucgaagaacgaacaggcguuagcugggaccuaggcguagaagacgccagugaauccaaacuauugacaguauccaucauggaucuaucucaaauguacuccccaguauucgaauaucugagcggcgaucggcaagucgaagaauggcccaaagcuaccugcacaggcgacugccccgaaagaugcggcugcacaaguaguaccugcuuacacaaagaauggccccacagccgcaacuggcgcugcaaccccacauggugcuggggaguaggcaccgguugcacgugcugcggcgucgacguaaaagaccuauucaccgaccacauguucgucaaauggaaaguagaauacauuaaaaccgaagcaaucgucugcgucgagcuaacuucucaagaacgccagugcagccuaaucgaagcaggcacccgcuucaaccuaggcccaguaacgaucacccuaagcgaaccccggaacauacagcaaaaacuacccccagaaaucauaacccuccacccuaaaguagaagaaggauucuucgaccuuaugcauguccagaaaguacuaucagccuccacaguuugcaagcuacaauccugcacccacggcauacccggagaccuccaagucuaccacaucggcaaccuccucaaaggggaccgcgucaacgggcaccucauacacaaaaucgaaccccacuucaacaccucauggaugaguugggauggaugcgaccucgacuauuacuguaacaugggcgacuggccauccugcacguacaccggcguuacccaacacaaccaugccgccuucguaaaccuacuaaacaucgaaacagacuacaccaaaaccuuccacuuccacucuaaacgagucaccgcccacggcgacaccccgcaacucgaccuaaaagcccgacccaccuacggcgcaggagaaaucaccguccuaguggaaguagccgacauggaacuacacacaaagaaaguagaaaucagcggccucaaauucgccucacucgcgugcacgggcugcuacgcaugcagcucaggcaucucaugcaaaguccgcauccacgucgacgaaccggacgagcucacaguccaugucaaauccuccgacccagauguaguagccgcaagcacaucccucauggcgaggaaacucgaguucggaacugauuccaccuucaaggccuucucggcaaugccaaagacgucccucugcuucuacauagucgaacgagaauacugcaagagcugcagcgaagaagacacccaaaaaugcgucgacaccaaacuggaacagccccaauccauccuaaucgaacacaaggguacuaucaucggaaaacagaacgacacgugcacagcuaaaaccuccugcuggcucgaauccgugaaauccuucuucuacggccucaagaacaugcucggcagcguguucggcaacuucuuuaucggaauacuccucuuccucgcgccauucguacuccucguccuauucuucauguucggauggaaaauccuauuuugcuucaaaugcugccgccgcaccaggggccuucucaaauaccgccaccucaaagacgacgaagaaacaggauacagacgaaucauagaacgccucaacaauaagaaaggcaaaaaccgccuccucgacggcgaacgccuggcugaccguaaaaucgccgaacuauucagcacgaaaacucacaucgga

SEQ ID NO: 15764 - RNA, 1932 nt, Artificial Sequence
  derived and/or modified CDS sequence (opt11) from CCHFV(Min)__KX013481.1__Gc
uuccuggacuccaucgucaaaggcaccaaaaaccuccucaacagcacgucacuugaaacaucacucuccaucgaggcccccuggggcgccaucaacguccaaucaaccuucaaaccaaccguauccaccgcaaacauagcccucucaugguccagcgucgaacaccgcggcaacaaaauccuggucaccggccgcuccgaaucuaucaugaaacuagaagaacgcaccggcgucucgugggaccuaggaguagaagacgcuucagaaucuaaacuccuaacaguaagcaucauggaccuaucgcagauguacagcccaguguuugaauaucuuucgggcgaccgccaaguggaagaauggcccaaagcgacaugcaccggagacugccccgagcgcugcggcugcacaucaagcacaugccuccacaaagaguggccccacucacgaaacuggcgaugcaacccaaccuggugcuggggcgucggcaccggcugcacaugcugcggcguagacgugaaggaccuguucaccgaccacauguucguaaaauggaaagucgaauauauaaaaacagaagccaucguaugcguagaacucaccucccaagaaagacaaugcagccuaaucgaagccggcacacgauucaaccuaggccccgucaccaucacccuuucagaaccuagaaacauucaacaaaaacuaccacccgaaauaaucacccuccaccccaaaguagaagaaggcuucuucgaccucaugcacguccaaaaaguacuuagcgcaagcacggucugcaaacuccaaucaugcacacacggcauccccggcgaccuccaaguauaccacaucggcaaccuucugaagggugaccgcaucaauggacaccucauacauaaaauagaaccacacuucaacaccuccuggaugagcugggacggcugcgaucucgacuacuacugcaacaugggcgacuggccuuccugcaccuacaccggcgucacacaacacaaccacgccgccuucgucaaccuucucaacauugaaaccgacuacaccaagaccuuccacuuccacagcaagcgaguaaccgcucacggcgacacgccccagcucgaccuuaaagcccgaccgaccuacggagccggcgaaauaaccguccucguagaagucgccgacauggagcuccauacgaagaaagucgaaaucucaggccucaaauucgccucccucgccugcacgggcugcuacgccugcuccucugggaucuccugcaaaguccgcauccacgucgacgaacccgaugaacugacaguccacguaaaaagcuccgaccccgauguagucgccgccucaaccucccucauggcacgaaaacuagaguucggaaccgacuccaccuucaaagccuuuucagcaaugcccaagaccucacuaugcuucuacaucgucgaacgugaauacugcaagucaugcuccgaagaagacacacaaaaaugcguagacaccaaacucgaacaaccacaauccauccucauagaacacaaaggaacaauaaucggcaaacaaaacgauaccugcacagccaaagccucgugcuggcuagaauccgugaaauccuucuucuacggccucaaaaacaugcuaggaucuguauucggcaacuucuucaucggcauacuucucuuccuagcaccguucguccuccugguccucuuuuucauguucggauggaaaauccuuuucugcuuuaaaugcugccgccgcacgcguggccuccugaaauaucgccaccucaaggacgacgaagaaacuggauaccgacgaaucaucgaacgccugaacaacaagaaaggcaaaaaccgacuccuagacggagaaaggcucgcagaccgcaaaaucgccgaacucuucuccacaaaaacccacauaggc

SEQ ID NO: 15765 - RNA, 1932 nt, Artificial Sequence
  derived and/or modified CDS sequence (opt11) from CCHFV(Nakiwogo)__KX013484.1__Gc
uaccucgacucuauagcaaaaggaaugaaaucacuacucaacucaaccaaccucgaaacaucacucuccauagaggcccccuggggcgcaaucaacguccaauccacauucaaaccaaccgucuccgccgccaacaucgcacuaucuugguccucaguugaacaccgcggaaacaaaauccucgucagcggacgaagcgagagcaucaugaaacucgaagaacgcaccggcaucuccuggucucucggcgucgaagacgcgagcgaauccaaaaccuugacaguauccgucauggaccuaucacaaauguacucccccgucuucgaauaccucagcggcgaccgacaaguggaagaauggcccaaagcaacaugcaccggagacugccccgaacgcugcggcugcaccuccucaaccugccuccacaaagaauggccccacucccguaacuggcgaugcaaccccaccugguguuggggagucggcacggguugcacaugcugcggccucgacguaagagaccuguucacagacuacaugaugguaaaauggaaaguugaauacgucaaaacugaagccaucaugugcgucgaacuaacgagccaagaacgacaaugcucccucauagaagcgggcacgagauucaaucuaggacccgucaccauuacgcuaucagaaccacgcaacguacaacaacggcuaccauccgaaauaguuacccuccacccuaaaauagaagaaggcuucuucgaccucaugcacguacaaaaaguccuauucugcaaacacucccuacaggccaccagcugcacucacggcguccccggcgaccuccaagucuaccacgucggcaaccuccugaaaggcgacaaagucaacggucacucuauacacaagauagaaagccacuucaacaccuccuggauguccugggaugggugcgaccuagacuacuucugcaacaugggagacuggccaagcugcacauacacuggagucacccaacacaaccgcgccgcauucgucaacaugcucaacauugaaacagauuacaccaaaacauuccacuuucacuccaaacgcgucacagcacacggagacacaccccaacuggaccugaaagcccgacccaccuacggcgcaggcgaagucaccguccucguugaaguggccgaccucgaacuccacacaaagaaaaucgaagucucgggucuaaaauucgccagucucacaugcagcggaugcuacgccugcucuagcggcaucucaugcaaagugcgaauccaugucaacgaaccagacgaauuuacgguccacguaaaaagcaacgaccccgacguagucgccgccggaagcagccucauggcccggaaaauagaacucggcgcagacucaacauucaaagcauucagcagcaugcccaaaaacucccuaugcuucuacaucgucgaacgggacuacugcucauccugcacugaugacgacacccaaaaaugcgucaacaccaaacucgagcacccacaaucgauccucaucgaacacaaaggcacgaucauaggcaaacagaacgacacauguccaaccaaaaccucuugcuggcuagaaagcguaaaauccuucuucuacggccucaaaaacaugcucgggggcaucuucggcaacgucuuccucggcaucuuccucuucuuagccccauucgcacuccucauccuguucuuuuucuucgguuggcgccuacucuucugccugaaaugcugccgccgaacccgaggacuccugaaauacaaacaacucaaggacgaggaagaagccggcuacaagaaaauuaucgagcgccuaaacgacaagaaaggcaaaucccgccuauucgacggcgaacgacucgccgaccgaaaaauagcagagcuauucuccacgaaaacccauauaggc

SEQ ID NO: 15766 - RNA, 1932 nt, Artificial Sequence
  derived and/or modified CDS sequence (opt11) from CCHFV(Saf)__KX013487.1__Gc
uucuccgacuccaucgucaagggcaugaaaaaccuacugaacuccaccagccucgaaaccucacucucaauagaagcacccuggggcgcaauaaacguacaauccacauucaaaccgacagucucaaccgccaauaucgcgcucucuuggucauccgucgaacaccgcggaaacaaaauacucgucaccggccgcuccgaaagcaucaugaaacucgaggaacgcaccggcguauccugggaccucggagucgaagacgccuccgaaagcaagcuacugaccgucagcauaauggaucucucacaaauguacucacccgucuucgaauaccuauccggcgacagacaggucgaggaauggcccaaagccaccuguacgggcgacugucccgaacgcugcgguugcacauccuccacaugccuacacaaggaauggccacauagccgcaacuggcgcugcaacccgaccuggugcuggggugucggaaccggaugcacaugcugcgggguagacgucaaagaccucuucaccgaccauauguucgucaaguggaaaguagaauacaucaaaaccgaggcuaucguaugcguagaacucaccucccaagaacgacagugcucccugaucgaagccggcacccgcuucaaccugggcccagucaccaucacccugucagaaccacgcaacauccaacaaaaacucccacccgaaaucaucacccuccaccccaaaguagaagaaggauucuucgaucucaugcacguccaaaaaguacucuccgccagcaccgucugcaaacuacaaucaugcacccauggcauccccggagaccuccagguuuaccacaucggcaaccuccuaaagggggaccgcguuaacggccaccucauccacaaaauugaaccacacuucaacaccucauggauguccugggacggcugcgaccuagacuacuacugcaauaugggcgacuggcccucaugcacuuauacaggcgucacccagcacaaccacgccgccuucgucaaccuucugaacaucgaaaccgacuacaugaaaaccuuccacuuccacagcaaacgcgucacagcacacggagacaccccacaacucgaccuuaaagcacgcccaacuuacggagcaggcgagauaacgguccucgucgaagucgccgacauggaacuccacacaaagaaaguagaaaucucuggacucaaauucgucucucuagccugcaccggcugcuaugccugcuccucaggcaucuccugcaaaguacgaauccacgucgacgaacccgacgaacucacaguccacgucaaauccuccgacccugacguagucgcagccucaaccucccucauggcccgaaaacuggaguucggcacagacagcaccuucaaagccuucuccgcaaugccaaaaacaucccucugcuucuauaucguagaacgcgaauacugcaagucaugcagcgaagaagacacccagaagugcgucgacaccaaacucgaacaaccacagagcauccugaucgaacacaaaggaaccauuauaggcaaacaaaacgacaccuguaccgccaaagcauccugcuggcuagaaagcguaaaauccuuuuucuacggacucaaaaacaugcuaggguccgucuucggaaacuucuucaucggcauacuccucuuccucgccccuuucguacucuugguccucuucuucauguuuggauggaaaauccucuucugcuucaaaugcugcagacgcacccgcggauuacucaaauaccgacaucugaaagacgacgaagaaacaggguaccggcgcauaaucgaacgccuaaacaacaagaaaggcaaaaaccgacuccucgauggcgaacgccucgcugaccgcaaaauagccgaacucuuuucgaccaagacacacauagga

SEQ ID NO: 15767 - RNA, 1932 nt, Artificial Sequence
  derived and/or modified CDS sequence (opt11) from CCHFV(Ast199)__KX056051.1__Gc
uuccucgauaguaucgucaagggcaugaaaaaccuccuuaacuccacaagccuagagaccucacuaucaauagaagccccguggggcgccaucaacguacaaucaaccuucaaacccacagucagcaccgccaacaucgcacuauccuggucaucaguagaacacagaggcaacaaaauacucguaacgggccgguccgaaagcaucaugaaacuugaagaaagaacuggcguauccugggaccuuggaguagaagacgccagcgaaucaaaacuacugaccgucagcaucauggaccuaucacaaauguacucccccguauucgaauaccugagcggagaccgccaagucgaagaauggcccaaagcaaccugcaccggcgacugcccagaaagaugcggcugcacguccuccacgugccuacacaaagaauggccccacucccgcaacuggcgaugcaauccuacauggugcuggggcgucggcaccggcugcacaugcugcggcgucgacgucaaagaccucuucaccgaccacauguucauaaaauggaaagucgaauacaucaaaacagaagccaucgucugcgucgaacuaaccucccaagaaagacaaugcucacucauagaagccgguacccgauucaaccugggaccgguuaccauaacccuuucagaaccccgcaacauacaacaaaaacucccacccgaaauaauaacccuacaccccaaaaucgaagaaggcuucuucgaucucaugcacguccaaaagguccucuccgcauccacagucugcaaacuacaauccugcacgcacgggauccccggagaccuucaaauauaccacaucggaaaccuccucaaaggagaccgccuaaacggccaccuuauccacaaaauagagccacacuucaacaccuccuggaugucaugggacggaugcgaccucgacuauuacugcaacaugggcgacuggccaagcugcacauauaccggcgucacccaacacaaccacgccgccuucguaaaccuccucaacauagaaaccgacuauaccaagaccuuccauuuccacagcaaacgagugacugcccacggcgacacaccccaacucgaccuuaaagcacgccccaccuacggagccggagaaauaaccguacucgucgaagucgcagacauggaacuccacaccaaaaaggucgaaguaucgggacucaaauucgccucccucgcgugcaccggauguuacgccugcuccucaggcaucucaugcaaaguaaggauacacguagacgaacccgacgagcugaccguccacguaaaaucaucagacccagacgugguggcagccagcaccucacucauggcccgcaaacuagaguucgggaccgacucaaccuuuaaagccuuuuccgcaaugcccaaaaccucacuuugcuucuacaucgucgaacgagaauacugcaagagcugcagcgaagacgacaccaagaaaugcgucgacaccaaacucgaacagccccaaucaauccuaauagagcacaaaggcacgaucaucggcaaacagaaugacacaugcacagcaaaagccaguugcuggcucgaaagcgucaaauccuucuucuacggucucaaaaacaugcuaggaucuguauucggaaacuucuucguagguauacuucucuuccuagccccguucgugcuacucguccuguucuucauauucggcuggaaaauacuauucugcuucaaaugcugccgucgcacgcgcggucucuucaaauacagacaccuaaaagacgacgaagaaaccggauaccgcaaaauaaucgaacgccugaacuccaaaaagggcaaaaaucgacuacuagacggcgaacgcuuagccgaccgcaaaaucgcggaacucuucucaaccaaaacacacauaggc

SEQ ID NO: 15768 - RNA, 1932 nt, Artificial Sequence
  derived and/or modified CDS sequence (opt11) from CCHFV(Ast149)__KX056054.1__Gc
uuccucgacagcaucguaaaaggcaugaaaaaccuccuaaacuccaccucccuugagaccucccuauccauagaggcccccuggggagccaucaacguccaaucaaccuucaaacccaccgucuccaccgcgaacaucgcgcuuuccuggagcagcguagaacaucgcggcaacaaaauccuaguaaccggacgaucggaauccauaaugaaacucgaagaacgaaccggaguaagcugggaccuaggagucgaagacgcauccgaauccaaacuacuaacagucagcaucauggaccuaucccaaauguacucgcccguauucgaauaccucagcggcgacagacaagucgaggaguggcccaaagcuaccugcacaggcgacugcccagaacgcugcgggugcaccagcucaaccugccugcacaaagaauggccccauucccgaaacuggcgcugcaaccccaccuggugcuggggagucggcacgggcuguaccugcugcggaguagacgucaaagacuuauucacagaccacauguucauaaaauggaaagucgaauacaucaaaaccgaagcaaucgucugcgucgaacuaaccucccaagaacggcagugcucccucauugaggcgggaacgcgauucaaccuaggacccguaaccaucacacucuccgaaccacgaaacauccaacaaaaacugcccccagagaucauaacccuccacccaaaaauugaagaaggcuucuucgaccucaugcacguacaaaaaguccucuccgcaagcacugucugcaagcuacaauccugcacccacgguaucccgggcgaccuccaaaucuaucacauaggcaaccugcucaaaggggaccgccugaacggacaucuaauacacaaaauagaaccacacuucaacaccucauggauguccugggacggaugcgaucucgacuauuacugcaacaugggcgacuggcccuccugcaccuacaccgguguuacccaacacaaccacgccgccuucgucaaucuccucaacaucgaaacugacuacaccaagaccuuccacuuccacucaaaacgaguaaccgcccacggcgacaccccacagcuagaccucaaagcccgaccaacauauggcgcuggagaaaucacggucuuagucgaggucgccgacauggagcuccacacuaagaaagucgaagucuccggccuaaaauuugcuucgcucgcgugcacaggcugcuacgccugcuccuccggcaucucaugcaaaguccgcauccacgucgacgaacccgaugagcucacaguacacgucaaaagcagcgaccccgaugucguagccgcauccaccucccucauggcccgaaaacucgaguucggcacagacucaacauucaaagccuucuccgccaugccaaaaaccucccucugcuucuacaucgucgaacgagaauacugcaaaucaugcagcgaagacgacacaaagaaaugcgucgacaccaaacucgaacaaccccaaagcauccucaucgaacacaaaggaaccaucauaggcaaacaaaacgauaccugcaccgcaaaagcauccugcuggcuagaguccguuaaauccuucuucuacggacucaaaaacaugcuuggcuccguguucggcaacuucuucguaggcauccuacuauuccucgccccauuuguccuccuagcccuauucuucaucuucggcuggaaaauccucuucugcuuuaaaugcugccggcgcacgagaggccucuucaaauauagacaccucaaagacgacgaagagacagguuaccgaaagauaaucgaacgccucaacucaaagaaaggcaaaaaucgacuucucgacggcgaacgccuagcggaccgcaaaauagccgaacuauucuccacgaaaacccacauuggc

SEQ ID NO: 15769 - RNA, 1932 nt, Artificial Sequence
  derived and/or modified CDS sequence (opt11) from CCHFV(Ast137)__KX056057.1__Gc
uuccuggacaguaucguaaaggguaccaaaaaccuacuaaacuccaccucacucgaaacaucccuauccaucgaagccccauggggagccauaaacguucaaucuaccuucaaacccacaguaagcaccgccaacauagcgcucagcuggucgagcguggaacaccgcggcaacaagauuuuggucaccggacgcuccgaaagcauaaugaagcuagaagaacguacaggggucucgugggaccucggugucgaggacgcaagcgaaagcaagcuacuaacagucagcaucauggaccucagccaaauguacucaccaguauuugaauaccucagcggcgaccggcaaguagaagaguggcccaaagcuaccugcacaggugacugccccgagcgaugcggcugcacauccuccacgugccuccauaaagaauggccccauagccgcaacuggcgcugcaaccccaccuggugcuggggcgucggcaccggauguaccugcugcggcguagacgucaaggaccucuucacagaccacauguucauaaaauggaaaguugaguacaucaagacggaagcaaucguaugcgucgaacuaaccucccaagagcgccagugcucccuuauagaagcgggcacacgauucaaccugggcccagucacgaucacccucucagaaccccgaaacauacaacaaaaacuaccuccagaaaucaucacccuacauccaaaaaucgaagaaggauucuucgaccuaaugcacguccagaaaguccuuuccgcgagcacggucugcaaacuacaauccugcacacacgguauacccggcgaccuccaaauauaccacauaggcaaccugcucaaaggcgaccgacuaaacggccaccucauacacaaaaucgaaccccacuucaacaccuccuggauguccugggacggaugcgaccuugacuacuacugcaacaugggagacuggcccagcugcacguacaccggagucacccaacacaaccacgcagccuucgucaaccuacuaaacaucgaaaccgacuacaccaaaacauuccacuuccacucaaaacgugucacggcccacggugacacaccccaacuggaccuaaaggcgcgaccaaccuacggcgccggcgaaaucaccguccuaguagaagucgcggacauggaacugcacacgaagaaagucgaagucuccggacuuaaauucgccucgcuagcaugcacaggaugcuaugcaugcagcuccggcauauccugcaaaguacgcauccacguagacgaaccagacgagcugaccguccacgucaaauccucagaccccgacgucgucgcggcauccaccagccucauggcccgcaaacuugaguucggaacagacuccaccuuuaaagcguucucagccaugccaaaaaccucacucugcuucuacaucgucgaacgcgaauacugcaaaagcugcagcgaagacgacaccaagaaaugcgucgacacaaaacucgaacaaccacaaucgauccuaauagagcacaaaggaaccaucauuggaaaacaaaacgacacaugcaccgccaaagccuccugcuggcucgagagugucaaauccuucuucuacggacugaaaaacaugcuagguuccgucuucggcaacuucuucguaggaauacuccuguuccucgccccguucguccuucucguacucuucuucauauucggcuggaaaauccucuucugcuucaaaugcugccgacgcacccggggccuuuucaaauaccgccaccuuaaggacgacgaagaaacaggcuaucgcaaaauaaucgagcgccugaacucaaagaagggcaagaaucgccuacuagacggggaacgccucgccgaccgcaaaauagccgaacuauuuagcaccaaaacacauaucggc

SEQ ID NO: 15770 - RNA, 1932 nt, Artificial Sequence
  derived and/or modified CDS sequence (opt11) from CCHFV(Ast133)__KX056060.1__Gc
uucagcgacagcauagucaaaggaaugaaaaaccuccucaauuccacuucccucgaaaccucgcucuccaucgaagcccccuggggcgccaucaacguacaauccaccuucaaaccgaccguguccaccgcuaauaucgcccuuucuugguccagcguggaacaccgaggaaacaaaauccugguaacaggacgaagcgaaagcaucaugaaacucgaggaaagaaccggaguuuccugggaccucggagucgaagacgcaagcgaauccaaacuacugaccgucucaaucauggaccuaagccaaauguacucgccuguauucgaguaccucagcggcgaccgccaaguagaagaguggccuaaggccacaugcaccggcgacugcccagaacgcugcgggugcaccucaucaacaugccuacacaaggaguggccccacucccgaaacuggcgcuguaacccaacauggugcuggggcgucgggacaggcuguaccugcugcggagucgacguaaaggaccuauucacagaccacauguucauaaaauggaaagucgaguacauaaaaaccgaagcgaucgucugcgucgaacuaacaagccaagagagacaaugcucacucaucgaagccgggacacgauucaaccuaggcccagucacuauaacccucuccgaaccccgcaacauucaacaaaaacucccucccgaaauaauaacccuccaccccaaaaucgaagaaggcuucuucgacuuaaugcacgugcagaaaguauuaucagccagcaccguaugcaaacuacaguccugcacacacggaauacccggcgaccuccaaaucuaccacauaggcaaccuccucaaaggcgaccgcguaaacggccaucuaauccacaaaaucgaaccccauuucaauaccucauggaugagcugggacggcugcgaucuagacuacuacugcaauaugggcgacuggcccucaugcaccuauaccggcguaacccagcacaaccacgccgcauucgucaaccuccucaacaucgaaacagacuacaccaagaccuuccacuuccacucuaagcggguaacggcacacggcgacacuccccaacuagaccuaaaagcacgccccaccuacggagcaggcgaaaucaccgugcuagucgaagucgcggacauggaacuacacaccaagaaagucgaaaucuccggccuaaaauucgcaucccuuacaugcaccggcugcuacgccugcaguagcggcaucagcuguaaaguccgcauacacgucgacgaaccagacgaacucacgguccacguaaaaucaagcgaccccgacgucgucgccgccucaaccucacuaauggcacgaaaacuagaguucggcaccgacagcacauucaaagccuucagcgccaugccaaaaacuagccucuguuucuacauugucgaacgagaauacugcaaaaguugcagcgaagacgacaccaaaaaguguguugacacaaaacuagaacaaccgcaauccauucugaucgaacacaaaggcacgaucaucggcaagcaaaacgauaccugcacagcuaaggcaucaugcuggcucgaaagcgucaaauccuucuucuacgggcucaaaaacaugcucggcagcguauucggaucauucuucgucggaauccuauuguuccucgcacccuucguacuccuaguccucuucuuuauguucggcuggaagauacucuucugcuucaaaugcugccgccgaacacgaggccucuucaaauaccgccaccuaaaagacgacgaagagaccggauaccgcagaaucauugaacgccuaaacagcaaaaagggcaaaaaccgacuacuggacggagaacgccuagccgaccgaaaaauagccgaacuauucaguuccaaaacacacauaggg

SEQ ID NO: 15771 - RNA, 1932 nt, Artificial Sequence
  derived and/or modified CDS sequence (opt11) from CCHFV(SK/2015/human)__KX458183.1__Gc
uuccucgacagcauagugcgaggaaugaaaaaccuccuuaacagcaccucacuggaaacuucccucuccaucgaagcucccuggggcgccaucaacguccaaucaaccuacaaacccaccgucuccacggccaacaucgcccucuccuggucaagcgucgaacaucgcggaaacaaaauccuaguaucagguagaucagaauccauaaugaaacucgaagaaagaaccggcgucucuugggaccuaggcgucgaagacgccuccgaauccaaacuacucaccgucagcguuauggaccuuucccaaauguacucacccgucuucgaauaccucuccggcgaccgccaagucgaagaauggcccaaagcaaccugcacaggcgacugccccgaaaggugcgggugcacaacuuccacuugccuccauaaagaauggccccacucacguaacuggcgcuguaaccccaccuggugcuggggugugggcacgggauguaccugcuguggacuagacguaaaggaccuuuucaccgacuacauguucgucaaauggaaagucgaauauaucaagaccgaagccaucgucugcgucgagcucaccucccaaggcagacaaugcucccuaaucgaagccggcacccgcuucaaccuggguuccgucaccaucacccuaucagaaccacgaaacauacaacacaaacucccgcccgagauuaucacacuccacccccgaaucgaagaaggcuucuucgaccucaugcacguccaaaaagugcuauccgccucaacaguuugcaaacuccaauccugcacacacgggguacccggcgaccuccaaguauaccacaucggcaaccuccuuaaaggcgacaaaguuaacggccaccuaauccacaaaaucgaaccccacuuuaacacuucguggaugucuugggacggcugugaucuggacuacuacugcaacaugggcgacuggccaucuugcaccuacaccggagucacccaacacaaccacgccagcuucguaaaccuucucaacaucgaaacagauuacaccaaaaacuuccacuuccacagcaaacggguuacagcccacggcgacacuccucaacuggaccucaaagcccgcccaacuuacggagccggcgaaaucaccguacuggucgaagucgcagacauggaacuccacaccaagaaaaucgaaauuucaggccucaaauucgccucgcuaaccuguaccgguugcuacgcauguucaagcggcauuagcugcaaaguacgcauacacgucgacgaaccagacgaacuaaccguccacgucaaauccgacgacccagacguaguagccgccuccuccucacuaauggcacgcaaacucgaguucggcaccgacucuaccuucaaagccuucuccgcuaugcccaaaaccagccucugcuucuacaucguagaacgcgaauacugcaagucaugcagcaaagaagacacccaaaaaugcgucaacaccaagcucgaacaaccccaauccauccuaaucgaacaucgcggcacuauuauuggcaaacaaaacaauaccugcaucgcuaaagccuccugcuggcuagaauccguaaaaucauucuucuacgggcucaaaaacaugcucucaggcaucuucggcaaccuauuccuaggcaucuuccucuuccucgcaccauucauccuccucauccucuucuucauguuuggauggcgcauccucuucugcuucaaaugcugccgccguacacgcggacucuucaaauaccgucaccuaaaagaugacgaagaaaccggcuacagacgaaucaucgaacgccuaaacaacaagaaaggcaaaaacaaacuucucgacggagaacgauuagcagaccgccgcaucgccgaauuauucuccaccaaaacacacaucggc

SEQ ID NO: 15772 - RNA, 1932 nt, Artificial Sequence
  derived and/or modified CDS sequence (opt11) from CCHFV(YL16070)__KY354081.1__Gc
uuccucgacucaaucgcuaaaggaaugaaaagccuacucaacucgaccucccuagaaacaagccuguccaucgaggcacccuggggcgcaaucaacguacagagcacauucaaaccaaccgucuccgccgcuaacauagcacucagcugguccuccgucgaacaucgaggcaacaaaauccucguaucaggacgcuccgaaagcaucaugaaacuagaagaacggaccggcgucagcuggaaccucggagucgaagacgccuccgaaagcaaaacccugaccguaagcgucauggaccucucccaaauguacucccccgucuucgaauaccucagcggagaccgacaaguagaagaauggcccaaagcaaccugcaccggcgauugccccgaacgcugcgguuguaccucaucuaccugccuucacaaagaauggccacacagccgaaacuggcgcugcaacccaacauggugcuggggcguuggcaccggcuguaccugcugcggccucgacgucaaagacuucuucaccgacuacaugcucguaaaauggaaaguagaauacaucaaaacagaagccaucguaugcgucgaacuaaccagccaagaacgacaaugcagccuaaucgaagccggcacccgcuucaaccugggaccaguuacaauuacccucucugaaccccgcaacguacaacaacgccuaccgcccgaaauagugacacuacaccccaaaauagaagaaggauucuucgaccuaaugcauguacaaaagauccucagcgccagcacagucuguaaacuccaaucgugcacccacgggguaccgggcgacuuccaagucuaccacgucggaaaccuccuucgaggcgacaaaguaaauggccacagcauccacaagauagaaccccauuucaacaccagcuggaugagcugggacgggugugacuuagacuacuucugcaauaugggggacuggcccagcuguacauacaccggcguaacacaacacaaccgcgccgccuucauuaacaugcucaacaucgaaaccgacuacacaaaaaccuuccacuuccacucgaaacgcguaacagcacacggagacacaccgcaacucgaccuuaaggcacggcccgccuacggcgccggagaaguuacgguucuaguagaaguagccgaccucgaacugcacacgaagaaauuagagguauccggacucaaaaucgcaagccuaaccugcuccggaugcuacgcaugcaguuccggcauuuccugcaaaguccgcauacaugucaacgaacccgacgaguucacgguacacguacgcagcuccgacccagacguaguagcagcaggaucuucucucauggcacgcaaaauugaguucggcgccgacucgaccuuuaaagccuucucauccaugccaaaagacucccuaugcuucuacaucgucgaaaaggacuacugcucauccugcaccgacgacgacacucaaaaaugcgucaacaccaagcucgaccauccacaauccauacucauagaacacaaaggcaccaucaucggaaaacaaaaugacacaugcuccaccaaaacuuccugcuggcucaaguccuucaaaggcuucuuuuacggacucaaaaacaugcucucaggcaucuucggcaacgucuuccucggaauccuucuauuccucgcacccuucguacuacucaucuucuucuucuucuucggcuggcggcuccucuucugccugaaaugcugcaagaaaacaaaaggccuacucaaauacaaacaccucaaagauaaagaagaagccggauacaagaaaaucaucgaacgccucaacggaaagaaaggcaaaagccaacucuucgacggcgagcgacucgccaaucgcaaaauagccgaacucuuuuccacaaaaauacacaucggc

SEQ ID NO: 15773 - RNA, 1932 nt, Artificial Sequence
  derived and/or modified CDS sequence (opt11) from CCHFV(Oman_812956)__KY362518.1__Gc
uucuucgacagcaucgccaaaggcaugaagaaccugcugaacucaaccucccucgaaacaucccuguccaucgaagcccccuggggcgccauaaacguacaauccaccuucaaacccaccgucagcacagcaaacauagcccuauccugguccuccguagaacaucgagggaacaaaauccucguaagcggucgcuccgaauccaucaugaaacucgaagaaagaaccggcauaucaugggaccuaggcgucgaagacgccagcgaaucaaaacuccuaaccguuuccgucauggaccucucccaaauguacucgcccgucuucgaauaccucucaggggacagacaaguagaagaauggcccaaagcuaccugcaccggcgacugccccgaacgcugcggcugcaccuccagcacaugccuccacaaggaauggccacacagccgaaacuggcgcugcaacccgaccuggugcuggggugugggaaccggcuguaccugcugcggccucgacgucaaggaccucuucacagacuacauguucguaaaauggaaggucgaauacaucaaaaccgaagccaucgucugcguagaacucacuucccaagaaagacagugcucccucaucgaagccggcacccgcuucaaccuaggacccgucacaauaacccuauccgaaccucgcaauauccaacaaaaacucccacccgaaaucguaacccuacacccccgcaucgaggaaggcuucuucgaccucaugcacguccaaaaaguccuuuccgccuccaccguaugcaaacuccaauccugcacccacggcguccccggggaccuccaagucuaccacaucggcaaccuacuuaaaggagacaaggucaacggccaccucauccacaaaguggaaccacacuucaacacaucauggauguccugggacggaugcgaccucgacuacuacugcaacaugggagacuggcccuccugcacauacacaggcgucacccaacacaaccacgccgccuuugucaaccuccuaaacaucgaaacagacuacaccaaaaacuuccacuuccacagcaaacgagucaccgcccacggcgacacaccccaauuagaccugaaagcacgcccuaacuacggagccggagaaaucacgguccuugucgaagucgccgacauggaacuacacacaaagaaaaucgaaauaucaggccucaaauucgccucccuuaccugcaccggcugcuaugcaugcucaagcggaaucuccugcaaaguccgaauccacguugacgaacccgacgaacucaccguccacgucaaaagcgaagauccagacauaguggcagccagcaguucacucauggcccgaaaacucgaauuuggcacggacucaacauucaaagcauucuccgccaugcccaaaacaucgcucugcuucuauaucguagaacgagaguacugcaaauccugcagcaaagaagacacucagaaaugugucaacgcaaagcuagagcggccgcagucaauccuaauagaacacaagggcacaaucaucggcaaacaaaacgacacaugcacugccaaagccuccuguuggcuagagagcguaaaauccuucuucuacggccuuaagaacaugcuaucgggcaucuucggaaacguauucaucggcauauuccuauuccucgccccguuuauccuacucauacucuucuucauguucggauggcgaauccuauuuugcuucaaaugcugccgccguacccgcgggcuuuucaaguaccgccaccuaaaagacgacgaagaaaccggauacagaaaaaucaucgaacgccucaacaacaagaaaggcaaaaacaagcuccuagacggcgaacgccucgccgaccggaaaaucgcagaacuauucagcacaaaaacccacaucggc

SEQ ID NO: 15774 - RNA, 1932 nt, Artificial Sequence
  derived and/or modified CDS sequence (opt11) from CCHFV(UCCR4405)__KY484029.1__Gc
uuccucgacuccacugucaaaggaaugaaaaaccuacuuaacuccacuucccucgaaacaagccuauccaucgaagcccccuggggcgcaaucaacguccaaagcaccuucaaacccacaguauccaccgccaacaucgcccucuccugguccuccgucgaacaccgaggaaacaaaauccugguaaccgggcgaagugaaucaaucaugaaacucgaggaacgaaccggagucaguugggaccucggugucgaagacgccuccgaaagcaagcuacuaaccgucaguaucauggaccucucccagauguacucaccaguauucgaauaccuauccggcgaccgacaagucgaagaguggcccaaagcaaccugcaccggagacugcccagaacgcugcggaugcaccucaagcacaugccuacacaaagaauggccacacagccgcaacuggcgcugcaacccaaccuggugcuggggcgucggcaccggcuguaccugcugcggcgucgacgucaaagaucucuucaccgaccauauguucgucaaauggaaaguagaauacaucaaaaccgaagccauugucugcgucgagcucaccucucaagaacgacagugcagccucauagaagcaggcacccguuucaaccucggacccgucaccaucacacucucagaaccccguaacauacaacaaaaacuaccacccgaaaucaucacccuccaccccaagaucgaagaagguuucuucgaccucaugcacguacagaaagugcucuccgcgagcaccgucugcaaacuccaguccugcacccauggcauacccggcgaccuacaaauauaccacaucggcaaccuccucaaaggggaccgugucaauggccaccucauccacaaaauagaaccccauuucaacaccuccuggaugucuugggacggcugugaccuugauuacuacugcaacaugggcaacuggccaagcugcacuuacaccggagucacccaacacaaccacgccgccuucguuaaccuccucaacaucgaaaccgacuacacuaaaaccuuccacuuccacucaaaacgcguuaccgcucacggcgauaccccacaacucgaucucaaagcccgcccaaccuacggagccggagagaucaccguccuagucgaagucgccgacauggaacuccacaccaagaaggucgagauaucuggccucaaguucgcaucgcuagucugcaccggcuguuacgcaugcucaagcggaauaucaugcaaaguccgcauucacgucgaugaacccgacgaacucaccguccacguaaaauccuccgaucccgacgucguugcagccuccaccucccuaauggcucggaaacuggaguucggcaccgacucuauuuucaaagcauucucagccaugccgaaaaccucgcucugcuucuacauagucgaacgagaauacugcaagaguugcuccgaagacgacacaaagaaaugcgucgacacuaaacuugaacaaccgcaaagcauauuaauagaacacaaaggcaccauaaucggaaaacagaacgacacaugcaccgccaaagccagcugcuggcuagaauccgucaaauccuucuucuacggccugaaaaacaugcuaggcucagucuucggaaacuuuuucgucggaauccuacucuuucucgccccauucguacuucucguccucuucuucauguuuggcuggaaaauccucuuuugcuucaaaugcugcagaagaacccgcggccucuucaaguaccgacacuuaaaagacgacgaagaaacaggcuaccgccgcaucaucgaacgacucaacuccaaaaagggcaaaaaccgccuccucgacggcgaacgacucgcggaccgcaaaauagccgaacuauucuccacaaaaacacacaucggc

SEQ ID NO: 15775 - RNA, 1932 nt, Artificial Sequence
  derived and/or modified CDS sequence (opt11) from CCHFV(UCCR4401)__KY484035.1__Gc
uuccucgacagcaccgccaaaggcaugaaaaaccuucuaaacuccaccagccuagaaacaucgcuuucgaucgaagccccauggggagccaucaacguccagucaaccuacaaacccacuguaucuaccgcaaacaucgcucucucauggucaagcguagaacacagagggaacaaaauccuagucucagggagguccgaaagcaucaugaaacuugaagaacgcacgggcaucucaugggaccuaggcgucgaagacgcgucugaguccaaacuccuaaccguauccgucauggaccucucgcaaauguacucccccguuuucgaauaucuaagcggggaccgccaaguagaggaauggccgaaagcaaccugcacgggcgacugcccggaacgcugcggcugcacaagcuccacgugccuacauaaagaauggccccacagccgcaacuggcgcugcaacccgacguggugcuggggcguuggcacaggcuguaccugcugcggacucgaugucaaagaccuauucaccgacuacauguucgucaaauggaaagucgaauacaucaaaaccgaggcgaucguaugcguagaacucaccucccaagaacgacagugcucgcuuaucgaagccggaacgcgcuucaaccucgguccgguaacaaucacgcuaagcgaaccgcgaaacauccagcaaaagcucccacccgaaaucauaacucuccaccccagaaucgaagagggcuucuucgaccucaugcacgugcaaaaaguacuauccgcaucgacgguaugcaaacuucaauccugcacacacggcgucccaggugaccuccaagucuaucacaucggcaaccuacuuaaaggcgacaaggucaauggccaccuaauccacaaaaucgagccccacuucaacaccagcuggauguccugggacggaugcgaccuagacuacuacugcaacaugggagacuggcccagcugcaccuacaccggcguaacccagcacaaccacgcuagcuucguaaaccuacucaacaucgaaaccgacuauaccaaaaacuuccacuuccauucaaaacgcgucaccgcccacggcgacacgccccaacucgaccuaaaagcccgaccgaccuacggcgcaggcgaaaucacaguccuagucgaaguagccgacauggagcuacacaccaagaaaaucgagaucuccggucucaaauucgcuucacucgccugcaccggcuguuacgccugcuccagcggaauuuccugcaaaguccgcauucacguugacgaaccggacgaauuaaccguccacgucaaaagcgacgacccagacgucguagcggcguccucaucccucauggcccgcaaacucgaguucggaacugacuccaccuucaaagcguucucggccaugccaaaaacuucacucugcuuuuacaucguagaacgagaacacugcaaauccugcuccgaagaagauaccaagaaaugcgucaacaccaaacuagaacaaccccaaucgauacugaucgagcacaagggcaccaucaucggcaagcaaaacagcacaugcaccgccaaagcauccugcuggcuagaaagcguaaagagcuucuucuacggacucaaaaacaugcuauccggcaucuucggcaacgucuucaugggcaucuuccucuuccucgcccccuucauccuccucauccucuucuucauguucggcuggcgcauccucuucugcuucaaaugcugccgacgcacccgcggccucuucaaauaucgacaccuaaaagacgacgaagagaccggcuaccgacgcaucaucgagaaacuaaacaacaagaaagguaaaaacaaacuacucgacggcgaacgccuagcagacagacgcaucgcagaacucuucuccaccaaaacccacauaggc

SEQ ID NO: 15776 - RNA, 1932 nt, Artificial Sequence
  derived and/or modified CDS sequence (opt11) from CCHFV(UCCR4448)__KY484042.1__Gc
uuccuagacagcauagucaagggcaugaaaaaccuccucaacuccacaagccucgaaacaucacucagcaucgaggccccauggggcgccauuaacgugcaauccaccuacaaacccacagucagcaccgccaacaucgcacucucauggucuagcguggaacaccgaggcaacaaaauccucgucuccggacgaagcgagagcaucaugaagcucgaggagaaaaccggcaucucaugggaccucggcguagaagaugcauccgaaagcaagcuacuaaccguuagcguaauggaccuaucccaaauguacucacccguauucgaauaccucagcggagaccgacaagucgaagaauggccaaaagcaaccugcaccggagacugcccagagcgcuguggcugcaccuccagcacgugccuacacaaagaauggccccacagccggaacuggagaugcaacccuaccuggugcuggggcgucggaaccggcuguaccugcugcggacuagacgucaaagaccuauucacggacuacauguucguaaaauggaaaguagaauacauaaaaaccgaagccauagucugcgucgaacucaccucacaagaacgccagugcucccucaucgaagccggcacacgguucaaccucggcccggucacaaucacgcucuccgaaccccgaaacauccagcaaaaacuaccacccgaaaucaucacucuccacccccgaaucgaagaaggguucuucgaccucaugcacguccaaaaaguacucagcgcgagcacagucugcaagcuccaaagcugcacccacggcguacccggagaucuacaagucuaccacaucggcaaccuucuaaagggggacaaaguuaacggacaucucauccacaagaucgaaccccacuuuaacaccuccuggaugaguugggacggcugcgaccucgacuacuacugcaacaugggcgacuggcccucgugcaccuacacaggcgucacccaacacaaucacgccagcuucgucaaccugcuaaauauagaaaccgacuauaccaagaacuuccacuuccauucgaaacgcgucaccgcacacggagacaccccacaacuagaccucaaagcccgcccaaccuacggcgccggcgagaucacaguucuugucgagguggcugacauggaacuccacaccaaaaagaucgaaauauccggccuuaaauucgccucccugaccugcaccggaugcuacgcuugcucaagcggcaucucaugcaaagucagaauccacguggacgaaccagacgaacucacgguacacgucaaaagcgacgaccccgacgucgucgcggccucaucaucacuaauggccagaaaacuugaguucgggacagacucaaccuucaaagccuucucagcaaugcccaagaccucccucugcuucuacaucguagaaagagaacacugcaaaagcugcagcgaagaagacacaaagaagugcguaaacaccaaacucgaacaaccccagucaauacucaucgaacacaaaggaacaaucauaggcaaacaaaacucaacgugcacagccaaggcuagcugcuggcuugagagcguaaaaucauucuucuacggccucaaaaacaugcuaucuggcauauucggaaacgucuucauaggaauauuccuauuccuagcaccauucauacuccuuauccuauucuucauguucggcuggaaaauccucuuuugcuucaaaugcugccgacgaacucgcggccuauucaaauaccgucaccuuaaggacgacgaagagacaggauaccggcgcaucaucgaacgccucaacaacaaaaagggcaagaacaaacuacucgacggagaaauucucgccgacagacguauagccgaacuauucagcacaaaaacacacaucggg

SEQ ID NO: 15777 - RNA, 1932 nt, Artificial Sequence
  derived and/or modified CDS sequence (opt11) from CCHFV(U2-2-002/U-6415)__AY900144.1__Gc
uuccaagacucaaucguaaaaggaaugaaaaaccuacuaaacuccacauccuuagagacuucgcuauccaucgaagccccuuggggcgccaucaacguacaauccaccuacaaacccaccguaagcgccgccaacauagcccucuccugguccuccgucgaacaccgaggaaauaaaauccuagucuccggccgcuccgaaucaauaaugaaacucgaagaaaggaccggcaucuccugggaccucgguguugaggaugcaagcgaaagcaaacuucugacaguaagcgucauggaucuaucacaaauguacucgccagucuucgaauaccucuccggagaccgccaaguagaagaauggccaaaagcaaccugcacaggugacugccccgagcgaugcggcugcaccucaucaaccugccuccacaaagaauggccgcauucccgcaacuggcgcugcaaccccaccuggugcuggggagucggcaccggauguaccugcugcggccuagauguaaaagaccucuucaccgacuacauguuuguaaaguggaaggucgaguacaucaagaccgaagccauugucugcgucgaacucaccucccaagaacgacagugcucccucauagaagccggcacuagauucaaccugggacccguaaccaucacgcucuccgaaccacgcaacauccaacaaaaacuuccgccagaaaucauaacccuccacccacgcaucgaagaaggcuucuucgaccucaugcacgugcaaaaaguacucuccgccagcaccguaugcaaacuccaaucauguacccacggcguuccaggagaccuccagguauaccacaucggcaaccuacucaaaggcgacaaagucaacggccaucucauccacaaaaucgaaccccacuucaacacauccuggauguccugggacggcugcgaccuagacuacuacugcaacaugggcgacuggcccagcuguacauauaccggcgucacccaacacaaccacgcauccuucguaaaccuccuaaacaucgagacagacuacaccaagagcuuccacuuccacuccaaacgaguaaccgcacacggcgacaccccgcaacuugacuuaaaagcccgcccguccuacggcgccggcgagauaaccguccucguagaaguagcagacauggaacuacacaccaagaaaaucgaaaucuccggccucaaauucgcaagucuaaccugcaccggcugcuacgcaugcuccagcggcaucuccugcaaaguucgcauccacguugacgaacccgaugaguucacaguccacgucaaaucggacgaccccgacguagucgcagccuccagcucccuaauggcacgcaaacuagaauuuggcaccgacuccacuuucaaagcauucucggccaugcccaaaacaucacucugcuucuauaucguagaacgagaguacugcaaauccugcuccgaagaagacacccaaaaaugcgucaacaccaaacucgagcaaccccaauccauccugaucgaacacaaaggaacaaucaucggcaaacaaaacaauaccugcaccgccaaggccuccugcuggcuagaauccguaaaauccuucuucuacggccucaaaaacaugcucucuggaaucuuuggaaacgucuucgucggcauauuccuguuccuggccccauucauccuccugauccuguucuucauguucggcuggcgcauacuauucugcuucaaaugcugccgacgaacccguggauuauuccgcuacaaacaccucgaaaacgacgaagaaacaggauaccgacguaucauugaacgacucaacaacaagaaaggcaaaaacaaacuccuagacggcgagcgacuagcagacagacgcaucgccgaacucuucagcacaaaaacccauaucgga

SEQ ID NO: 15778 - RNA, 1932 nt, Artificial Sequence
  derived and/or modified CDS sequence (opt11) from CCHFV(SPU 45/88)__KJ682809.1__Gc
uuccuagacucaauagucaaaggcaagaaaaaccuccucaacuccaccucccucgagaccucacucagcauagaggcuccuuggggcgcuauaaacguacaguccaccuuuaaacccaccgucucggccgcuaacauagcccucucaugguccuccgucgaacaccgcggaaacaaaauccucgucuccggccgcucugaauccauaaugaaacuagaggagcgaaccgggaucuccugggaccucggggucgaggacgcauccgagucaaaacuacucaccgucuccgugauggaccuuucacaaauguacuccccaguauucgaguaccuaucaggagaccgccaaguggaagaguggcccaaagcaaccugcaccggggacugucccgagaggugcggaugcaccucauccacaugccuacacaaagaauggccacauagcaggaacuggcgcuguaacccaaccuggugcuggggcgucggaaccggcugcacaugcugcgggcucgacgugaaagaucuauucacagacuacauguucgucaaauggaaaguagauuacauaaaaaccgaagccauaguaugcguagaacuaacaucccaagaacgccaauguucucuaaucgaagcaggcaccagauucaaccucggccccgucaccauaacccucucggaaccccgcaacauccaacaaaaacucccacccgaaaucguaacccuucacccccgcaucgaagaagguuucuucgaucuaaugcacguccagaacguacucuccgcgucaacggucugcaaacuacaaucgugcacgcacggaguacccggcgaccuacaaaucuaccacauaggcaaccuacucaaaggcgacaaagucaacggccaccucauccacaaaauagaaccucacuuuaauaccuccuggauguccugggacggcugcgaccucgacuacuacugcaacaugggcgacuggcccuccugcucguacacaggcgucacccagcacaaccacgcagccuucgucaacaugcucaacaucgaaaccgacuauaccaaaaacuuucacuuccacucgaaaagagucaccgcucauggcgacacaccacaacucgaccuuaaagcacguccaaccuacggagccggcgagauaacgguacuugucgaagucgccgacauggaacuacacaccaagaaaaucgaaauaucaggucuuaaauucgccucccuaacaugcaccggaugcuacgccuguagcagcggaauaucgugcaaaguccggauccacguagacgagcccgacgagcucacgguccacguaaaauccgaagacccagauaucguagccgccuccagcucccucauggcccgaaaacucgaguucggcacagacuccaccuucaaggcauucucagcuaugcccaaaacaucccucugcuucuacaucgucgaacgggaauacugcaaaagcugcucaaaggaagacacucaaaaaugcgucaacaccaaacucgaacaaccucaaagcauccugaucgagcacaaaggcacaaucaucggaaaacaaaacgacacaugcaccgcuaaagccagcugcuggcuagaaagcgucaaauccuucuucuacggccucaaaaacauguuaagcggcaucuucgguaacguuuucauaggcauccuccucuuccuugccccguucauaaugcuuauccuauucuuuauguucggcuggcgcauacuauuuugcuucaaaugcugccgccgcacacgcggacucuucaaauaccgccaccuaaaagacgacgaagaaaucggguaccgaaagaucaucgagcguuuaaacaacaagaaaggcaaaaacaaacuccuagacggugaacgccuagccgacagaaaaaucgccgaacucuucucaacaaaaacccacauagga

SEQ ID NO: 15779 - RNA, 1932 nt, Artificial Sequence
  derived and/or modified CDS sequence (opt11) from CCHFV(SR3)__AJ538199.1__Gc
uuccucgacucaauaguaaagggcaugaaaaaccuucuaaacucuaccagccuagaaaccucccucuccaucgaagcccccuggggcgccaucaacguccaaucaaccuacaaaccuacggucagcaccgccaacauagcccuauccuggucgucaguggagcaccgaggaaacaaaguacucgucucgggcagauccgaauccaucaugaaacuagaggaacgcacaggaaucuccugggaccuuggugucgaagacgccuccgaaucaaaacuacucaccgucagcgugauggaccuaagccaaauguacuccccagucuuugaauaccucucaggcgaccgucaggucgaggaguggcccaaagccaccuguaccggcgacugcccagaaagaugcgguugcaccucaaguaccugccuacacaaagaauggccccacagccgcaacuggcgcugcaacccgaccuggugcuggggaguaggcacuggaugcacauguugcggccuggacguuaaagaccucuucaccgacuacauguucgucaaauggaaagucgaauacaucaaaaccgaagccaucguaugcgucgaacuaacaucccaagagcgccagugcagccuaaucgaagcaggcacccguuucaaccugggcuccgucaccauaacacuauccgagcccagaaacauccaacaaaaacuacccccagagaucauaacucuacacccaaaaauagaagaaggauucuucgaccucaugcauguacaaaaaguccucagugccagcaccguuugcaaacuccaaagcugcacucacggcguccccggcgaccuccaagucuaccacaucggcaaccuccucaaaggcgaccgagucaauggccaccucauccacaaaaucgaacaacacuucaacacaagcuggaugagcugggacggaugcgacuuagacuacuacugcaacaugggagacuggccauccugcacauacacaggaguaacccaacacaaccacgccagcuucgucaaccuucucaauaucgaaaccgauuauaccaaaaccuuccacuuccacuccaaacgagucaccgcucacggagacaccccgcaacuggaccuaaaagcccgccccaccuacggugccggcgagauaacaguccucguggaggucgccgacauggaauuacacaccaagaaaauagagauauccggccuaaaauucgccggccucacgugcaccggcugcuacgcaugcucauccggcaucagcugcaaaguccgcauccacgucgacgaaccagacgaacucaccguccacgucaaauccgacgaccccgacguagucgcggcauccuccucacuaauggccagaaaacucgaguucggaaccgacuccacuuucaaagcauucucagccaugcccaaaacaucccuaugcuucuauaucguagaacgcgaauacugcaaaucaugcaacaaagaagacacccaaaaaugcgucaauacaaaacucgaacaaccgcaaucgauccugaucgaacacaaaggaaccaucaucggcaaacaaaacaauaccugcaccgcaaaggcaucgugcuggcuagaaagcgucaaaucguucuuuuacggacucaaaaacaugcucggcggaaucuucggcaacguauucaucgguaucuucacauuccucacucccuucauacuacuaauacuauucuucauguucggguggagaauacucuucuguuucaaaugcugccgccgcacccgcggucucuucaaauacagacaccugaaagacgacgaagagacaggcuaccgcaagaucauagaacgucucaacaacaagaaaggcaaaaacagacuacuagacggcgaaagacuggccgaccgaaaaaucgccgaacuauucucaaccaagacccacaucgga

SEQ ID NO: 15780 - RNA, 4656 nt, Artificial Sequence
  derived and/or modified CDS sequence (opt11) from DUGV(ArD44313)__NC_004158.1__GP
augagcaagcgcgugcuaaucaucgccgucgucguguaccucgucuucaccacccagaaccagauuaccggcaaccacacgaccaucaacuccagcucccccucaaccacggaggccuccagcaccccgaccguaucccggacgccccagaccaccaccacuagcacggcgguuuccaccacaaucaccgccacgaccacgcccaccgccagcuggaccacccagagccaauacuucaacaagaccacccagcaccacuggcgcgaggaaacgaugauaucccggaaccccaccguccuugaccgccagucccgggccagcucggugcgcgagcugcucaacaccaaauuccugaugcuacucggguucaucccgaagggcgaggugaaccaucuggagaacgccugcaaucgggaaggcaagaacugcaccgagcugauccucaaggagcgcaucgcgcgguuuuucagcgaaacggagaaggaguccugcuacaauaccuaccuggagaagcaccuccguucagucucccccgaggucucguuaaccccguaccgggugcuuggccugagagaggacauucuccugaaagagauugaccggcgcauaauccgguucgagaccgacucccagcgcguuacgugccuguccgcaagccuccugaagcccgacguguuuauucgggagcagcgcaucgaugccaagccuaguaacggucccaagaucguccccguugacagcguggccugcaugaaccuggaggcgaacguggacguacgguccaacaagcucgugauucagagccugaugacuaccgucaagaucucccuuaagaacugcaaggucgucgugaauagccgccaaugcauucaccaacagaccggauccggcgucauuaaggugccaaaguucgagaaacagcagggcgggacuuggucuuccuacaucgccggcgucuauaccgccacgaucgaccuauuggacgagaacaaccagaacugcaaacucuucaccgaguguaucgugaagggccgggagcuuguaaaggggcagagcgagcuaaaguccuucaauaucgagguccugcucccgcgcgugaugaagaccagacgcaagcugcuggccgugacggacggcagcaccgaaugcaacuccggcacccagcucaucgaggggaaauccaucgagguccauaaacaggacauuggcgggcccgguaagaagcugaccaucuguaacggcacgagcgugcuggacgugccccucgacgaggggcacggcugcuacaccaucaacgucaucaccucaaagcgcgccugccggcccaaaaacuccaagcuacagugcucuauugacaaagagcugaagccuugcgacagcgggaagugucucuccaucagccagaagggcgcuggacacaucaaggugucccgcgggaaaaccauccugaucacugagugcaaggagcauugccagaucccggugccaacuggcaagggugacauuauggucgacugcagcggcgggcggcagcacuaucuggaggugaauauuguggacauccacugccccaacacuaaguuucuuggcggcaucaugcuguacuucugccgcaugagcagccggccgaccgucgcguuacuccugggcauauggaucggcuguggguacauucugacgugcaucuucucauuccuccuguaccaccugauccucuucuuugccaacugcaucaagcagugccgcaagaagggcgagcgguuaggagagaucugcguaaagugugagcagcagacggugaaccugauggaccaggagcugcacgaccucaacuguaacuuuaaccugugucccuacugcugcaaccgcaugagcgacgaagggauguccaggcauguagggaagugcccgaagcgccuggaacggcucaacgagaucgagcuguaccugaccaccagcgaaugccucugccucucgguaugcuaccagcugcucaucucagugggcaucuuccugaaaaggaccaccuggcuggucgugcuccucguguugcucggccuagccaucucgccaguccagggggccccuacagaagugagcaacgugaagcaggacggcgacuacuccaucugcuacuucauauucgggugccugguaaccgcggcucuccugcugaaggugaaacggacgaacuccaacggcauagugguggucguggauuccuucggccgcugccccuacuguaacgaguucacagauagccucuucgaggagguccugcacgacacccugugcucacucugcgugugcccauucugcgaaaaacaggcccuggacuuggugacccuugaggaacacgucaaggagugcuacaagguagccacucggaaggacaucuucaagauccuugggcgcaaguuuaccaaugccuuggugcggcgcgagaagcuguucacgaccgguuugcaacuguucaucaauaagacgaacguugugguguucgcgcucaucaugugcuuccugcugcugcuaaccgggcauaaugccuccgcguucgauagcggcgaccugcccgacgggguuugggaggaguccagccagcucgugaagaguugcacccaguucuguuauaucgaggaagacgugugcuacugcccggccgaggacggcgucggccguaagcuccuguucuucaacgggcuccaaaacucgguaaagcggcucuccgacagccacaagcugcucacauccgugagcaucgacgccccauggggccgcaucaacguagaguccacguggaagcccacccuggcggcuagcaacaucgccauguccuggagcuccaccgacaucaagggggagaaagugauccuguccggccggucuaccagcaucaucaagcucaaggaaaagacaggggugauguggaagcuggucggcucaggccuagccagcgagaagaagaagccauuccgauuccccauuauggacuucgcacagguguacaacagcgucuuucaguacaucacgggggaccggcuacuguccgaguggcccaaagcggucugcaccggcgacugcccccaccgcugcgggugccagaccagcacgugcauggccaaggaaugccauacccaggagugugugaguacccacaugguccugggcaucgggaccggcugcacuugcugcggcauggacguggagaggccguucaacaaguaccucggugugaaguggagcaccgaguaucugcgcaccgagguccugguuugcguggagguaaccgaggaggagcggcacugcgaaaucguggaggccggcacacgcuucaacaucgggcccaucacgaucaccaucuccgacccccagaacaucggcagcaagcuaccggagucacuaaugaccgugcaagagaucgacgacagcaacuucgucgauaucaugcacguggguaacgugaucuccgcugauaacagcugccggcugcaguccugcacccacgguucugcagucaccacccgcuucaccgcccucaccgcccuuaucaaggacgaccacuccuccggucucaaccucgccguacuagacccgaaggugaacuccagcuggcugucgugggaggggugcgacauggacuacuacugcaacgucggcgacuggccgacguguaccuacacugggguggucacacagaagcuacgggaguuucucaagcuggaccagcaccgaaagcgccuccacacuacacugucauucucccugaagaagaaucucagcaagcgcagccacaccuccguccggcuggaaggcaagacugugacgcgcauggaggugaaggucaccgcccugaucgaaguugacggcauggagcuccacagcaaaaccauccggcuguccgggauccgccucaccggucucaagugcagcgggugcuuuuccugcacgagcggcaucuccugcucggugaacgcaaaacugacaucccccgacgaguucacccugcaccucagaucaaccucccccaacgucguuguggcugagacgucgaucaucgcccgcaaggggccguccgccaccaccagccgcuucaagguuuucucaguccgggacaccaagaagauaugcuucgagguggucgagcgcgaguacuguaaggacugcacgcccgacgagcugacuacuuguaccgggguggagcuggagcccaccaaagacauccugcuggagcaucgggggaccaucgugcagcaccagaacgauacuuguaagagcaaaauagacugcugguccaacagcaucagcagcuucgccagcgggaucggcgacuucuucaagcauuauaucgggaguaucgcggucggcgugcuugggacagugcuccccuucgcucugcugauucucuucuucaucuauggugacaagaugcuguggccguuuaaggucuucugcaggccuugccggcgcugcugccgcaagaacgaaggcuacaauaagcuggccgaggaggaagaacugcgcgacaucauccggaaguucagcaaguccggggagcucaucaacaaggacgccaaagacaagcgcacccuggcgcgucuguucaugagcgacaacccuaagcucaaaaaggagaagaagcuguccgagaucgccuaa

SEQ ID NO: 15781 - RNA, 4656 nt, Artificial Sequence
  derived and/or modified CDS sequence (opt11) from DUGV(IbAr1792)__KU925456.1__GP
augagcaagcgggugcuaaucaucgccgucguggugugccucgucuucacgacccagaaccagaucgccggcaaccauaccaccgcgaacuccgggagccccuccaccaaggaggccagcuccaugccgaccgugagcgacacgccucagaccaccaccacguccaccgcggugagcaccaccaucacggccaccaccacccccacggccuccuggaccacccagagccaguacuucaacaagacgacgcagcaccacuggcgggaggagaccauggucucccgcaaccccaccgugcugaaccggcagcgccgggcgagcuccgugaaggagcugcucaacaccaaguuccugaugcugcucggcuucaucccgaagggggaagucaaccaccuggagaacgccugcaaccgcgaggguaagaacugcacggagcugaucuuaaaggagcggaucgcccgcuucuucagcgagaccgagaaggaguccugcuacaacaccuaccuggagaagcaccugugcagcgugucccccgaggugagccucacccccuaccggguccuggggcugcgcgaggacauuuuacugaagaagaucgaccggcgcaucauccgguucgaggccgacucccagcgcgugacgugccugagcgcgagccuccugaagcccgacguguucauccgggagcagcgcaucgacgccaagccgagcaacggccccaagaucguucccguggacagcgugcggugcaucaaccuggaggccaacgucgacgugcgcuccaacaagcucgugauccagagccugaugaccaccgucaagaucucccugaagaacuguaaggugguggucaacagccggcagugcauccaccagcagaccggcuccggggugaucaagguccccaaguucgagaagcagcagggcgggacguggagcuccuacaucgccgggguguacaccgccaccauugaccuccuggacgagaagaaccagaacugcaagcuguucaccgagugcaucgugaaggggcgcgagcucgucaagggccagagcgagcugaaauccuucaacaucgaggugcugcucccgcgggugaugaagacgcgccgcaagcugcuggcggucaccgacggcucuaccgagugcaacuccgggacccagcucaucgaaggcaagagcaucgaggugcacaagcaggacaucgggggccccggcaagaagcugacgaucugcaacgggacguccgugcuggacgucccccucgacgagggccacgguugcuacaccaucaacgugaucaccagcaaacgugccugccgccccaagaacuccaagcugcagugcagcaucgacaaggagcugaagccgugcgacucuggcaaaugucucagcaucagccagaagggggccggccacaucaaggugucccggggcaagaccauccugaucacggagugcaaagagcacugccagauucccguccccacagggaagggcgacaucaugguggacugcagcgggggccgccaacacuaccuggaagugaacaucgucgacauccacugccccaacaccaaguuccucgggggcaucaugcuguacuucugcaggauguccagccgcccgaccguggcccugcuccugggcaucuggaucgggugcgguuacauucugacgugcaucuucuccuuccuccuguaccaccugauccuguucuucgccaacugcaucaagcagugccggaagaagggggagcgccucggcgagaucugcguuaagugugaacagcagaccgucaaccugauggaccaggagcugcacgaccucaacugcaacuucaaccugugccccuacugcugcaaccggaugagcgacgaggggauguccaggcacgugggcaagugccccaagcggcuggagcgccucaacgagaucgagcuguaccugaacuacaagcgggugcccagcugccuccgcugcauguuauccaccagcaucuccgucggcaucuuccugaagagaaccacguggcucguggugcugcugguccuccuggggcuggcgaucagcccggugcagggggcccccgccgagguguccaacgucaagcaggacggggacuacagcaucugcuacuucaucuucggcugccucgugaccgccgcccugcuguuaaaggugaagcgcaccaacuccaacggcaucgucguaguggucgacagcuucgggcggugccccuacugcaacgaguucaccgacucccuguucgaggaggugcugcacgacacgcucugcagccugugcgugugccccuucugcgagaagcaggcgcuugaccucgucacccuggaggagcacgugaaggagugcuacaaggugaccacccgcaaggacaucuucaagauccugggccggaaguucacgaacgcccuuguccgccgugagaagcuguucaccaccggguuacagcuguucaucaacaagaccaacgugguggucuucgcccugaucaugugcuuccugcuccuccucacgggucacaacgccagcgccuucgauagcggggaccucccggacggaaucugggaggagagcucccagcuggucaagagcugcacccaguucugcuacaucgaggaggacgugugcuacugccccgcggagaacggcguggggcggaagcuccucuucuucaacggccuucagaacuccgugaagcgcuuaagcgacucccacaaacuccuaaccagcguguccaucgacgcccccuggggugcgaucaacgucgagagcaccuggaagccgacgcuggccgcguccaacaucgccaugagcugguccagcaccgacaucaagggugagaaggugauccucuccgggcggagcaccuccaucaucaagcugaaggaaaagaccggcgugaugugggagcuggguagcgagcucgccuccgagaagaagaagcugcuggucagcaucauggacuucgcccagguguacaacagcgucuuccaguacauuacuggggaccgccuccuguccgaguggcccaaggccgugugcaccggcgacugcccccaccggugugggugccagaccagcacgugcauggcgaaggaguggccccacacccgcaacuggcggugcaacccaaccuggugcuggggcaucgggaccggcuguacgugcugcggcauggacguggagcgccccuucaacaaguaccuuggggucaagugguccaccgaguaccuccggaccgaggugcuggugugcgucgaggugaccgacgaggagaggcacugcgagaucguggaggccggcaccagauucaacaucgggccaauuaccaucacgaucagcgacccgcagaacaucggcuccaagcugccggagagccucaugaccguccaggaaaucgacgacuccaauuucguggacaucaugcacguggggaacgucauuagcgccgauaacuccugcagacugcagagcugcacccacggcuccgccggcgacuaccaaaucuacagcaccgacucccugaucaaggacgaccacagcuccgggcucaaccuggccgugcuggaccccaaggugaacagcagcuggcucagcugggagggcugcgacauggacuacuacugcaacgucggggacuggcccacgugcaccuacaccgguguggugacccagaacuccgagagcuucagcaaccugauaaacaucgagaaggacuacacgcagcgguuccauuuccacuccaagcgcaucagcgcgaagggccacacccugcagcucgaccugaaggcccggcccaaccaggacgggggcgaggucaccgcccugauagagguggacgggauggagcuccacaguaaaacuauccgccuguccggcauccggcugacggggcucaagugcuccgggugcuucagcugcaccuccggcaucagcugcuccgugaacgccaagcugaccagcccggacgaguucacccugcaccuccgguccacgagcccgaacgucgugguggccgagaccuccauaaucgcgcggaaggggcccagcgccaccaccagcaaguucaaggucuucucggugcgcgacaccaagaagaucugcuucgagguggucgagcgggaguacugcaaagacugcucccccgacgagcugacgaccugcaccggcguggagcuggagccacccaaggacauccuccuggagcaccgcgggaccaucgugcagcaccagaacgacacgugcaagagcaaaaucgacugcugguccaacagcaucagcuccuucgccagcggcaucggggacuucuucaagcacuacaucggcuccaucgccgucggcauucuggggaccgugcuccccuucgcgcugcugauccucuucuucaucuacggcgauaagaugcuguggcccuucaagguguuuugccgcccgugucgccgcugcugccggaagaacgagggguacaacaagcuggccgaggaggaggagcuccgcgacaucauacggaaguucagcaaauccggcgagcugaucaacaaggacgccaaggacaagcgcacccuggcccgccucuucaugagcgacaaccccaagcugaagaaggagaagaaacuuuccgagaucgccuaa

SEQ ID NO: 15782 - RNA, 4884 nt, Artificial Sequence
  derived and/or modified CDS sequence (opt11) from NSDV(Jilin)__NC_034391.1__GP
augguuagcuuggagaagggccucauccuguugcuccugaugcacaucgccaucgccuccaccgggggcucucuugggcuccccggccugaacggggaggaccacaccgacgacccggaggucggcggcgacggccccacggaggaguacaccgaggacgaccccgaauccacuacggugucgauccccacgaccccgccagugcugggccaggggacugaagagguccccgcaacaucgggcgaggccgaggcgggguauagcacgaccgacgugcccgacaccguguccgagaaagucgaggacgagcaggacaccacgccgagcacccagguaacccccgaccagcccgagcaguccacuacgagucugcccgacccguggaccgccaucuccacccgcauaggccgggagcugcugagcguggaguccgacaccaccaagagcucccucgucaccgugggccacccccagcaacccaucuuccuggacgggcagcccguggaggaaguaacccaccccgugaacgaacgcgacgugaccgaggcgcugcggaaguaugacaagaugaagaagcuccugagccagcgcauccuguccaagaugggcauggcgcgggacuucacggacgaggagcucgacgucuggugucacgagcgguucgacaacugcagcuccaacgacaucgagaaucggauacgcgacuucuuccuaauaucagaccagaccgagugcuucgacgaggugcuggugaaacggcucugugaaucuaccaaccccaucgucggugagcccuggcagguugccggcaucaaggaggagaucguacgccgugagaugggccgccgaaucuuccgcuucuuuacccccacgcugaaagugaccugcguguccgggucccugaacccguccgaccaguucgugagauucuacgacccugucaucgagcgcaccagcggccccaccauccagaacuaugacuccaugcacugccucaacaucgagaacgggcuggccaagcccagcaagaugguggucuuaaacgugcucaugacuacaguggagguccgguuggaguccugccgcgccuucaucaacgcucaccagugcaucuacacucagcacgccgacggccaggugauggugccgacauucgucgaccacuccgggacgcgccgcaccauuggggccuacaccaugagcuucaaccucaccgacgagcggaaucgcgccugcaucauacguacgaccugcguggugaaaggcaaggaggucaaaaaggggcagagccaacuccggggauuccccaccuccauucgccuguucaagagcgugaccgggaagaggcggcugauggccgaagagggcgacuggaccgacugcggguccggaacccagcuggacaugaccauggccgugagcguccacaacgacaagaagggcgggcccggcaagaaacugaccaucuguaacgggaccacgguguccgauagcacccugaacgagggccucgggugcuacaccaucaacaaggugaucaccgggaaggcuugcaaggucggcaauuccacgggguccugcgaggugcaaaccgaguugcagaagugcgagaccggaaagugcauccuggugaagcagaaguccaagggcgucgugaaguuaaagcggggaaagaccgugaucaucacggagugccagggcaguugccuguucgccaucccccaggacacuggggacaucacuaucgacugcaguggcgggcgccagcacuaucuggaaaucaacaucgucgacauucacugcccuggcaaggacaaguggaagggguucaugcucuacaucugccggguuuccucacgcccccugaucgcccugaccuucggccucuggcuggccgcggguuaccucauaacaugccucguguccuucaucaucuauaacgccguccugcugcugagcaucgccaucaagaaagugaggcaggggcgcgagaaaaagggcgaccucugcaucaagugcgagcagcacugcaugaaccuguacgaccaggaacugcacgagcucaacugcuccuucaaccugugcccauacugcgccaaccggcugucggacgaggggcucccucgucacgugccccggugccccaaaaaguccgaacgccuggaagagaucgagcuauacauuaacuauacccgcgugcccugcaucuugcgcuggauccugagcacauccguccaggugggcaccgccgugaagcggcucagcugguucuccgugcucgugacgcuguucauucucaccaucagcccgguccaaggguucccccucgagucgccgccaaucggggcggccaccgacagucgcaucauguacggcguuguaggguucauguucgcgcugaucaugaugcugaaccucaaaaagucccacuacggcagcaucuuccacgucaucgacggguucggccgguguaaccugugcgacacccgcaucgauucccugauggaggagacggcgcacgaccucugcuguauguucgacugcugccccuacugccaccgugugagcgagagcaacgguucccacugcuuccacgugcggaucugcgucgcgaaggagaucagcaaaaagaugcugaaggcgggcggccgccuguucaccaacaagcucgugucccgggaggggaccuucgccaaccguauccagcugcuguaccggcgcagcaagguggucuccacccucguggugacgguccugcugcuccuggugcugcucaagcccaccaccgccuucgacagcggcccccugcccgaugggaccugggaggaggaggagaagcuggugcggaacugugggcaggagugcauacucgaccagggagagugccugugcccgggcgagcacagagcaggccggaaacugcuguuccugaacgggcugcaggacgcggcccgccguaugacggagucccaccgccuccugaccagcgucuccaucgacgccccuuggggcgccaucaacauugaguccacauucaagccggugcuugccgcguccaacaucgaccucagcuggaacuccgccgaggagcagggggacaaaaucauccuaagcggccgauccaccgggaucaucaagcuccaggaacgaaccgggcucauguggaagaugagcuccgagaaggccagcgaguccaagaacuuacuggugagcgucauggacuucagccagcucuacaauuccaucuuccaguauaucacgggugaccggagccuguccgaguggcccaaggccgugugcaccggggacugcccggaccgcugcggcugucagaccagcacguguuaccacaaggaguggccucacacgaggaacuggcgcugcaaccccaccuggugcugggggaucggaaccggcugcacgugcugcgggauggacguagaacgguacuucaacaaguacuucggcgucaagugggcccuggaguacguacgcaccgacgucguggugugcgucgaguugaccaacgaggagcggcacugcgaucuggugcaggcggggucucgcuucagcaucggcccgguuuccgucacgcuaagcgacccgcaaaacgugguaaaccgccucuccagcaauauaaugaccauccaggagaucgccgacaacgggauccuggacuugaugcacguauccaaggugauuagcgccgagaacgccugcaagcuccaguccugcacgcacggcagccccggcgaccugcaaaucuuacacaccgacaaccucaucaagggcgauauguccggcgggaucaaccuggcccacuuagacccccagguaaacaccagcuggauguccugggaaggcugcgaccucgacuacuacugcaccgugggcgacuggcccucuugcacguacaccggcguaaacucgauuaacaccgacagcuucaccaaccugauuaacaccgagaccgacuacaccggcaaguuccacuuccacagcaagcguaucuccgcgcgcgacgacacccugcagauggaccucaaggcccggcccaauagcgggggcggugaaaugacggugcugguggaggugaacggucuggagcuccacucgaagcguaucagccugaagggccugcggcucacuaaccugaagugugacgguugcuucgcaugcucccagggccugaccuguacaaucacggccaagcucgagagccccgacgaguucaccauccaccuccgcuccaccagccgggacguggucguggcggagacaucuguaacggcucgcaaggucgagacgggggcacgaagcggcuuccgcgcguucgcagugcgggacgugaagaagcugugccucgaggucguagagaaggauuacugcccuuccugcaccguggaggaccuaaaaauuugcgucgaugugucucuggagccgcccaaggacauccucaucgagcacaaggggaccaucauccagcacuacaacaaguccugcgacgagggguacaacugcugggugggcagcgucuccggauucuuugucggcgugaaggacuucuucgagaagaaccuagggggcguccugaucggucuggugagcacgauucugccccugguccugacgguccuguucuuuaucuacggcaagaagcuguucugccucugucgccuaugccacaagaaguguugccgcggguccgggcgcggccgggauggauauagcagauugucccaggaggaagaaaucaaggagaucaucaagaaguucagccgcaacggcgaacugcucgggaagggcgagaacgacaagcgcaccgucgcgcgcauguucauggacggccagagcaccaagaaggccaucaaggagguggcuuga

SEQ ID NO: 15783 - RNA, 4884 nt, Artificial Sequence
  derived and/or modified CDS sequence (opt11) from NSDV(708)__EU697952.1__GP
auggugucgcuggaaaagggauucuuuuuccuccugcugcugcacauagucaccgccuccaccgggggcccgcccgggcugcccggccccaacgggaaagaccaaacggacggaccagagggagguggggacggacccaccgaggaguacaccgaggaugacuucgagagcacgacguucuccauccccacgaccccgcccgugagcgagcaggaugccaaagagguguccgcgaccagcgaggaggccgaagucgaggacagcacgcugauugugcccaagaccaugagcgagaaggucggggacgagcaguccaccaccagcaauaugcagguuacgaccucacagcccgaacagagcaccaccgggaugccgggccccuggauggcaaguuccauuaagaucggccgcgagcuccuuuccguggagucggacacgaccaagucgagccuggugacggucggguacccgcagcagccgaucuuccucgacggccagcccguggaggaggugacccacccaguguccgagcgggacguggccgaggcccugcgcaaauacgacaaaaugaagaagcuccucagccagaggauccugagcaaaauggggauggcgcgcgacuucacggacgacgaacuagaugccuggugucacgagcgguucgacaacugcuccuccaacgacaucgagaaccgaaucaaagacuucuuccucaucuccgaccagaccgagugcuucgacgagguccuagucaagcggcugugcgaguccaccaauccgaucaucggcgaacccuggcaagucgcgggcauaaaagaggaagucgugcgcagggagauggggcgccggaucuuccgcuucuucacccccacguugaaggugaccugcguauccgggagcuuaaaccccuccgaccaguucguucgguucuauaacccggugaucgaacgcacgagcgggccuaccauccagaacuaugacucuaugcacugccuaaacaucgagaacggccucaucaagcccagcaaggugguaauccugaacguguuaaugacgacagucgaggugcgacucgaguccugccgugccuucgugaacgcgcaucagugcaucuacacgcagcacgccgacgggcagguccgggugcccaccuucguggaccacagcggcaccaagcgcaccaucggugccuacaccauguccuucaaucugaccgacgagcguaauaaagccugcauaauccgcacgacgugcguagugaaggguaaggaagugaagaagggccagagccagcugcgggguuucccgaccucaauccgccucuucaagagcgugacaggcaagcgccgccugauggcagaagagggggacuggacagacugcggcuccgguacgcagcuggacaugaccaccgcggugagcgugcacaacgaucgcaagggcgggcccgggaaaaaguuaaccaucugcaacggcacgaccgucuccgacagcaccuugaacgaggggcugggcugcuacacaaucaauaaggugaugaccggcaaagccugcaagguggggaacagcaccggcuccugugagguccagcccgaauuacagaaaugcgagacgggaaagugcauccuggugaagcagaagaauaagggcguggucaaacugaaaaggggcaaaaccgugauaaucacggagugucaggguagcugccucuucgcuaucccccaagacacuggcgacaucacaaucgacugcucagggggccgccaacauuaccuugaggugaacaucgucgauauccacuguccgggaaaggacaaguggaaaggcuuuaugcuguauaugugccgugugucaagccgaccccucaucgcucugacauucggccuauggcucgccgcgggguaccugaucacgugucugguuucauucaucauauacaacgccguccugcugcucuccaucgccaucaagaaggugagacagggccgcgagcggaagggggaccucuguauuaagugcgaacagcacugcaugaacuuauaugaccaggagcuucaugagcugaauugcucuuucaaccugugccccuacugcgccaaccgccuguccgacgagggccugccucggcacgugccacgcugccccaagaaaacggaacggcucgaggagauugagcuguacauaaacuacacccgcguucccugcauccugcgguggauccucucuacauccguccagguggggacugcugucaagcgccugucgugguucuccguguuagugauccuguuuguccugaccaucagcccgguacagggcuucccccuggagaacacccccaucggcuccaccacggacagcagaaucaucuacggggugguaggcuucaucuucgcucucaucaugaugcugaaccucaaaaagagccacuacgggagcaucuuccacgugaucgacggguuuggucgcugcaaccucugcgacaccaggauagacagccugauggaggagacugcacaugaccugugcugcaucuuugacugcugccccuacugccaccgcgugucggagagcaacggcucccauugcuuccacgugcgcaugugcgucgccaaggagaucagcaaaaagaugcucaaggccgccgggagguuauucacgaacaaacuggugucccgcgaggggauuuucgcgaaccggguccagcuccuuuaccgccggagcaaggugguguccacguucgucgugaccguucugcuucugcuggucuuccugcgcccggccaccgcguucgauagcggcccacugccggacgggacaugggaggaggaggaacgucuggugcgaaacugcggccaggagugcguucuugaccaggacgagugccugugcccgggggagaacagagccggccgcagacugcuguuccugaacggccuacaggacgcgguccguagaaugacggagucccaucgccuccuuaccagcgugucaaucgacgccccguggggcgcuaucaacaucgagucuaccuucaagccggugcuggccgccuccaacaucgaccucucuuggaacuccgcggaggaacaaggagauaagaucauccugagcggucgauccaccggcauaaucaagcugcaggaacgcaccggacucauguggcggaugagcuccgagaaggcgagcgaguccaagaaccugcugguguccgucauggacuuuagccagcucuacaacuccaucuuccaguacaucaccggggaccgcagccuaagcgaguggcccaaggcgguuugcaccggcgauugccccgaccggugcgggugccagaccucgaccugcuaccacaaggaauggccacacacacguaacuggcggugcaaccccaccugguguugggguaucgggaccggcugcacguguugcggcauggacguagagaaguacuucaacaaguauuucggggugaagugggcccuggaguauguccgcaccgacgugguggucugcguggagcucaccaacgaggaacgccacugcgaccugguucaagcaggcagccgguucagcaucgggcccgucucagugacccugucggacccccagaauguggucaaccgccucuccucaaacaucaugaccauccaggagaucgcggacaacggcauucuggaccuaaugcacguguccaaggugaucagcgccgagaacgccugcaagcuccagucguguacgcacgggagcccgggcgaccugcagauacugcacaccgacaaccucaucaagggcgacauguccggaggcaucaaccuagcccaccuggacccucaagucaacaccagcuggauguccugggaggggugcgaccucgacuacuacugcaccgugggcgacuggcccagcugcacguacaccggggugaacagcauuaacaccgauucguuuaccaaccugauuaacacggagaccgacuacaccagcaaguuccacuuccacuccaagcggaucagcgcuagagaugacacccugcaaauggaccucaaggcacggccaaacaccggcggcggggagaugacuguccugguggagguaaacggccuggagcuccacuccaagcgcaucaaucugaagggacugcggcucaccaaucucaaaugcgacgguugcuucgcuugcucacagggccugacauguacggugaucgccaagcucguuuccccggacgaguucaccauccaccuacgcagcaccagccgggacguggugguggccgagaccagcaucacggcgcgcaagguggauaccggagcccggaguagcuuccgcgccuucgccguucgggacgugaagaaacugugccucgagguugucgagaaggacuacuguccauccugcacaguggacgaucugaaaauguguguggacgucagccuggagccgcccaaagacauccucaucgagcacaagggaaccaucauucagcacuacaacaaguccugcgacgaaggguacaacugcugggugggcagcguguccggguucuucguuggcgugaaggacuuuuucgagaagaaucugggaggggugcugauaggccucgucgggacaauccugccccugguucuaaccauccuguucuucaucuacggcaagaagcuguucuaccucugucgccugugccacaagaaaugcugcaaggggagcggccggggccgcgacggguacagccggauuucccgcgaggaggagaucaaggagaucaucaaaaaguucagccggaacggcgaacuguuggggaagggugagaacgacaagcgcacgguggcucgaauguucauggacggucaguccaccaagaaggcgaucaaggaggucgccuag

SEQ ID NO: 15784 - RNA, 4875 nt, Artificial Sequence
  derived and/or modified CDS sequence (opt11) from NSDV(779)__HQ286599.1__GP
auggcccugguggccaaaggacucauccuuaugcugcucuuguacauguucaaggcgagcgaggucaaccuggagcuccccuccuggaacagcaccgaggggaccgaguacgccgacgagcugccgacggagccgcccucggaggaggagcccaagcuagccgcugugagcacagugaccaccccggccccgcccaaggaguccacggaggacaccauagagagccccgacggcggggagaccauggcgcccaccacgcccgcccccgucaccgacuccgccagcaagcucgaggaggagcccgggaccacccagcaggcccaauccacgcagaugcagaacagccaggcgccgaucgggaugcccgaggccugguccaccagccccucccgcgugggccgcaagccccugagcgccuccccggacgugagcgagcccgaccagaacaccgaggcccagacccacccgcccgucuuccuggacggccgccccguggaggaggaggagcacuccguggggacgcgggacgucgccagcgaccuccgcgaguacaaccagaugaagcagcugcugucccagcggauccucgcgaaaaugggcauggccguugacuucaccgacgacgaguuagacaccuggugcuaccgccgguacagcaacugcagcuccaacgacaucgaaagccgcauccgggacuucuuccugaucaccgaccguuccgagugcuucgacgaggugcucgucaagcggcugugcgagacgaccagccccaucaucgaccgcgccuggaagaucgccgggcugaaggaggagguggugcugcgggagaugggccgccggaucuuccgcuucuucacccccgcucugaaggugaccugcauguccgggagccugaaccccuccaaccaguucgugcgguucuacaacccgacgcucgagcgcaccagcggccccaccauccagaacuacgacggcaugcacugccugaacaucgagaacgggcugaucaagccguccaagguggucgugaucaacgugcucaugaccacggucgacauccgguuagagagcugucgcgcguucaucaacgcccagcagugcaccuacacacagcacgccgacggccuggugcgggugcccaccuucgucgggccgcacggggagaagcgcaucaucggcgccuacacgauguccuucaaccucaccgacgagaagaacaaggccugcaccaucaagaccacgugcguggucaaggguaaggaggugaaaaagggccagagccagcugcgcggguuccccaccaccauccggcuguucaaguccgugaccggcaagcgccgguugaugagcaacgaggaggaguggaccgagugcggguccggcacgcagcugaacauggcgaccgccgucagcgugcauaacgacaagcugggcgggcccggcaagaagcucacuaucugcaacgggaccacgguguccgacaucgccuuaaaugagggccuggggugcuacacaaucaacaagaucaucaccggcaaggucugcaagaccggcaacacgaccgggagcugcgaggugcagccggagcuccagaagugcgagaccggcaagugcauccugaucaagcagaagaacaaggggguggucaagcugaagcgcggcaagaccgugaucaucacggagugccagggguccugccucuucgccaucccccaggacaccggcgacaucaccaucgacugcagcggcgggcggcagcacuaccuggagaucaacaucguggacauccacugccccggcaaggacaaguggaagggguucaugcuguacaucugccgcgucagcucccggccccucguggcccugaccuucggcaucuggcugacggcgggcuaccucaucacgugccucgccagcuucauccuguacaaugccauccugcucaucuccaucgcuaucaagaagcugaagcagaagcgcgagaagaagggggaccugugcaucaagugcgagcagcacugcaugaaccucuacgaccaggagcugcacgagcugaacuguagcuuuaaccucugcccguacugcgcaaacaggcuauccgacgacggccugccacgccacgugccccggugccccaagcgcggggagcggcucgaggagaucgagcuguacauuaacuacacccgcgucccgugcuuguuacggugggcccugagcacuuccguccaggugggcaccgucaucaagcgccugagcugguucggggugcuccuaacccuguucuuccucaccaucucccccgugcagggcuucccccuggagaacccgcccaucggcaccgccacggacagcaacaucaucuacgggcuggccggcuucaucuucgcccucguccugaugcugaaccucaagaagacccacuacggguccguguuccacgugaucgauggccuggggcugugcagccucugcgacacccggaucgacucccugauggaggagaccgcgcacgagcugugcugcgccuucgacugcugccccuacugucaccaggucagcgaguccaacggcagccacugcuuccacaugcgcaucugcguguccaaggagaucagcaagaagaugcucaaggccgccggcaagcuguucacgaacaagcuggugagccgggagggguuuuucgccaacaagauacagcuccuguaccagcgcuccaaggucguaagcacccugauccucacggugcugcugcuccugaucauccugaagcccgcagccgccuucgauucaggcccacucccggacgggaccugggaggaggaggagagccugauccgcuccugcgaccaggagugcguccuggagcaggacgagugccucugccccggcgagcaccgggccgggcgccggcugcuguuccucagcggccugcaggacgccgcgcgccggaugacggaaucccaccgcuuguuaaccucuguguccaucgacgcccccuggggcgccaucaauauagagagcaccuucaagccccugcuggccgcguccaacaucgaccucagcuggaacuccgccgaggagcagggugacaagaucgugcugagcgggcgguccaccgggaucaucaagcugcaggagcgcacgggccucauguggaagaugagcuccgagaaggccagcgaguccaagaaccuguuagucagcaucauggacuucucgcagcucuacaacuccaucuuccaguacaucaccggggaccggagccuguccgaguggccgaaggccgucugcaccggcgagugccccgaccgcugcggcugccagaccagcacgugcuaucacaaggaguggccccacaccaggaacuggcgcugcaaccccaccuggugcugggggaucggcaccgggugcacgugcugcggcauggacguggagcgguacuucaacaaguacuucggcgucaagugggcccuggaguacgugcgcaccgacguggucgugugcguggagcucaccaacgaggagcggcacugcgaccugguccaggcggggucccgcuucagcaucggcccgguguccgugacccucagcgacccccagaacgucgugaaccggcucuccagcuccauaaugaccauccaggagaucagcgacaacgggauccuggacgugaugcacgucuccaaggugaucagcgcggagaacgccugcaagcugcaguccugcacgcacggcagccccggggaccuccagaucuuacacaccgacaaccugaucaagggcgagauguccagcggcaucaaccucgcccaccuggacccccaggugaacaccuccuggaugagcugggaggggugcgaccuggacuacuucugcaccgucggcgacuggcccaguugcacguacaccggggugaacuccaucaacaccgacagcuucaccaaucucaucaacacggagaccgacuacaccuccaaguuccacuuccacagcaagcgcaucuccgcccggggagacacccugcagauggaccugaaggcccgcccaaacgucgggggcggcgagaugacggugcucguggaggucaacgggcuggagcugcacagcaagaagaucucccucaagggccugaagcugagcaaccucaagugcuccgggugcuuugccugcagccccggccuguccugcaccgugaucgcccggcuggagagcccugacgaguucaccauccaccuccgcuccaccagccgcgacguggucguggcagagacguccgugaccgcccggaaggcggagaccggggccaagagcuccuuccgggccuucgccgucaaggacgugaaggagaucugccuggagguggucgagaaggaguacugccccagcugcuccaucgaggaccugaagaucugcaucagcgugacccucgagccgcccaaggacauccugaucgagcacaagggcacgaucgugcagcacuacaacaagagcugcgaugaaggcuacaacuguuggaucggguccgucucaggcuucuucgugggggugaaggacuucuucgagaagaacuucggcuccgucaucaucggcaucgugagcaccgugcugccccucauccugaccguccuguucuucguguacgggcggcgccuguucugucucugucggcugugccacaagaaguguugccgcggcuccucccgggggcgcgacggcuacucccggcugagccaagaggaggagaucaaggagaucaucaagaaguucaaccgcaacggggagcuccugggccggggcgagaacgacaagcguaccguggcgcggauguucauggacucccagagcgcccgcaaggccgucaaggagguggccuga

SEQ ID NO: 15785 - RNA, 4302 nt, Artificial Sequence
  derived and/or modified CDS sequence (opt11) from BUNV__NC_001926.1__GP
augcgcauacugauccuccugcuggccgugacccagcucgccgucagcucccccgugaucacccggugcuuccacggagggcagcugaucgcggagcgcaaaucucagacuuccaucagcgaguucugcaucaaggacgacguguccaugcucaaaucagagaucgucuacacuaaaaacgacacaggcauuuucgggcacuccaagguguuccggcacuggaccaucacggacuggaaggccugcaacccgguggucaccgccggcgggagcaucaacgugaucgaaguggacaagaaccuuaacuuggucacccgcaacuacgugugcaccggcgacugcaccaucaccgucgaucggaagaaugcccagauaaucuuccagaccgacaaacugaaccacuucgaggucaccggcacaaccaucuccaccgggugguuuaagagcaaggccagcgugacccucgaccgcacgugcgagcacaucaaggugagcugcggcaagaagacccugcaguuccacgcgugcuucaagcagcacaugucuugcguccgguuccuucaccgcagcauccuccccgggucgauggccaucagcaucugccagaacaucgagcugauaaucaucaccauccuggcguugugcaucuucaucaucaugaucauccugaccaagacguacaucugcuacgugcugauccccguguucaugcccaucgcguucgcuuacggcugggcauacaaccgauccugcaagaagugcacguguugcgggcuugccuaccacccguucaccaacugcggcagcuacugcgucugcggcucaaaguucgagaccagcgaccgcaugcggaugcaccgugagagcgggcugugccagggcuucaagucccugcgcguggcccgccggcucugcaagagcaagggguccagccugaucaucuccauucuccucagcgugcugauccuguccuucgucacacccaucgagggcacccucacgaauuaccccaccgaccagaaguacacgcuggacgagaucgccgacgugcugcaggcgaagacccacgaggacagcaccaaauauuacaucauccucuacaccucccuguucggcgccgggcugacgaucaucuucgccggcguggcccucgggcugacuauuauccuggaaguccucaccaagaucaacgugaucuucugcaacgaaugcaacauguaccacaguaagaaguccaucaaguacgucggcgacuucaccaacaagugcggguucugcacgugcggccugcuggaggaccccgagggcguggugguccacaaggccaagaaguccugcaccuacagcuaccaaaucaauuggguccgcgggauaaugauauucguggcguucuuguucgucauccagaacaccaucaucaugguggccgccgaggaggacugcuggaagaacgaggagcugaaggaggacugcgugggcccgcugaucgcccccaaggacugcaccgacaaggaccacaagaccuaccucagcgaggccagucugcuggcuacggccaagaagaucacccaggucgacgccgagaacguggagauccuagggaagaccauggagagcgccauacgggugaucgagcgccaaaagaccuaccaccgaaugcaccuccuggaggccguauuccugaauaagcacugcgacuacuacaagauguucgagcacaauuccggcuacagccagguuaaguggcgcaugaugaucaagacgcagcacuucgacaucugcgcgcugcaggcgaacuccccauucugcgcgcaguguaucgccgacaacagcugcgcgcagggaagcugggaguucgacacccacaugaacuccaccuacagcuccaagguggacaacuucaagcacgacuucagccuguuccugcggaucuucgaggccgccuuccccggcaccgcuuacguccaccuccugaccaacaucaaggagaagaagcccuaccaggccguguccaugaucgagaaaaucaagaagaaauuccccaacaacaagcugcucaucggcuaccuugacuucgggaaguaccugcucggccugagccacgccaguaccuacgagcugcagcagcgccagcucgacaagcuguaucagcccaccgagcugacccgcagcgggggucagcagacgucacuagccaacucagugguugggcaggccaccaaggagugcaagaaguacaaggacguguccugccugaguccccgguucggcaucccguuggaagaccucaucuccugcugcgaccagcccaacuacaacaucuacaagaagcccaaaaagguguacaaggcccacgacaaggaggagaccugguguaucaacgaccagcacugccuggucgacuucguucccgccgaggcggauaccguggagaaguuaaagccaaugaagugcuggcucgucgaccccggcaagaacgacgacgucuacagcaucgccaucaaaacgugcagaguggucgacaagggggugugcaccgugaacagccagaaauggaacaucaucaagugcgacagcggcccacuguacuacuccgaccacauccccggggaggacacagguaacgacaucggccacuacugcgucagcgccgggugcaagaccgaccgguacccgaucaaucccgacguggugacggacugcgucugggaguucaccagccgcaaaagucaguacaucggcaagaucagcaugcagucccuggaggacuaugagaaggcccucaccgaccggcugacccacacgcuggagacauacagcuucgcgccccucgagaaccugccccacaucaagccgguguacaaguacaucacagcucaggggguggagaacuccgauggcauugagggggccuucaucaccgccagcauccccgccgcgggcggcacguccauuggguacaacguccgcagcaaggauggcuuuccccugcucgaccugaucguauucgugaaguccgccguuaucaagagcaccuacaaccacaucuacgacaccgggccgaccaucuccaucaacacgaaacacgacgagcauugcaccggccagugccccagcaacaucgaacacgaggccaacuggcugaccuucucccaggagcgaaccagucgcugggguugcgaggaguucggcugccucgcugugaacacgggcugcguguucggcucaugccaggacguuauccggccagagaccaagguguaccgcaaggccguggacgaggucgugaucuugaccgugugcaucacuuaccccggccacaccuucugcacggaaaucaacgccauugagccgaagaucaccgaggagaucgagcugcaguucaagaccgucgacaccaagacgcuccccuacaucguggccgugaauaaccacaagcuguacagcgggcagaucaaugaccuaggcaccuucggucagaugugcggcaacguccaaaagaccaacuccagcauccucggcaccgggacgccuaaguucgacuacacgugucacggcgccucccggaaggacaucaucgugcgccggugcuacaacaauaacuucgacagcugcaagcugcugaaggaagagacccagcucaucuucaacgacgaccacgacacaauaaccgucuacaacaccaaccaccugauaggggagcuggccaucaagcucauccugggcgacauccaguacaagcuguucaccgagacccuagacuuacagaucgacgccaagugcgucgggugccccgacugcuucgagagcuacuccugcaacuuccagauagugaguaacaucgacacgaucugcucccuggaaggcccgugcgacaccuuccacaaccgcaucagcaucaaggcgaugcagcaaaauuacgccgucaagcucuccugccagaaggacccccggcccagcggcacuuucaagaucugcaaccgcgaguacaccgugguguuccacaccgucgccaaggacgacaagaucgagaucaaugugggagaccagaccagcuucaucaaggagaaggacgaccggugcaagacauggcugugccgcgugcgggacgagggcauaagcgucaucuucgagccuaucaaggccuucuucggguccuacuucagcaucuucuucuacaucaucguaguggucguggugggcuuccugauuaucuacaucuucaugccgauguucaugaagcucaaggagguccucaaggccaacgagaagcuguaucuccaggagaucaagcagaaguga

SEQ ID NO: 15786 - RNA, 4311 nt, Artificial Sequence; identical to SEQ ID NO: 12500
  derived and/or modified CDS sequence (opt11) from BUNV(SFCrEq231)__KP063893.1__GP

SEQ ID NO: 15787 - RNA, 4302 nt, Artificial Sequence; identical to SEQ ID NO: 12501
  derived and/or modified CDS sequence (opt11) from BUNV(GSA/S4/11232/WT)__KM507339.1__GP

SEQ ID NO: 15788 - RNA, 4302 nt, Artificial Sequence; identical to SEQ ID NO: 12502
  derived and/or modified CDS sequence (opt11) from BUNV(MGD/S1/12060/WT)__KM507340.1__GP

SEQ ID NO: 15789 - RNA, 4308 nt, Artificial Sequence
  derived and/or modified CDS sequence (opt11) from Ab-BUNV(Cu20-XJ)__KJ710423.1__GP
auggccaucagcaucgugcugaugaucauauucucaaccaccagcugucucgcccgcgcggcgcccuccaucagcaagugcuuccaggacggaguucugaucgccgagaagaaguccagcuccgggauuucagaguucugcaucaaggacgacaucuccauccucaagagcgagaucaauuacuccaagaacgacacgggaaucuucaugcacagcaagguguuccggcacuggaccguggccgauuggaagcagugccagccgauacccuccgccgggggcagcaucaauguccucgagguggacaagaaccugaaccugguggcgaagaacuacaugugcacccgccccugcgugaucaccaucgauaaggagaacgcccagcuccuguuccagacggaacagcucaaccaauucgaggucacugggaccaccaucuccacgggcugguucaaaagcaagaccuccgugagccucgacaacacaugcgagcacaucaaggugaccugcggaaagaagucccugcaauuccacgccugcuucaagcagcauaugagcugcgucagauuccugcaccgcagcguccuccccggguacauggccaacuccaucugccagaacaucgagcugaucaucaucaucacccugacccuugcgaucuucaucuucaugugcaucaucaccagaaccuacaucugcuacaucaugcugccgcuguucgcccccaucgccuacaucuacggcuggcucuacaaccgcucgugcaagaagugcaucugcugcgggcuagccuaccaccccuucacgaacugcggcuccuacugcgucugugggucccgauucgagaccuccgacaggaugcggcugcaccgcgagagcggccucugccagggcuucaagucccugcggguggcccguacccugugcaaaagcaagggguccucccuugugauauccgucuuaaccgcgaugcugauccugaguuucgugacgccgcuggaggccaucuccaccaacuacccgaccgaccggaaauacacccugaacgaggugaacgacaucguccucggcaaggggacggagaacgagcugaagaccagcauccuggcccuuguguccauaugcggcaucggcaucauaaucauuuucaucgcccugaccaugcugcucgacaucgugcuggaggccaucgcgaagcgcagcaccaucuucuguacggaaugcaaccugauccacgacaagaaggccaugaaguucgucggggacuucaccaacaagugcggcuucugccccugcggggagcucgaggaccccgagggccuggugauccacaccacccggaaguccugcacauacuacaucaagauccgcaaccugaaacucaucaugcugguguucagcauugccauccugaugcagaacaccgccaugcucguuguggccgaugagaacugcuggaccaacaccgagaucaaggcggacugcguugggccccugaucgggccgacaacgugcaccaacaagggcucaaagaccuacaaggccguggcccaggagcugguaacgagcaacaaaaucacgcagcucgacgccgacaaguacacucuguuaggggacaccaucgagagcgccuuauccgcgaucaccgagcagaagcacuacagcgccauccaccuccuggagacaaucuuccucaugaaacacugcgacuacuacaaggucuacgagcacaacuccggcuacagccagacuaaguggcggcucaucgccaagaccaacuccuucgacaucugcagcauccccucaacccccaauuuuugcaagugccugagcgacuccagcugcuccacgagcacccugaacuuugccaccuccaugaauagcaccuacacguccaaggcggaguacuuuaaucacgacuucacccucuucuugaacaucuucgaagccgccuuccccgguagcgccaccgccuuccuguucaagaagauaaaagagaaggcgccguaccaggccuucgagaugaugggcaagaucgccaacaaguaccccaacaacaagcuccuggugguguugcucaaguauggccaguacauggucggccugucccacgccagcaccuaccagcugaagcaggaguggaucgcaaagagccucucccuggugcgcagcacgaagaccggccugaagauggcgaugaccaacgccgagcccgggccggcgaccaaggaguguuccgaugccaagacgauagcgugccucaccccgaaguuccagguggaggucaacaaucugaugagcugcggcgcaucccccaacuucaagaucuacaugaaguccggggagcuguacaaggcccacgaccggaacagcguguggugccucaacgacaugcauugccugacccccuacacccccgccaacgccgagcuggucgcgacgaugaagaagauggagugcuggcaggacaacccgaagcaacccaccaacgacuacgccacaccccgccggagcugccagaugaaagaccgcggccuaugcaacgucggugccgacaaguggaaggugauaaagugcgacgacgaccuaauguucuacaccgacgcccuggagucccccgacccggccgcggacaucgggcaguacuguuucagcgagaagugccagaucgaacgcuaccccaucaaccccaccucccucaccaacugcgaguggcuguaccgggccgugaagccgcaguacaucaaacgccugagccuccagaccaucgaagaauacaagaaggccaucaccgacaagcugacgcacacgcugcagcucuaucacuucgcgccccuggagaaucugccccacauccggcccaccuacgaguacaucaccgcccaaggcacauacaccgccgacggcaucgagggcgccuccaucauuacgagcaucccggcccucuccgggaccagcgucggcuuuaagaucaacgccaaggacgggaccgcccugcuggacaucgugguguacaucaaguccagcgucgucaaauccguguacaaccacaucuacgacacggggcccaccaucaacaucaacucuaagcacgacgagcucugcaccggucagugccccaagcgaauccccgcggacccgaacuggcugaccuucagccaggagcgcacgucccgcugggggugcgaagaguucggcugccuggccaucaacacagggugcgucuacggcagcugccaggacgugaucagaacagagaccaagguguaccgcaaggccaacgaggagacggucaugcucaccgugugcaucaccuaccccggacacaccuucugcacggacgugaacgcccuggagcccaagaucacggacgagcuggagcuccaguucaagaccauagacaucaagucccugcccaaucuggucgcaauaaccaaccacaagcucuacacggggcaaaucaacgaccugggcaccuucgggcagaugugcggcaacgugcagaagaccaacaccagcauccugggggcgggcacgccgaaauuugacuacacgugcuacuccgccagccggaaggacaucaucauccgccggugcuauaacaacaacuacgacuccugccgccuccugaagcaggagggagaccugcuguucgacgacaaccacgagacccugauuguguacaauaacaagcggcugaacggggagcucaccaugaaguugcugcucggcgacauccaguacaagcuguauaccgagaacauggagcuggagcucgaggccaagugcgucgggugcgugggcugcuucgagagcuaccagugcaaccuacaaaucaccuccagccuggacgggaacugcgccaucuccggccccugcgagaccuuccacgaccgcauccagaucaaaaccacgaagaaagacuaugcgcucaagcuggcgugcaccaaggaccccggcgacaaggccacauuccgggugugcgggaaggacuacgacuucaacuuccacaccgucgugaagaaugacaagaucgaggugaacgucggcgacgagacgagcuacaucaaggaaaaggacgcgcgcugcggcaccuggcugugccguguacgcgacgagggccucuccgugaucuucgagccccugaagaacuucuucgguaacuaccugaauauguuccucuacauuuugggcggcguccuauugcuguucuugucgcucuacauuaucaugccgguaugcgcccggcugcgcgacgagcugaagaaaaacgagaagcuccaccagauggagaugaagaagcgguaa

SEQ ID NO: 15790 - RNA, 4305 nt, Artificial Sequence; identical to SEQ ID NO: 12504
  derived and/or modified CDS sequence (opt11) from ANADV(EIV-13128Kam)__KT313718.1__GP

SEQ ID NO: 15791 - RNA, 4305 nt, Artificial Sequence; identical to SEQ ID NO: 12505
  derived and/or modified CDS sequence (opt11) from ANADV(EIV-13130Kam)__KT313721.1__GP

SEQ ID NO: 15792 - RNA, 4305 nt, Artificial Sequence
  derived and/or modified CDS sequence (opt11) from ANADV(EIV-13395Mg)__KU159765.1__GP
auguuccugauccucguccugcugauccccuucuacaucaccgccaccccugucacgacccgcugcuuccacggcgggcagcucaucgccgaaagcaagucccugaccgcgaucagcgaguucugccugaaggacgacguguccaccgucaagagcgagaucacguaccuaaagaacgacacaggcaucuucgcccacuccaaggugcugcggaacuggaucaucaaggacuggaagaacugcaaccccgugcccacugccgggggcagcaucaacgugaucgaggucaacgccgaccugagucucagcaccaagaccuacgugugcucccgcgacugcaccaucaccguggacaaggaggacgcccagaucaucuuccagaccgacaagcugaaccauuucgaggucucggggacgacccuguccagcggcugguucaagaccaaggcgaguguuacccucgaccggacgugcgagcacaucaaggugaccuguggcaagaagacccugcaguuccacgccugcuucaagcaccacaugagcuguauccgcuucuuccacaacaccauccugcccgggacgauggccgucuccaucugccagaacaucgagcucauaaucaucaccagccugacucugaucaucuucauccucauggugauccugaccaagacguacaucugcuacgugcugaugccgcuguucaugccggucgccuaucuauacggcugggcguacaaccgguccugcaagaagugcagcugcugcgggcucgccuaccacccuuucaccaacugcggcucccacugcgugugcgggcucaaguuugaggccagcgaccgcaugcggauccaccgcgagagcggccugugccagggcuacaagucccugcggguggcccgccuccuaugcaagagcaagggguccagccugaucaucuccauccuccugagcguccugauccucuccuucgugacccccaucgagggcacccugacgaacuacccggagagcaagaaguacucccuggaggaaaucgccgacgugaucgagggcuucauugcggagaaaggcaucaaggaguacaucgugcucuauaccagcaucuucggcgcccugcuccuccugaucgcccugauuaucaccgugucccucaaccggaucaccgaguaccugacgaaccugaacgugaucuacugccacgagugcagcauguaccacuccaagaagaacaucaaguacaucggggacuucaccaauaagugcggcuucugcacgugcggggagcucgaggaccaggagggucugaacaugcacaaggucagcaagaagugcaucuaccgcuaccagcugaccugguccaaggugaucaugaccauccucgugugccugcugaucgcccagaacaccgugcugaucguggcugcgaacgacgacugcugggccaagcagagccucgagaucgagugcgucggaccccugcagcaggucgacgccugcgaggacaaguccagccgguccuacaacggcgaggccaagaagcuggugggcaccagcaaggugaccgagcucgacgccggccaagugaaccugcuggggcagaccaucgagagcgcgaucauagccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaaccgcgacuuugcgggcgagaugaacaccaccuaccacucgaagcgggacuucuucaagcacgacuucaaccuguucugcacccugcucgagaacgccuuccccgggacgaccgagagccuguacuaccaguuacucuccaagcgcaacaccaccggcgccagcaagcugcuggggaagcucaucacgaaguucggcaacaacaaucucuucguggggaucuggaaguucggccaguuccugcucucccugcccuacgugaacaacaccgagcuuagcgcccuccaguccagcaagauccuggaguccccggagcccuuacuacggagcgcguccggccggcaggagagccugagcuccgccacccccggggaggccagcaaggagugccgcaacgccaagaagaucuccugcaucucaccccgguucggcgucccgauggaaaaccugaccgccugcggggagucccccaacuacaagaucuacaagacgcccacccgcaucuacaagagcaacaacaagggcgagaucuggugcgcgggcgacgugcacugcuuccaggaguucacccccgugcuccaggaggucguggacaagcugaagaagaugaccugcuuccugacggagccggaggccgaggaagacgccuucuccaucgccaucgccaugugcaagauccucgacaagggggugugcacuaucaacagcgagcgguggaacaucaucaagugcgacuccggccugauguacuacaccgaccagcgcgacgggcaggacaccggcaaugacuucggggaguacugcaucagccacaacugcaagacggagagguuccccaucaaccccuccaucauaagcgacuguaucugggaguaccacucccgcaaaagccgguacaucuccacccugaaccucgagagccuggaggaguucaagcgcgcgaucuccgagaagcugagccacacccucguugucuaccaauucaagcccacuuccaaccugccgcacaugaagcccguguacaaguauaucacggcccagggcgucgagaauagcgacggcaucgacagcgccuucaucaccgccuccaugcccgcccugagcgggaccuccaucggcuacaacgugaugagcaaggacaacuuuccacucuucgacaucaucaucuucaucaaguccgcggugaucaagaccacguacaaccacaucuacgacaccgggccgaccaucggcaucaaugucaugcacgacgagcauugcaccgggcagugccccaucgagaucccccacaaggagaacuggcugacguucagccaggagcggaccucccgcuggggcugcgaggaguucggcugccuggccaucaacaccgggugcguauucggcagcugccaggacaucauccggccggagaccaaggucuaccgcaaagccaucgaggaguccguccuccugaccgugugcgugacguaccccgggaacaccuucugcaccgagaucaacgccaucgagcccaagaucaccgacgagcuggagcuccaguucaaaacggucgacaccaagacccugcccaaccuccucgcggugcagaaccacaaacuguacagcggucagaucaacgaccugggguccuucgcccaggggugcggaaacauccagaagaccaaccucuccgugaucgggacgggcaccgccaaauucgacuacaucugccacggggccucccggaaggacaucgucgugcgccggugcuacaacaacaacuaugagagcugcaagcugcugaaggaggagccgucccucaucuucagcgacaaccaugagaccaucgaggucgccaacauccgccaccuccugggggagcuccaguucaagcugaugcugggggaccuccgguacaaauccuucgcggagaaccccgagcuggagaucgaggccaagugcgucggcugcccuagcugcuucuccagcuacagcugcaacuuccgcaucuccagcuccaucgacaccgugugcgcaaucgacggccccugcacgaucuuccacaaccgccugaucaucagcuccaccaagcaggacuacgggaucaagaugagcugcaaggagaagccgaaccccguggagaaguucaacaucugcaagcggguguacuccguccucuucaccaccaucgacaagaacgacaagaucgagaucaauacgggcgaccagaccagcuucauccaggagaaggacgaccgcugcaagaccuggcugugccgggugcgcgacgaggggaucuccgugauuuucgagcccaucaaggccuucuucggcagcuacuucuccaucgccuucuacguggugaucggcaucaucgcgcuguucaucaccaucuacaucuuccuccccauggucuucaagcugaaggacauccugaagaagaaugagcuccuguaccugcaggagaugaaguacaaguga

SEQ ID NO: 15793 - RNA, 4305 nt, Artificial Sequence; identical to SEQ ID NO: 12507
  derived and/or modified CDS sequence (opt11) from ANADV(EIV-16002Mg)__KT313724.1__GP

SEQ ID NO: 15794 - RNA, 4305 nt, Artificial Sequence; identical to SEQ ID NO: 12508
  derived and/or modified CDS sequence (opt11) from ANADV(EIV-16199Mg)__KT313730.1__GP

SEQ ID NO: 15795 - RNA, 4305 nt, Artificial Sequence
  derived and/or modified CDS sequence (opt11) from ANADV(EIV-16208Mg)__KT313733.1__GP
auguucuugauccucguucugcugaucccauucuacaucaccgccacccccgucaccacccgcugcuuccacggcgggcagcucaucgccgagagcaaaucccugaccgcuaucagcgaguuuugccugaaagacgacguguccaccguaaagagcgagaucacguauuuaaagaacgacaccggcaucuucgcccacuccaaggugcugcggaacuggaucaucaaggacuggaagaacugcaaccccgugcccacagccgggggcagcaucaacgugaucgaggucaacgccgaccugucccucagcacaaagacguaugugugcucccgcgacugcaccaucaccguggacaaggaggacgcccagauaaucuuccagaccgacaagcugaaccacuucgaggucagcgggacgacccuguccagcggcugguucaagaccaaggccucugugacccucgaccggacgugcgagcacaucaaggugaccugcggcaagaagacccugcaguuccacgccugcuucaagcaccacaugagcugcauccgcuucuuccacaacaccauccuccccgggacgauggccgucuccauaugccagaacaucgagcucaucaucauaaccagccuaacucugaucaucuucauccucauggugauccugaccaagaccuacaucuguuacgugcugaugccgcuguucaugcccgucgccuaccuguacggcugggcguacaacagguccugccgcaagugcagcuguugcggacuggccuaccaccccuucaccaauugcggcucccacugugugugcgggcucaaguucgaggccagcgaccggaugcgcauccaccgggagagcggccugugccagggcuacaagucccugagaguggcccgucuccugugcaagagcaagggcuccagccugaucaucuccauccugcucagcgugcugauccucuccuucgugacccccaucgagggcacccugacaaacuacccggagagcaagaaguacucccuggaggaaaucgccgacgugaucgagggguucaucgcggagaagggcaucaaggaguacaucguccucuacacaagcaucuucggcgcccugcugcuccugaucgcccugaucaucaccgugucacucaaccgcaucaccgaguaccuuacgaacuuaaacgugaucuauugccacgagugcagcauguaccacagcaagaagaacaucaaguacaucggggacuucaccaacaagugcggcuucuguacgugcggggagcucgaggaccaggagggccugaacaugcacaaggucagcaagaagugcaucuaccgcuaccagcugacaugguccaaggugaucaugaccaucuuaaucugccugcugaucgcccagaacgccguccugauaguggcggccaacgacgacugcugggccaagcagagccucgagaucgaguguguggggccccugcagcaggucgacgccugcgaggacaaguccagccgcuccuauaacggcgaagccaagaagcugguggguaccagcaaagugacagagcucgacgcggggcagguuaaccugcugggccagaccaucgaaagcgcgaucauagccauccggaagcagcgcaccuaugccacgaugcacuuccucgaguccguguuccuggggcggcacugcgacuacuacaagguguucgaacacaacagcgguuacucccaggccaaguggcgccugcucgcgaagaccaaccacuucgacaucugcagccggcacuccacccaccacuucugccgcugcaugagugacgggaccaagugugaaaacggcaacugggauuucgccggcgagaugaacacgaccuaccacuccaaacgggacuucuucaagcacgacuucaagcuguucugcacccuauuggaaaacgccuuccccgggacaacggagagccuguacuaccagcugcucucgaaacgcaacaccaccggcgccagcaaacuucuggggaagcucaucaccaaguucggcaacaacaaccuguucgucgggaucuggaaguucggucaauuccugcugucccuccccuaugugaacaacacggagcugagcgcgcuccaguccagcaagauccuggaguccccggaaccccugcuccgcagcgccuccggacggcaggagagccugagcucagccacccccggggaggccagcaaggaaugccgcaacgccaagaagaucuccuguaucagcccccgguucggcgugccgauggagaaccucaccgcgugcggggagucucccaacuacaagaucuacaaaacccccacgcgcauauacaagagcaacaacaagggcgagaucuggugcgcaggcgacguccacugcuuccaggaguucacccccgugcuucaggagguggucgacaagcugaagaagaugacaugcuuccugaccgagcccgaggccgaggaggacgccuucuccaucgccaucgcgaugugcaagauccucgacaagggggugugcacgaucaacagcgaacgguggaauauuaucaagugcgacuccggccugauguacuacaccgaucagcgagacgggcaggacaccggcaacgacuucggggaguacugcaucagccacaacuguaaaaccgagcgguuucccauuaaccccuccaucaucagcgacugcauaugggaguaccacucccgcaagagcaaguacaucucaacgcugaaccucgagagccuggaggaguuuaagcgcgccaucuccgagaagcugagccauacccucguggucuaccaguucaagcccaccuccaaccugccgcacaugaagcccguguacaaguacaucaccgcccagggcguggagaacagcgacggcaucgacagcgccuucaucaccgccagcaugcccgcgcugagcgggaccuccaucggcuacaacgucaugagcaaggacaacuucccccucuucgacaucaucauuuucaucaaguccgccgugaucaagaccaccuacaaccacaucuacgauacggggccgaccaucggcauaaacgugaugcaugacgagcacugcaccgggcaaugccccaucgagaucccccauaaggagaacuggcuaaccuucagucaggagcgcacgucccgguggggcugcgaggaguucggcugccuagccauaaacaccgggugcgucuucggaagcugccaggacaucauccgcccggagaccaagguguaccggaaggccaucgaggaguccgugcuccugacugucugcgugaccuaccccgggaacacguucugcaccgagaucaacgcgaucgaacccaagaucaccgacgagcuggagcuccaguucaaaaccguggacacgaagacccugcccaaccugcuagccguccaaaaccacaagcuguacagcggacagaucaacgaccugggguccuucgcccagggcugcggcaacauccagaagaccaaccugagcgugaucgggaccggcacggcgaaguucgacuacaucugccacggggccucccgcaaggacaucaucgugcggcgcugcuacaacaauaacuacgagagcugcaagcugcugaaggaggagccgucccucaucuucagcgacaaccacgagaccaucgaggucgcgaacauccggcaccuccugggcgagcuccaguucaagcugaugcugggggaccuccgauacaaguccuucgccgagaauccugagcuggagaucgaggcaaagugcgugggcugccccagcugcuucucgagcuauagcugcaacuuccggaucuccagcuccaucgacaccgugugcgccaucgacggccccugcaccaucuuccacaaccgccucaucaucucauccacgaagcaggacuacgggaucaagaugagcugcaaggagaaaccgaacuccgucgagaaguucaacaucugcaagcgcguguacagcguccucuucaccacgaucgauaagaacgacaagaucgagaucaacaccggcgaccagacguccuucauccaggagaaggacgaccggugcaagaccuggcugugccgagugcgggacgaggggaucuccgugauuuucgagcccauuaaggcauucuucggcuccuacuucagcaucgcguucuacguggucaucggcauaaucgcccuguucaucaucaucuacaucuuccucccgaugguguucaagcugaaggacauccugaagaagaaugaacuccuuuaccugcaggagaugaaguacaaguga

SEQ ID NO: 15796 - RNA, 4305 nt, Artificial Sequence; identical to SEQ ID NO: 12510
  derived and/or modified CDS sequence (opt11) from ANADV(EIV-16356Mg)__KT313736.1__GP

SEQ ID NO: 15797 - RNA, 4305 nt, Artificial Sequence; identical to SEQ ID NO: 12511
  derived and/or modified CDS sequence (opt11) from ANADV(EIV-17769Yak)__KT313739.1__GP

SEQ ID NO: 15798 - RNA, 4305 nt, Artificial Sequence; identical to SEQ ID NO: 12512
  derived and/or modified CDS sequence (opt11) from ANADV(EIV-18098Yak)__KT313742.1__GP

SEQ ID NO: 15799 - RNA, 4305 nt, Artificial Sequence; identical to SEQ ID NO: 12513
  derived and/or modified CDS sequence (opt11) from ANADV(EIV-18136Yak)__KT313745.1__GP

SEQ ID NO: 15800 - RNA, 4305 nt, Artificial Sequence; identical to SEQ ID NO: 12514
  derived and/or modified CDS sequence (opt11) from ANADV(EIV-18146Yak)__KT313748.1__GP

SEQ ID NO: 15801 - RNA, 4305 nt, Artificial Sequence
  derived and/or modified CDS sequence (opt11) from ANADV(EIV-18353Yak)__KT313751.1__GP
auguuucugauccucgugcugcugauccccuucuacaucaccgccaccccggucacgacccgcugcuuccacggcggucagcucaucgccgagagcaagucccugaccgcgaucagcgaguucugccugaaggacgacguguccaccgucaagagcgagaucaucuaccucaagaacgacacgggcaucuucgcccacuccaagguucugcggaacuggaucaucaaggacuggaagaacugcaaccccgugcccacagccgggggcagcaucaacgugaucgaggucaacgccgaccugagucucagcaccaagaccuacgugugcucccgcgacugcacgaucaccguggauaaggaggacgcccagaucaucuuccagaccgacaagcugaaccacuucgaggucagcgggaccacgcuguccagcggcugguucaagaccaaggcguccgugacccucgaccggacaugcgagcacaucaaggugacgugcggcaagaagacccugcaguuccacgccugcuucaagcaccacaugagcugcauccgcuucuuccacaacaccauccugcccgggaccauggccguuuccaucugccagaacaucgagcucaucaucaucacgagccugacccugaucaucuucauccucauggugauccugaccaagaccuacaucugcuacgugcugaugccgcuguucaugcccgucgccuaccuguacggcugggcguacaaccgguccugcaagaagugcagcuguugcgggcuggccuaccaccccuucacgaacugcggcucccacugcgugugcgggcucaaguucgaggccagcgaccgcaugcggauccaccgcgagagcggccugugccagggcuacaagucccugcggguggcccgccuccugugcaagagcaagggauccagccugaucaucuccauccucuuaagcguccugauccuuucuuucgugacccccaucgagggcacccugaccaacuacccggagucaaagaaguacuccuuagaagagaucgccgacgugaucgagggguucaucgcggagaagggcaucaaggaguacaucguccucuacacgagcaucuucggcgcccugcugcuccugaucgcccugaucaucaccgugucccucaacagaaucaccgaguaccugaccaaccugaacgugaucuacugccacgagugcagcauguaccacuccaagaagaacaucaaguacaucggggacuucacgaacaagugcggcuucugcacgugcggggagcucgaggaccaggagggccugaacaugcacaagguuagcaagaaaugcaucuaccgcuaccaacugaccugguccaaggugaucaugaccauccucgucugccugcugaucgcccagaacacggugcugaucguggcggcgaacgacgacuguugggccaagcagagccucgagaucgagugcgucggaccccugcagcaggucgacgccugcgaggacaaguccagccgguccuacaacgaggaggccaagaaacuggugggcaccagcaaggugaccgagcucgacgccggccaggugaacuugcuggggcagacaaucgagagcgcgaucaucgccauccgcaagcagcggaccuacgccacgaugcacuuccucgaguccguguuccugggccgccacugcgacuacuacaaggucuucgagcacaacucaggguacucccaggccaaguggcggcugcucgccaagacuaaccacuucgacaucugcagccgccacuccacccaccauuucuguaggugcaugagcgauggcacgaagugcgagaacgggaacugggacuucgcgggcgagaugaacacgaccuaccacuccaagcgcgacuucuucaagcacgacuucaaccuguucugcacccuccucgagaacgccuuccccggcacgacggagagccuguacuaccagcugcucuccaagcggaacaccaccggggccagcaagcugcugggcaagcucauaaccaaguucgggaacaacaaccuguucgugggcaucuggaaguucgggcaguuccugcucucccugcccuacgugaacaacacggagcugagcgcccuccaguccucaaagauccuggagucgccggagccccugcuccgcagcgcauccggccgccaggagagccugagcuccgccacccccggcgaggccagcaaggagugccggaaugccaagaagaucuccugcaucagcccccgcuucggggucccgauggagaaccugaccgccugcggcgagucccccaacuacaagaucuacaagacccccacucggaucuacaaaagcaauaacaagggggagaucuggugcgcgggcgacgugcacugcuuccaagaguucacucccgugcuccaggaggucguggacaagcugaagaagaugaccugcuuccugaccgagccggaggccgaggaggacgccuuuuccauagccaucgccaugugcaagauccucgacaagggcgugugcacgaucaacagcgagcgcuggaacaucauuaagugcgacuccgggcugauguacuacacagaccagcgggacggccaggacaccgggaacgauuucggcgaauacugcaucagccacaauugcaagaccgagcgcuuccccaucaaccccuccaucaucucggacugcaucugggaguaccacucccgcaagagccgguacaucuccacgcugaaccucgagagccuggaggaguucaagcgggcgaucuccgagaagcugagccacacccucaucgucuaccaauucaagcccaccuccaaccugccgcacaugaagcccguguacaaguacaucacggcccaggggguggagaacagcgacggcaucgacagcgcauucaucacggccuccaugcccgcccugagcggcaccuccaucggguacaacguuaugagcaaggacaacuucccccucuucgacaucaucaucuucaucaaguccgcggugaucaagaccaccuacaaccacauauacgacacgggcccgaccaucgggaucaacgugaugcacgacgagcacugcaccggccagugccccaucgagaucccccacaaggagaacuggcugaccuucagccaggagcgcacgucccggugggguugcgaggaguucggcugccuggccaucaacaccggcugcguauucgggagcugccaggacaucauccgcccggagacaaaggucuaccggaaggccaucgaggaguccgugcuccugaccgucugcgugaccuaccccggcaacacguucugcaccgagauaaacgccaucgagcccaagaucaccgacgagcuggagcuccaguucaagaccguggacacgaagacacugcccaaccugcucgcgguccaaaaccacaagcuguacuccgggcagaucaacgaccuuggcuccuucgcccaggggugcggcaacauccagaagaccaaccucagcgugaucggcaccgggacggccaaguucgacuacaucugccacggcgccucccgcaaggacaucguggucagacgcugcuacaacaacaacuacgagagcugcaagcugcugaaggaggagccgucccucaucuucagcgacaaccacgagaccaucgagguggccaacauccggcaccuccugggggagcuccaguucaagcucaugcugggagaccuccgcuacaaguccuucgcggagaaccccgagcuggagaucgaggcccggugcguugggugccccagcugcuucuccagcuacagcugcaacuuccgcaucuccagcuccaucgacaccgucugcgccaucgacggccccugcaccaucuuccacaaccgccugaucaucagcccgacgaagcaggacuacggcaucaagauguccugcaaggagaagcccaaccccguggagaaguucaacaucugcaagcggguguacagcguccucuucaccaccaucgacaagaacgacaagaucgagaucaacaccggggaccagacguccuucauccaagagaaggacgacaggugcaagaccuggcugugccgggugcgcgacgaggggaucagcguuaucuucgagcccaucaaggccuucuucggguccuacuucagcaucgccuucuaugucgugaucggcauaauugcguuauucaucaucaucuacaucuuccucccuaugguguucaagcugaaggacauccugaagaagaacgagcuccuguaccugcaggagaugaaguacaaguga

SEQ ID NO: 15802 - RNA, 4305 nt, Artificial Sequence
  derived and/or modified CDS sequence (opt11) from ANADV(EIV-18560Yak)__KT313754.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucaucuaccucaagaacgauacgggcaucuucgcccacucuaaggugcugcggaacuggaucaucaaggacuggaagaacugcaaccccguacccaccgccgggggcagcaucaacgugaucgaggucaacgccgaccugucccucaguaccaagaccuacgugugcucccgcgacugcacgaucaccguggacaaggaggaugcccaaaucaucuuccaaaccgacaagcugaaccacuucgaggucagcgggaccacgcuguccucaggcugguucaaaaccaaggcguccgugacccucgaccggaccugcgaacacaucaaggugacgugcggcaagaaaacccugcaauuccacgccugcuucaaacaccacaugagcugcauccgcuucuuccacaauacaauccugcccgggaccauggccgucuccaucugccagaacaucgagcucaucaucaucacgagccugacccugaucaucuucauccucauggugauccugaccaagaccuacaucugcuacgugcugaugccgcuguucaugcccgucgccuaccuguacggcugggcguacaaccgguccugcaagaagugcaguugcugcgggcuggccuaucaccccuucacgaacugcggcucccacugcgugugcgggcucaaguucgaggccagcgaccgcaugcggauccaccgcgagagcggccugugccaaggcuacaagucccugcggguggcccgccuccugugcaagagcaagggguccagccugaucaucuccauccuccugagcguccugauccucuccuucgugacccccaucgagggcacccugaccaacuacccggagagcaagaaguacucccuggaggagaucgccgacgugaucgagggguucaucgcagagaagggcaucaaggaguacaucguccucuacaccagcaucuucggggcccugcugcuccugaucgcccugaucaucaccgugucccucaaucggaucacggaguaccugaccaaccugaacgugaucuacugccacgagugcagcauguaccacuccaagaagaacaucaaguacaucggggacuucacgaacaagugcggcuuuugcacgugcggggaacucgaagaccaggagggccugaacaugcacaaagucucgaagaagugcaucuaccgcuaccagcugaccugguccaaggugaucaugaccauccucgucugccugcugaucgcucagaacaccgugcugaucguagccgcgaacgacgacugcugggccaagcagagccucgagaucgagugcgucgggccccugcagcaggucgacgccugcgaggacaaguccagccgguccuacaacgaggaggccaagaagcuggucggcaccagcaaggugaccgagcucgacgccggccaggugaaccugcuggggcagaccaucgagagcgcgauuaucgccauccgcaagcagcggaccuacgccacgaugcauuuccucgaguccguguuccugggacgccacugcgacuacuacaaggucuucgagcauaacagcggguacucccaggccaaguggcggcuguuggccaagaccaaccauuucgacaucugcagccgccacuccacccaccacuucugccggugcaugagcgacggcaccaagugcgagaacgggaaccgcgauuucgcgggcgagaugaacacgaccuaucacuccaagcgggacuucuucaagcacgacuucaaccuguucugcacccugcuggagaacgccuuccccggcaccacggagagccuguacuaccagcugcucuccaagcgcaacaccaccggggccagcaagcugcugggcaagcucaucacaaaauucgggaacaacaacuuauucgugggcaucuggaaguucgggcaguucuuacucucccugcccuaugugaacaacacggagcugagcgcccuccaguccuccaagauccuggaguccccggagccccugcuccgcagcgcguccggccggcaagagagccugagcuccgccacgcccggcgaggccagcaaggagugcagaaacgccaagaagaucuccugcaucagcccccgguucggggucccgauggagaaccugaccgccugcggagagucccccaacuacaagauuuacaagacgcccacgcgcaucuacaagagcaacaacaagggggagaucuggugcgcgggcgacgugcacugcuuccaggaguuuacccccgugcuccaggaggucguggacaagcugaagaagaugaccugcuuccugaccgagccagaggccgaggaggacgccuucucgaucgccaucgccaugugcaagauccucgacaagggcgugugcacgaucaacagcgagcgguggaacaucaucaagugcgacuccgggcugauguacuacaccgaccagcgcgacggccaggacaccgggaacgacuucggcgaguacugcaucagccacaacugcaagaccgagcgguuccccaucaaccccuccaucaucagcgacugcaucugggaguaccauucccgcaagagccgguacaucuccacgcugaaccucgaaagccuggaggaguucaagcgcgccaucuccgagaagcugagccacacccucaucgucuaccaguucaagcccaccuccaaccugccgcacaugaagcccguguacaaguacaucaccgcccaggggguugagaacagcgacggaaucgacagcgccuucaucacugccuccaugcccgcccugucgggcaccuccaucggguacaacgucaugagcaaggacaacuucccccucuucgacaucaucaucuucaucaaguccgcagugaucaagaccaccuacaaccauaucuacgacacggguccgaccauugggaucaacgugaugcacgacgagcacugcacgggccagugccccaucgagaucccucacaaggagaacuggcugaccuucucucaggagcggacgucccgcuggggaugcgaagaguucggcugucuggccaucaacaccggcugcgucuuugggagcugccaggacaucauccggccggagaccaagguauaccgcaaggcgaucgaggaguccgugcuccugaccguaugcgugaccuaccccggcaacacguucugcaccgagaucaacgccaucgagcccaagaucaccgacgagcuggagcuccaguucaagaccguggacacgaaaacccugcccaaccugcucgcgguucagaaccacaagcuguacucggggcagaucaacgaucugggcuccuucgcccaggggugcggcaacauccagaagaccaaccucagcgugaucggcaccgggacggccaaauucgacuacaucugccacggcgcgagucgaaaggacaucgugguccgccggugcuacaauaacaacuacgagagcugcaagcugcugaaggaggaaccgucccucaucuucagcgacaaccacgagaccaucgagguggccaacauccgccaccuccugggggagcuccaguucaagcugaugcugggcgaccuccgguacaaguccuucgcggagaaccccgagcuggagaucgaggcccgcugcguggggugccccagcugcuuuuccagcuacagcugcaacuuccgcaucuccagcuccaucgacacaguuugcgcgaucgacggccccugcaccaucuuccacaaccggcugauaaucucuccgacgaagcaggacuacggcaucaagauguccugcaaggagaaacccaaccccguggagaaguucaacaucugcaagcgcguguacagcguccucuucaccaccaucgacaagaacgacaagaucgagaucaacaccggggaccagacguccuucauacaggagaaggacgaccggugcaagaccuggcugugccgcgugcgggacgagggcaucagcgugaucuucgaacccaucaaggccuucuucggguccuacuucagcaucgccuucuacgucgugaucggcaucaucgcgcuguucaucaucaucuacaucuuccucccgaugguguucaaacuuaaggacauccugaagaagaacgagcuccuguaccugcaggagaugaaguacaaguga

SEQ ID NO: 15803 - RNA, 4305 nt, Artificial Sequence
  derived and/or modified CDS sequence (opt11) from ANADV(EIV-18715Yak)__KT313757.1__GP
auguuccugauccucgugcugcugauccccuucuacauuaccgccaccccggucacgacccgcugcuuccacggcgggcagcucauugccgagagcaagucccugaccgcgaucagcgaguucugccugaaggacgacguguccaccgucaagagcgagaucacguaccucaagaacgacaccggcaucuuugcccacuccaaggugcugcggaacuggaucaucaaggacuggaagaacugcaaucccgugcccaccgccgggggcagcaucaacgugaucgaggucaacgccgaccugucccucagcaccaagacguacgugugcucgcgcgacugcaccaucacgguggacaaggaggacgcccagaucaucuuccagaccgauaagcucaaccacuuugaggucagcgggacgacccuguccagcggcugguucaagaccaaggcguccgugacccucgaccggacgugcgagcauaucaaggugaccugcggcaagaagacccugcaguuccacgccugcuucaagcaccacaugagcugcauccgcuucuuccacaacacgauccugcccgggacgauggccgucuccaucugccagaacauagagcucaucaucauuaccagccugacccugaucaucuucauccucauggugauccugaccaagacguacaucugcuacgugcugaugccguuauucaugcccguugccuaccuguacggcugggcguacaaccgguccugcaagaagugccccugcugcgggcuggccuaccaccccuucacuaacugcggcagccacugcgugugcgggcucaaguucgaggccuccgaccgcaugcggauccaccgcgagagcggccugugccagggcuacaagagccugcggguagcccgccuccugugcaaguccaaggggagcucccugaucaucagcauccuccuguccguccugauccucagcuucgugaccccgaucgagggcacccugacgaacuaccccgaauccaagaaguacucacuggaggagaucgccgacgugaucgagggguucaucgcggagaagggcaucaaggaguauaucguccucuacaccuccaucuucggcgcccugcugcuccugaucgcccugaucaucaccguuagccucaaccggaucaccgaguaccugacgaaccugaacgugaucuacugccacgagugcuccauguaccacagcaagaagaacaucaaguacaucggggacuucaccaacaaaugcggcuucugcacguguggggaacuugaggaccaggagggccugaacaugcacaaggucuccaagaagugcaucuaccgcuaccagcugaccuggagcaaggugaucaugaccauccucaucugccugcucaucgcccagaacaccguccugaucguggccgcgaacgacgacugcugggccaagcagucccuugagauagagugcguggggccccugcagcaggucgacgccugcgaggacaagagcucccggagcuacaacggcgaggccaagaagcuggugggcaccucccgcgugaccgagcucgacgccgggcaggucaaccuacugggccagaccaucgagagcgcgaucaucgccauccggaagcagcgcacguacgccaccaugcacuuccucgaaagcguguucuuagggcggcacugcgacuacuacaagguguucgagcacaacuccggcuacagccaggccaaguggcgccugcucgccaagaccaaccacuucgacaucugcucccggcacagcacacaccacuucugccgcugcauguccgacgggacgaagugcgagaacggcaacugggacuuugcgggcgagaugaacaccaccuaccacaguaagcgggacuucuucaagcacgacuucucccuguucugcacccugcucgaaaacgccuuucccgggacgaccgaaagccuguacuaccagcugcucuccaagcgcaacacgaccggcgccagcaagcugcuggggaagcucaucacgaaguucggcaacaacaacuuguucgucgggaucuggaaauucggccaguuccugcucucccugccguacgugaacaacaccgagcugagcgcccuccaguccagcaagauccuggagucccccgagccccugcuccgcagcgcguccggccgacaggagagccugagcuccgccacccccggggaggccagcaaggagugccgcaacgccaagaagaucuccugcaucagcccgcgguucggcgugcccauggagaaccugaccgccugcggggagucccccaacuacaagaucuauaagacgcccacccgcaucuacaagagcaacaacaagggcgagaucuggugcgcgggcgacguccacugcuuccaggaguucaccccagugcuccaggaaguggucgacaagcugaagaagaugaccugcuuccugacggagcccgaggccgaggaggacgccuucuccaucgccaucgccaugugcaagauccucgacaagggagugugcacuaucaacagcgaaagguggaacauaaucaagugugacuccggccugauguacuacaccgaccagcgcgacggucaggacaccggcaacgacuucggggaguacugcaucagccacaacugcaagacggagcgguuccccaucaaccccuccaucaucagcgauugcgugugggaguaccauucccgcaagagccgguacaucuccacccugaaccucgagagcuuagaggaguucaagcgcgcgaucuccgagaagcugagccacacccucgucguguaccaauucaagccgaccuccaaccugccccacaugaagcccguguacaaguacauaacggcccaaggcguugagaacagcgacggcaucgauagcgccuucaucaccgccuccaugccugcccugagcgggaccuccaucggcuacaacgugaugagcaaggacaacuucccccucuucgacaucaucaucuucauuaaguccgcggugaucaagaccacguacaaccauaucuacgacaccgggccgaccaucggcaucaacgucaugcacgacgagcacugcaccgggcagugccccaucgagauaccgcacaaggagaacuggcugacguucagccaggagcggaccucccgcuggggcugcgaagaguucggcugccuggccaucaauaccggcugcguguucggcagcugccaggacaucauccggcccgagaccaagguguaccgcaaggccaucgaggaguccguccuccugaccgugugcgugacguaccccgggaacaccuucugcaccgagaucaacgccaucgagccuaagaucaccgacgagcuggagcuccaguucaagacggucgacaccaaaacccugccgaaccugcucgcggugcagaaccacaagcuguacagcggccagaucaacgaccugggguccuucgcccagggcugcggcaacauccagaaaaccaaccucagcgugaucgggacgggcacagccaaguucgacuacaucugccacggggccucccggaaggacauugucgugcgccggugcuacaacaacaacuacgagucgugcaagcugcugaaggaagaacccucccucaucuucagcgacaaccacgagaccaucgagguggccaacauccgccaccuccugggugagcuccaguucaaacuuaugcugggggaccuccgguacaaguccuucgcggagaaccccgagcuggagaucgaggcccgcugcgucggcugccccagcugcuucuccucauacagcugcaacuuccgcaucuccagcuccaucgacaccgugugcgccaucgacggcccgugcacgaucuuccacagccggcugaucaucuccagcaccaagcaggacuacgggaucaagauguccugcaaggagaagcccaaccccguugagaaguucaacaucugcaagcgcgucuacagcguccuauucaccaccaucgacaagaacgacaagaucgagaucaacacgggcgaccagaccuccuucauccaggagaaggacgaccggugcaaaaccuggcugugccgcgugcgggacgaggggaucagcgugaucuucgagcccaucaaggccuucuucggcuccuacuucagcaucgccuucuacguggugaucggcaucaucgcgcuguucaucaucaucuacaucuuucuuccgauggucuucaagcugaaagacauccugaagaaaaacgagcuccuguaccugcaggagaugaaguacaaguga

SEQ ID NO: 15804 - RNA, 4305 nt, Artificial Sequence
  derived and/or modified CDS sequence (opt11) from ANADV(EIV-23263Tyum)__KT313760.1__GP
auguuccugauccucgugcugcugauccccuucuacaucaccgccaccccggucacgacccgcugcuuccacggcgggcaacucaucgccgagagcaagucccugaccgcgaucagcgaguucugccugaaggacgauguguccaccgucaagagcgagaucacuuaccucaagaacgacaccggcaucuucgcccacuccaaggugcugcggaacuggaucaucaaggacuggaaaaacugcaaucccgugcccaccgccgggggcagcaucaacgugaucgaggucaacgccgaccugucccucagcaccaagacguacgugugcuccagagacugcaccaucaccguggacaaggaggacgcccagaucaucuuccagaccgacaagcugaaccacuucgaggucagcgggacgacccugagcagcggcugguucaagaccaaggcguccgugacccucgaccggacgugcgagcacaucaaagugaccugcggcaagaaaacccugcaguuccacgccuguuucaagcaccacaugagcuguaucagguucuuccacaacaccauccugcccgggacgauggccgucuccaucugccagaacaucgagcucaucaucaucaccagccugacccugaucaucuucauccucauggugauccugaccaagaccuacaucugcuacgugcuuaugccgcuguucaugcccgucgccuaccuguacggcugggcguacaaccgguccuguaagaagugcagcugcugcgggcuggccuaccaccccuucaccaacugcggcucccacugcgugugcggguugaaguucgaggccagcgaccgcaugcggauccaccgcgaaagcggccugugccagggcuacaagucccugcggguggcccgccuccugugcaagagcaagggguccagccugaucaucuccauccuccugagcguccugauccucuccuucguaacccccaucgagggcacccugacgaacuacccggagagcaagaaguacucccuggaggagaucgccgacgugaucgagggguucaucgcggagcggggcaucaaggaguacaucguacucuacaccagcaucuucggcgcccugcugcuccugaucgcccugaucaucaccgugaguuuaaacagaaucaccgaguaccugacgaaccugaacguuaucuacugucacgagugcuccauguaccacuccaagaagaacaucaaguacauuggggacuucaccaacaagugcggcuucugcacguguggggagcucgaggaccaggagggccugaacaugcacaaggucagcaagaagugcaucuaccgguaccagcugaccugguccaaggugaucaugacaauccucgucugccugcugaucgcccagaacaccgugcugaucguggccgcgaacgacgacugcugggccaagcagagccucgagaucgagugcgucgggccccugcagcaggucgacgccugcgaggacaaguccagccgcuccuacaacggcgaggcccggaagcuggugggcaccagcaaggugaccgagcucgacgccggccaagugaaccugcuggggcagaccaucgagagcgcgaucaucgccauccgcaagcagcggacguacgccaccaugcacuuccucgaauccguguuccuggggcgccacugcgacuacuacaaggucuucgagcacaacagcggcuacucccaggccaaguggcggcugcucgccaagaccaaccacuucgacaucugcagccgccacuccacccaccacuucugucggugcaugagcgacgggacgaagugcgagaacggcaacugggacuucgccggcgagaugaauaccaccuaccacuccaagcgagacuucuucaagcacgacuuuaagcuguucugcacccugcucgagaacgccuuccccgggacgaccgagagccuguacuaccaguugcucuccaagaggaacaccaccggcgccagcaaacugcuggggaagcucaucacgaaguucggcaacaacaaccuguucguggggaucuggaaguucggacaguuccugcucucccugcccuacgugaacaacaccgagcugagcgcccuccaguccagcaagauccuggaguccccggagccccugcuccggucggcguccggccgccaggagagccugagcuccgccacccccggggaggccagcaaggagugccggaacgcgaaaaagaucuccugcauaagcccccgcuucggcgucccgauggagaaucugaccgccugcggggagucacccaacuacaagaucuucaagacgcccacccggaucuacaagagcaacaacaagggcgagaucuggugcgcgggcgacgugcacugcuuccaggaguucacccccauccuccaggagguggucgacaagcugaagaagaugaccugcuuccucacggagccggaagccgaggaggacgccuucuccaucgccaucgccaugugcaagauucucgacaagggggugugcaccaucaauagcgagagguggaacaucaucaagugcgacuccggccuaauguacuacacggaccagcgggacggacaggacaccggcaacgacuucggggaguauugcaucagccacaacugcaagacggagcgcuuccccaucaaccccuccaucaucagcgacugcaucugggaguaccacagucgcaagagccgguacaucuccacccugaaccucgagagccuggaggaguucaagcgcgcgaucuccgagaagcugucacacacccucguggucuaccaguucaagcccaccuccaaccugccgcacaugaagcccguguacaaguacaucacggcccaggggguggagaacagcgacgguaucgacagcgccuucaucaccgcuuccaugcccgcccugagcgggaccuccaucggcuacaacgucaugagcaaggacaacuucccccucuucgacaucaucaucuucaucaaguccgcggugaucaagaccacguacaaccacauuuacgacaccgggccaaccauaggcaucaacgugaugcacgacgagcauugcaccggacagugccccaucgagaucccccacaaggagaacuggcugacguucagccaagagcgcaccucccgguggggcugcgaggaguucggcugccuggccauuaacaccgggugcgucuucggcagcugccaggacaucauccgcccggaaaccaagguguaccggaaggccaucgaggaguccgugcuccugaccgucugcgugaccuaccccgggaacacuuucugcaccgagaucaacgccaucgagccgaagaucaccgacgagcuggagcuccaauucaagaccguggacaccaagacccugcccaaccugcucgcgguccagaaccacaagcuguacagcggccagaucaacgaccugggguccuucgcccagggcugcggcaacauccagaagaccaaccucagcgugaucgggacgggcaccgccaaguucgacuacauuugccacggggccucccgcaaggacaucgugguccggcgcugcuacaacaacaacuacgagagcugcaagcugcugaaggaggagccgucccucaucuucagcgacaaccacgagaccaucgaaguggccaacauccggcaccuccugggcgagcuccaguucaagcugaugcugggagaccuccgcuacaagucuuucgcggagaaccccgagcuggagaucgaggcucgcugcgugggcugccccagcugcuucuccagcuacagcugcaauuuccggaucuccagcuccaucgacaccgucugcgcgaucgacggccccuguacgauuuuccacaaccgccugaucaucagcuccaccaagcaggacuacgggaucaagaugagcugcaaggagaagccgaaccccguggagaaguucaacaucugcaagcggguguacuccguccucuucaccaccaucgacaagaacgacaagaucgagaucaacacgggcgaccagaccagcuucauccaggagaaggacgaccgcugcaagaccuggcugugcagagugcgcgacgaagggaucucugugaucuucgagcccaucaaggccuucuuuggcagcuacuucuccaucgccuucuacgucgugaucggcaucaucgcgcuguucaucaucauauacauauuccuccccaugggguucaagcugaaggacauacugaagaaaaacgagcuccuguaccugcaggagaugaaguacaaguga

SEQ ID NO: 15805 - RNA, 4305 nt, Artificial Sequence
  derived and/or modified CDS sequence (opt11) from BATV(804992)__FJ436801.1__GP
augcugcuccugcuggugcuccugauccccugcugcgucucagccuccccggugaucacccgcugcuuccacggcgggcagcugaucgccgagcgaaagagccaggcggccaucuccgaguucugccucaaggacgacgugagcaccaucaaguccgagauuaucuacgagaagaacgacacgggccuauucgcccacaauaagguccugcgcaacuggauuaucaaggacuggaagaacugcaaccccgugcccaccgccgggggcagcaucaacgugaucgaggucaacaccgaccucucccugaccacgaagacuuacgugugcagccgggacugcaccaucaccguggacaaggaggacgcccagaucaucuuccagacggagaagcugaaccacuucgaggucuccgggaccacccucagcuccggcugguucaagaccaaggcgagcgugacgcuggaccggaccugcgagcacaucaaggugaccugcggcaagaagacccugcaguuccacgccugcuucaagcaccacauguccugcauccgguucuuccacgggacgauccuccccggcaccauggccaccucuaucugccagaacaucgagcugaucaucaucaucucccugacccucaucaucuucauucucauggucauucugacgaagaccuacaucugcuaccuccugaugccgcuguucaugcccaucgccuacuucuacggguggagcuacaacaaguccugcaagaagugccccuguugcggccucgcguaccaccccuucaccaacugcgggagccacugcgugugcggccugaaguucgaggccuccgaccgcaugcggauccaccgcgagagcggccugugccagggguacaagagucuccggguggcccgccugcugugcaaguccaagggcagcuccuuaaucaucagcauccugcuguccaugcucauccugagcuucgucaccccgaucgaggggacgcugaccaacuaccccgagucccggaaguacgaccucgaggagaucgccgacgugcuggagggcuucguggucgagaagggcauuaaggaguacgugguguuuuacaccagcaucuucggugcccuguuccuccugauggcgcugauagucaucaucgcacucaaccgcgugaccgaguaccugacgaacaucaacgugcuguacugccacgagugcuccauguaccacagcaagaagaacaucaaguacaucggcgacuucaccaacaaaugcggguucugcacgugcggcgagcuugaagaccaggaggggcuaaagauccacaaggucucccggaagugcaucuacaaguaccagcugaccuggaguaaggugaucaugaugauccucgucugccugcugaucgcccagaacaccauacuaaucguggccgccuccgacgacugcuggaccaaaaagucccucgagauggagugcaucggcccccugcagcaagucgauacgugcgaugacaagaccucccgcagcuacuccggcgaggcgaagaagcuggugcgggccagcaagaucuccgaccucgacgccgcccagguggggcugcugggcagcaccaucgagucagccaucgcguccauccgccggcagcgcaccuacagcaccaugcaccuccuggaguccguguuccuggggaagcacugcgacuacuacaaggucuucgagcacaacagcggcuacucccaggccaaguggcgucucaccgccaagacacaccacuucgacaucugcagucgccacuccacgcaccacuucugccggugcaucucugacgggaccaagugccagaacggcgacugggacuucgccggcgagaugaacuccaucuaccagagcaagaaggacuucuucaagcacgacuucaagcuguucugcacccugguggagaacgccuuucccgggaccacggagucccucuucuacgagaugcugagcaagaaaaacaccaccggcaucaccaagcugcucgacaaacugacgaagaaguucggcaacaacaacauguucgugggcaucuggaaguucgggcaguacuuaaugucccucccguacgucaaugagaccagccugucccccauccagcuggcgaaggugcucgaggugaccgaccaacaccaccgcagcgucuccggccgccaggagagccuggccagcgccacccccggcuccaagagcuccgagugcgaccacgccaagaaggugagcugcaucagcccccgguucggggcgccgauggagggccugauggccugcgggaacagccccaacuacaagaucuacaagacgcccgccaagcucuacaaguccaacaacaagggcgagguguggugcagcggcgacguccacugcuuccaggagcugacccccgccucccaggagagcguggaccgcaucaagcagaugaccugcuuccugaccgagccggaggugaacgacgacgucuucuccaucgccaucgcgaugugcaaggugcaggacaagggggugugcacgaucaacgaggaccgguggaacaucaucaagugcgauagcggccucaucuacuacaccgaccagagggaggggcaggacaccggcaacgacuuuggggaguacugucugucccacagcugcagaaucgagcgcuuccccaucaaccccgcgaucaucuccgacugccugugggaguaccacagccggaaguccaaguacaucaccagccucgaccuggagucccuggaggaguucaagcgcgccaucagcgagaagcucagccacacgcuggucgucuacaacuucaagcccaccgccaaccugccgcacaucaagcccguguauaaguacaucaccguccagggcguggagaacuccgacggcguggacagcgccuacaucaccgcguccaugcccgcauuaagcgggacgucgaucggcuacaacaucaugagccgggacaacuucccccuguucgacaucaucaucuucaucaaguccgccaucaucaaggccaccuacaaccacaucuacgacaccgggcccaccaucggcaucaacgucaugcacgacgagcacugcacaggccagugucccaccgacaucccccacaaggagaacuggaucaccuucgcccaggagcgcaccagccgguggggcugcgaggaguucggcugccuggcggugaacacggggugcguguucggauccugccaggauaucauccgcccggagaccaaggucuaccggaaggccguggaggagagcgugcuccugaccgucugcaucacuuaccccgggaagacguucugcaccgagaucaacgccaucgagcccaaaaucaccgacgagcuggagcuccaguuuaagacaguggacaccaagacgcugcccaacauccuggcugugcagaaccacaagcucuacuccggccagaucaacgaccuggguagcuucucccagggcugcggcaacauccagaagaccaacagcuccauaaucgggacuggcaccgcgaaguucgacuacgucugccacggggccagccgaaaggacaucaucgugcggcgcugcuacaacaacaacuacgagaguugcaagcugcucaaggaggaacagagccugauguucgccgacaaccaugagaccaucgacguggccaacguccgucaccuccugggcgaccugcaguucaagcugaugcucggggaccugcgcuauaaguccuucgccgagaauccggaccuggagaucgaggccaagugcgugggcugccccagcugcuucaccagcuacuccugcagcuucaagaucguguccaacaucgacaccgucugcagcaucgagggcccaugcaccacguuccacaaccggcucaugaucaccuccacaaagcaggacuacgggaucaagaugagcugcaagaccaagcccggccugacggaagaguuccagauuugcaagaagaccuacaccgugcuguucgccaccguggagaagaacgacaagaucgagaucuccacgggggaccagaccagcuucauccaagagcgcgacgaccgcugcaagaccuggcucugccggguccgcgacgagggcaucuccgugaucuucgagccgauccgggccuucuucgggagcuacuucuccauagccuucuacaucgugaucgggaucaucguccuguuccuggugaucuacaucuuccuccccaugauguuuaagcugcgugacgugcugaaacggaacgaguacuuauaccuacaagagaucaagcacaaguga

SEQ ID NO: 15806 - RNA, 4305 nt, Artificial Sequence; identical to SEQ ID NO: 12520
  derived and/or modified CDS sequence (opt11) from BATV(8627-11)__FJ436799.1__GP

SEQ ID NO: 15807 - RNA, 4305 nt, Artificial Sequence; identical to SEQ ID NO: 12521
  derived and/or modified CDS sequence (opt11) from BATV(Chittoor/IG-20217)__JX846599.1__GP

SEQ ID NO: 15808 - RNA, 4305 nt, Artificial Sequence; identical to SEQ ID NO: 12522
  derived and/or modified CDS sequence (opt11) from BATV(41.3)__KM507322.1__GP

SEQ ID NO: 15809 - RNA, 4305 nt, Artificial Sequence; identical to SEQ ID NO: 12523
  derived and/or modified CDS sequence (opt11) from BATV(EIV-1217Astr)__KT313699.1__GP

SEQ ID NO: 15810 - RNA, 4305 nt, Artificial Sequence; identical to SEQ ID NO: 12524
  derived and/or modified CDS sequence (opt11) from BATV(EIV-12497Bl)__KT313692.1__GP

SEQ ID NO: 15811 - RNA, 4305 nt, Artificial Sequence; identical to SEQ ID NO: 12525
  derived and/or modified CDS sequence (opt11) from BATV(EIV-12845Ms)__KT313690.1__GP

SEQ ID NO: 15812 - RNA, 4305 nt, Artificial Sequence; identical to SEQ ID NO: 12526
  derived and/or modified CDS sequence (opt11) from BATV(EIV-2077Astr)__KT313702.1__GP

SEQ ID NO: 15813 - RNA, 4305 nt, Artificial Sequence; identical to SEQ ID NO: 12527
  derived and/or modified CDS sequence (opt11) from BATV(Italy-2009)__KC168047.1__GP

SEQ ID NO: 15814 - RNA, 4305 nt, Artificial Sequence; identical to SEQ ID NO: 12528
  derived and/or modified CDS sequence (opt11) from BATV(MM2222)__AB257763.1__GP

SEQ ID NO: 15815 - RNA, 4305 nt, Artificial Sequence; identical to SEQ ID NO: 12529
  derived and/or modified CDS sequence (opt11) from BATV(MM2222)__AY772534.1__GP

SEQ ID NO: 15816 - RNA, 4305 nt, Artificial Sequence; identical to SEQ ID NO: 12530
  derived and/or modified CDS sequence (opt11) from BATV(MM2222)__JX846596.1__GP

SEQ ID NO: 15817 - RNA, 4305 nt, Artificial Sequence; identical to SEQ ID NO: 12531
  derived and/or modified CDS sequence (opt11) from BATV(MS50)__JX846605.1__GP

SEQ ID NO: 15818 - RNA, 4305 nt, Artificial Sequence; identical to SEQ ID NO: 12532
  derived and/or modified CDS sequence (opt11) from BATV(NM/12)__KJ187039.1__GP

SEQ ID NO: 15819 - RNA, 4305 nt, Artificial Sequence; identical to SEQ ID NO: 12533
  derived and/or modified CDS sequence (opt11) from BATV(ON-1/E/94)__AB257764.1__GP

SEQ ID NO: 15820 - RNA, 4305 nt, Artificial Sequence
  derived and/or modified CDS sequence (opt11) from BATV(ON-7/B/01)__AB257765.1__GP
augcugcugcugcugguccuccugauccccugcugcgucagcgccuccccggugaucaccagaugcuuccacggcgggcagcugaucgccgaacguaagagccaggcggccaucuccgaguucugucucaaggacgacgugagcaccaucaaguccgagaucauuuacgaaaagaacgacacgggccuguucgcccacaacaagguccugcgcaacuggaucaucaaggacuggaagaacugcaacccagugcccaccgccgggggcagcaucaacgugaucgaggucaauaccgaccucucccugaccacgaagaccuacguguguagccgggacugcaccaucaccguggacaaggaagaugcccagaucaucuuucagacggagaagcugaaccacuucgaggucuccgggaccaccuuaagcuccggcugguucaagaccaaggcgagcgugacgcuggaccggaccugcgagcacaucaaggugaccugcggcaaaaagacacugcaguuccacgccugcuucaagcaccacauguccugcauccgguuuuuccacgggacgauccuccccggcaccauggccaccuccaucugccagaacaucgagcugaucaucaucaucucccugacccucaucaucuucauccugauggucauccuaacgaagaccuacaucugcuaccugcugaugccucuguucaugcccaucgccuacuucuauggauggagcuacaacaaguccugcaagaagugccccugcugcggccucgcguaccaccccuucacgaacugcgggagccacugcguuugcggccugaaguucgaggccuccgaccgcaugcggauccaccgcgagagcggccugugccagggguacaagagccuccggguggcccgccuacugugcaaguccaagggcagcucccucaucaucagcauccugcuguccauguugauccugagcuucgucacccccaucgaggggacgcugaccaacuaccccgagucccggaaguacgaucucgaagagaucgccgacguccuugagggauucaucguggagaaaggcaucaaggaguacgucguguucuacaccagcaucuucggggcccuguuccuacugaucgcgcugaucguaaucauugcccucaaccgcgucaccgaguaccucacgaacaucaacgugcuauacugccacgagugcuccauguaccacagcaagaagaacaucaaguacaucggcgacuuuaccaacaagugcggguucugcacgugcggcgagcucgaggaucaggagggacucaagauccacaaggugucccggaaaugcauauacaaguaccagcugacguggucgaaggucaucaugaugauccucgugugccugcugauugcccagaauacaauccugaucgucgccgcauccgaugacugcuggaccaagaagucccucgagaugggcugcaucgggccccugcagcaggucgacacgugcgacgacaaggcgucccgcagcuacucgggggaggccaagaagcugguaagagccaguaagaucuccgaccucgacgccgcccaggugggccaacuggggagcaccauugagagcgcgaucgccuccauccgccggcaacgcaccuacagcaccaugcaccuccuggaguccguguuccugggcaagcacugcgacuacuacaagguguuugagcacaauagcggguacucccaggcgaaguggcggcugaccgccaagacgcaccacuucgacaucuguagccgccacuccacccaccacuucugccggugcaucagcgacggcacgaaaugccagaacggcgacugggauuucgcuggggagaugaacuccacauaucaaagcaagcgcgacuucuucgagcacgacuucaaucucuucuguacccucaucgagaacgcguucccuggcaccacggagucccuauucuacgagaugcucagcaagaagaacaccaccgggaucaccaagcugcuggacaagcucacgaagaaguucggcaacaacaacauguucgucgggauuuggaaguucggccaguaccugaucucccugccguacgugaacgagaccagccucucccccacccagcuggccaaggugcuggucgugaccgaccagcaccaucgcagcaucuccgggcggcaggagagcuuagccagcgccacgcccggauccaaguccuccgagugcgggcacgcuaagaaagugagcugcaucagcccccgcuucggggucccgauggagggccugauggccugcggcagcucccccaauuacaagaucuacaagacccccgccaagcuguacaagagcaacaacaagggggaaguguggugcucaggcgacgugcacugcuuccaggaccucauccccgccagccaggaguccgucgaccggauuaagcagaugacuugcuucuugacggagccggaggugaacgacgacguguucagcaucgccaucgcgaugugcaagguccaggacaagggggugugcacaaucaacgaggaccgcuggaacuugaucaagugcgacuccggccucaucuacuacacagaccagcgggaggggcaggacaccggcaacgacuucggcgaguacugccugagccacaacugcaagauggagcgcuuccccaucaaccccgccaucaucuccgacugccugugggaguaccacucgagaaaguccaaguacaucaccagccucgaccuggagucccuggaggaguucaagcgcgccaucagcgagaagcucagccacacgcugguggucuacaacuucaagcccaccgccaaccugccgcauaucaaacccguuuacaaguacaucaccgugcagggggucgagaauagcgacggcguggacagcgccuacaucaccgcguccaugcccgcccucagcgggacguccaucggcuacaacaucaugagccgggacaacuucccccuguucgacauaaucaucuucauuaagucagccaucaucaaggcaaccuacaaccacaucuacgacaccgggccgaccaucggcaucaacgucaugcacgacgagcacugcacgggccagugccccaccgacaucccccacaaggagaacuggaucaccuucgcccaggagcgcaccuccaggugggggugcgaggaguuuggcugccuggcggugaacacgggaugcguguucggcuccugccaggauauuauccgcccggagaccaagguguaccggaaggccgucgaggagagcgugcuccugaccguaugcaucaccuaccccgggaagacguucugcaccgagaucaacgccaucgagcccaagaucaccgacgagcuugaacuccaguucaagaccgucgacaccaagacgcugcccaacaucuuggccguacagaaccacaagcucuacuccggccagauuaacgaccugggcagcuucucccaagggugcgggaacauucagaaaaccaaucugagcaucaucgggaccggcaccgcgaaguucgacuaugugugucacggggccucccgcaaagacaucaucguccggcgaugcuacaacaacaacuacgagagcugcaagcuccugaaggaggagcagucccugauguucgccgacaaccacgagacgaucgacguggcaaacgugcggcaucuccugggcgaccugcaguuuaagcucaugcuuggcgaccugcgcuacaagagcuucgccgagaacccggaccucgagaucgaggcuaagugcgucggcugccccuccugcuucaccagcuacagcugcaacuucaagaucguguccaacaucgacaccgugugcagcaucgagggccccugcaccacguuucauaaccgccugaugaucacuuccgccaagcaggacuacgggaucaagauguccugcaagaccaagcccggccugaccgaggaguuccaaaucugcaagaagacguacaccguccucuuugccaccguggagaagaacgacgagaucgagaucucuaccggcgaccagacgagcuucauccaggagcgcgaugaccguugcaagaccuggcugugccgcgugcgcgacgaggggaucuccguaaucuucgagccgauccgggccuucuucggcagcuacuucucaaucgccuucuacaucgugaucgggaucaucgugcuguuucucgucaucuacaucuuccugcccaugguguucaagcugagagacgugcucaagcgaaacgaguaccuguaccugcaagaaauuaagcacaaguga

SEQ ID NO: 15821 - RNA, 4305 nt, Artificial Sequence; identical to SEQ ID NO: 12535
  derived and/or modified CDS sequence (opt11) from BATV(UgMP-6830)__DQ436460.1__GP

SEQ ID NO: 15822 - RNA, 4305 nt, Artificial Sequence; identical to SEQ ID NO: 12536
  derived and/or modified CDS sequence (opt11) from BATV(ZJ2014)__KU746870.1__GP

SEQ ID NO: 15823 - RNA, 4305 nt, Artificial Sequence; identical to SEQ ID NO: 12537
  derived and/or modified CDS sequence (opt11) from CVV__AF082576.1__GP

SEQ ID NO: 15824 - RNA, 4305 nt, Artificial Sequence; identical to SEQ ID NO: 12538
  derived and/or modified CDS sequence (opt11) from CVV(Montgomery County/VA/2015 4b)__KX583998.1__GP

SEQ ID NO: 15825 - RNA, 4305 nt, Artificial Sequence; identical to SEQ ID NO: 12539
  derived and/or modified CDS sequence (opt11) from CVV(Montgomery County/VA/2015 K)__KX583999.1__GP

SEQ ID NO: 15826 - RNA, 4305 nt, Artificial Sequence; identical to SEQ ID NO: 12540
  derived and/or modified CDS sequence (opt11) from CVV(1156)__EU583730.1__GP

SEQ ID NO: 15827 - RNA, 4305 nt, Artificial Sequence; identical to SEQ ID NO: 12541
  derived and/or modified CDS sequence (opt11) from CVV(6V633)__KX100134.1__GP

SEQ ID NO: 15828 - RNA, 4305 nt, Artificial Sequence; identical to SEQ ID NO: 12542
  derived and/or modified CDS sequence (opt11) from CVV(807270)__AF186243.1__GP

SEQ ID NO: 15829 - RNA, 4305 nt, Artificial Sequence; identical to SEQ ID NO: 12543
  derived and/or modified CDS sequence (opt11) from CVV(856 clone 1)__EU583732.1__GP

SEQ ID NO: 15830 - RNA, 4305 nt, Artificial Sequence; identical to SEQ ID NO: 12544
  derived and/or modified CDS sequence (opt11) from CVV(856 clone 3)__EU583731.1__GP

SEQ ID NO: 15831 - RNA, 4305 nt, Artificial Sequence; identical to SEQ ID NO: 12545
  derived and/or modified CDS sequence (opt11) from CVV(CK102)__AF186242.1__GP

SEQ ID NO: 15832 - RNA, 4305 nt, Artificial Sequence; identical to SEQ ID NO: 12546
  derived and/or modified CDS sequence (opt11) from CVV(CK-102)__KX100146.1__GP

SEQ ID NO: 15833 - RNA, 4305 nt, Artificial Sequence; identical to SEQ ID NO: 12547
  derived and/or modified CDS sequence (opt11) from CVV(MI80-1-450)__AF186241.1__GP

SEQ ID NO: 15834 - RNA, 4305 nt, Artificial Sequence; identical to SEQ ID NO: 12548
  derived and/or modified CDS sequence (opt11) from CVV(MI80-1-450)__KX100149.1__GP

SEQ ID NO: 15835 - RNA, 4305 nt, Artificial Sequence; identical to SEQ ID NO: 12549
  derived and/or modified CDS sequence (opt11) from CVV(MNZ-92011)__KC436107.1__GP

SEQ ID NO: 15836 - RNA, 4305 nt, Artificial Sequence; identical to SEQ ID NO: 12550
  derived and/or modified CDS sequence (opt11) from CVV(MPB1-1551)__KX100143.1__GP

SEQ ID NO: 15837 - RNA, 4305 nt, Artificial Sequence; identical to SEQ ID NO: 12551
  derived and/or modified CDS sequence (opt11) from CVV(W308-67)__KX100140.1__GP

SEQ ID NO: 15838 - RNA, 4305 nt, Artificial Sequence; identical to SEQ ID NO: 12552
  derived and/or modified CDS sequence (opt11) from CVV(W728-67)__KX100137.1__GP

SEQ ID NO: 15839 - RNA, 4305 nt, Artificial Sequence
  derived and/or modified CDS sequence (opt11) from CVV(WI-03BS7669)__KX100152.1__GP
augcuguuccuccugauccuggccuuccucggcuucagcacuuccaaucccauagccacccgcugcuuccauggcggccaacucaucgcugaaagcaaguccgccacgagcaucuccgaguucugccugaaggacgacgugagcaugcucaagagcgagguagucuacaucaagaacgacaccgggcuguucggccacaacaagguguuccggagcuggaccaucaaagacuggaagcugugcaacccuauccccaccgccgggggcacgaucaacgucaucgaggugaacaaggaccucucccugaugaccaagaccuacauuugcucgcgcgacugcaccaucacgaucgacaaagaggaggcucagaucaucuuccagaccgauaagcugaaccacuucgaggucuccggcaccacgcucagcuccgggugguucaagagcaaagccuccgucacgcuggaccggacgugcgagcacgugaaggugaccuguggcaagaagucccugcaguuccacgcgugcuucaagcaccacaugagcugcguccgcuucuuccacaacacuauccuccccgggaacaugaucacgagcaugugccaaaacaucgagcugauuaucauccugggccucacccucgccaucuucauccuuauggugauccucaccaagaccuacaucugcuaccuccugaugcccaucuucaugccgaucgccuaccucuacgggugggccuacaacaaguccugcaagaaaugcaacugcugcggccuggcguaccaccccuucacgaacugcggcagccacugcgugugcgggcugaaguucgaggccuccgaccggaugagaauccaccgggaguccggccucugccagggguacaagucacugcgcaucgcccggcuguuaugcaaguccaagggcagcucccucgucaucagcggccuguuauccaugcugauccuuagcuucgugacccccaucgaaggcaccauuaccuccuaccccgagagcagaaaauacacgcucgaggagaucaccgauguugucgagggccugguguccgagcagaauaucaaggaguacaucgucuucuacaccagccuguucggcucccucauccugcugcucgccuucaucaugagcaucacccugucgaagaucacgagcauccuggccaagcggaacgucaucuacugcgaggaguguuccauguaccacagcaagcgcgggaucaaguacaacggggacuucaccaacaagugcggcuucugcacgugcaacgagcaggaggacaccgagggccucgugauccacaagguguccaagcggugcaccuacaaauaccagcugaagugggcgaagguccugaugauaacccucgugcuucugcugaucgcccaaaacaccauccuuaucguugccgccgagaccgacugcuggaucaagaagucccuggacauugacugcaucgggccgaugcuggacaucggcagcugcacgaacaagaacacccgcagcuacgacacagaggcccaaaaacuugucucccagucaaagaucagccagcuggacgcggaccaggugucccugcucgggaacagcaucgacuccgccaucaaggccauacgggcccagaagaccuacagcacaaugcaccuccuagagacuaucuuccugaugaagaacugcgacuacuacaccuccuucaaccacaacuccggcuacucccaggccaaguggagacugaucgcgaagaccgggcacuucgacaucugcagcaggcacuccacccaccacuucugccgcugcaucaacgacggcacgaagugccagaacggcgacugggacuucgcgggggagaugaacgagaccuacaacagcaagaacgacuucuacucccacgaccugaaccucuucuacaccaucuucgagaacgcauuccccggcaccacggagagccuguucuaccagcugauccagaagaagaacaccaccggcgcuuccaagguccucggcaagcugaucaccaaguacgggaauaacaacauguucguggguguguggaaguucggccaguaccugcucacgcugcccuacaucaacaauaccgagcugagccagaaccggcgccucaccauccugaccacgcaggagcugcucagccggucccacagcgggcgccaggaguccaugagcaacgccauccagggcuccaucaccaaggagugucacaacgcgaagggggugggcugcaucagcccacgcuucggcauuccgauagggaaccugaccgcaugcggcgacucccccaacuacaaaaucuacaagacccccgagaagcuguacaagagcaacaacaagggggaaguguggugcuccaaugacgugcacugccucaacgacuuugagcccgccgaugaggaggucgugaauaagaucaagaaguuaacgugcuuccugacugacgugagcgucgagguggacauauucuccgucgccgccagcacgugcaagauggccgacaagggggucuguaccgugaacggggcgaaguggaacaucaucaagugcgacuccggccucuacuacuucaccgaccaccgggagggccaggacaccgggaacgacuucggcgaguacugcaucagccacucuugcaacaccgagcgcuucccgauaaaccccgacauccugaaggacugcaccugggaguuccacagccggaaguccaaguacaucagcacgauuucccuggagagccucgaggaguuccgccgugccauggccgagaagcugagccauacccugaccaucuacaacuucaagcccaccgcgaaccucccccauauccgcccgacguacaaguucaucaccgccaacgggguggaaaacuccgacggcaucgagagcgccuacauccugucaucgaucccggcccucgggggcaucuccgucggcuacaacgugcagaccaaggacaacuucccccugcuggacaucaucguguucaucaagagcgccgucauccggaccacguacaaccacaucuacgacaccgggcccaccaucggcaucaacacucagcacgacgagcacugcaccgggccgugccccgcgguggugccccacaaggagaacuggaugacguucucccaagagcgaaccagccggugggggugcgaggaguucgguugccuggccaucaacaccggcugugucuucggcuccugccaggauaucauccacccggagaccaaaguguaucgcaaggccguggaggaggaggucgugcucacggucuguaucaacuuuccggggaacaacuacugcacugagaucaacgccaucgagcccaagaucaccgacgaaaucgagcugcaguucaagacggucgacacgaagacccuccccaaucuccuggccgugcagaaccacaagcuguacagcggccagaucaacgaccucggguccuucucccagggcugcgggaacgugcagaagaccaaccacagcauccugggcaugggcaccgucaaauucgacuacgugugccacggcgcgagccgcaaggacgugaucguccgccggugcuacaacaacaacuucgacuccugcaaauugcucaaggaggagacgagccugaucuucgccgacaaccacgagacccuggagguggcacacaccaagcaccucaucggugagcugcaguuuaagaucaugcugggggacauccgcuacaaguccuucgccgaaucuccggagcucgagaucgaugcgaagugcgugggcugccccuccugcuucgagagcuacagcugcaacuuccagauagucaccaacaucgacacggugugcuccguggaaggccccugcacucuguuccacaaucggaucaucaucagcgccaacaagcaguccuacggucugaagaugagcugccagaccaagcccaaccagaacgaggaguucaucaucugcaaccgcaaguacuccguccucuucaccacgaucgacaagaaugacaagauagaggugaacaccggcgaccagaccagcuacaucuaugagaaggacucccggugcaaaaccuggcugugccgcgugcgggacgaggggauuagcguccuguuugagccgcucaaagccuucuucggcuccuacuucagcaucaucuucuacgugguggucgggaucaucgugcuguuccugaucaucuacaucuuccugcccauguucuucaagcugaaggacguccuaaagcgcaacgaguaccucuaucugcaggaacugaagcacaaguga

SEQ ID NO: 15840 - RNA, 4317 nt, Artificial Sequence; identical to SEQ ID NO: 12554
  derived and/or modified CDS sequence (opt11) from CHLV(CHLV-Mex07)__JN808310.1__GP

SEQ ID NO: 15841 - RNA, 4305 nt, Artificial Sequence
  derived and/or modified CDS sequence (opt11) from FSV(86MSP18)__KX100131.1__GP
augcugagccuccugauccuggcccuccugggccugagcaccucaaaucccaucgccacccgcugcuuccacgggggccagcucaucgcggaguccaagagcgcgacgucaauaagcgaguucugccugaaggacgacguguccaugcucaagagcgaggucaucuacaccaagaacgacaccgggcuguucgggcacaacaagguguuccgauccuggaccaucaaggacuggaaacugugcaacccgauucccacggccgggggcaccaucaacgugaucgaggucaacaaagaccugagccucaugaccaagaccuacaucugcucccgcgacugcacgaucaccaucgacaaggaggaggcccaaaucaucuuccagaccgacaagcucaaccacuucgaggugagcggcacuacgcugucaagcgggugguucaaguccaaagccagcgugacccucgaccggaccugugagcacgugaaggugaccugcggcaagaagucccugcaguuucacgcgugcuucaagcaccacaugagcugcgugcgcuuuuuccacaacacgauccugcccgggaacaugaucaccuccaugugccagaacauagaguuaaucaucauccugggccugacccucgccaucuucauccugaugguaaugauaaccaagacguacaucugcuaccugcucaugcccaucuucaugccgaucgccuaucuguacgguugggcguacaacaagagcugcaagaagugcaacugcugcggccuggcguaccaccccuucaccaacugcggcagccacugcgugugugggcucaaguucgaggccuccgaccggaugcgcauacacagagagagcggccugugccagggguacaagucccugcgcaucgcccggcuccugugcaagagcaagggcuccagucuggucaucaguggacuccugagcaugcugauccucuccuucgucacccccaucgaagggaccauaacgaacuacccggacagccgcaaguauacccuggaggagauaaccgacgugguggagggacugauauccgagcagaacaucaaggaguacaucgucuucuacaccagccucuucgggucccugauccugcuccuggccuucaucaugagcaucacgcuuuccaagaucaccagcaucuuggcccgucgcaacgugaucuacugcgaagaguguuccauguaccacagcaagcggggcaucaaguacaacggggacuuuaccaacaaguguggcuucugcacgugcaacgagcaggaggacgcagagggcgugguuauccacaagguguccaagcgcugcaccuacaaguaccagcugaagugggccaaagugcuuaugaucacacucguccugcugcuaaucgcacagaacacaauccucaucguggccgccgaaaccgacugcugggcgaagaagucccuggacaucaacugcaucgguccgaugcugaacaucggcagcugcacgaacaagaacaccaggagcuacgacacugaagcccagaagcucgugagccaguccaaggucagccaacuggacgccgaccaggccuccuugcucgggagcaguauugacagcgccauaaaggcgauccgcgcccagaagaccuaccccgccaugcaccuccuggagaccaucuuccucaugaagaacugcgacuacuacacguccuucaaucacaacagcggguacagucaggccaaguggcggcugauagccaagaccgggcacuucgacaucugcagccgccacuccacccaccacuucugccggugcaucaacgacgguaccaagugccagaacggcgacugggacuucgcaggggagaugaacgagacguacaacucaaagaacgacuucuaccugcacgaccucaaucuguucuauaccaucuucgagaacgccuuccccggcaccaccgagucccuguucuaccagcuuauccagaagcgcaacaccaucggggccagcaaggugcugggcaagcugaucaccaaguacggggacaacaacauguucgucggcguguggaaguuuggccaguaccuccugacucuccccuacaucaacaacaccgagcucucccagaaucggcgccagacuaucuuggccgcgcaggagcugagcagccgcucccacccgggucggcaagagagcauguccagcgccauccagggcuccgugaccaaggaaugccacaacgccaaggaugucgggugcaucagcccccgauucggaauccccaucggcaaccucaccgccugcggggacucccccaacuacaagaucuacaagacuccggagaagcuguacaagagcaauaacaaaggcgagguauggugcuccaacgacgugcacugccugaacgacuucgaaccugccgacgaggaggucgugaacaaggugaagaagcugaccugcuuccucaccgacgucagcgugaagaccgacaucuucuccguggcggcaagcacgugcaagauggccgacaagggggucugcaccguuaacgacgccaaguggaacauuaucaagugcgacuccggccuguacuacuucaccgaccaccgggagggucaggacaccggcaacgacuucggcgaguacuguaucagccacuccugcaacaccgagcgcuuccccaucaaccccgacauccucaaggacugcaccugggaguuccacagccggaaauccaaguacaucucaaccaucucccuggagagccuggaggaguuucgccgggccaugaccgagaaacucagccacacccugacgaucuacaacuucaagccgaccgcgaacuugccucacauccgccccaccuacaaguucaucaccgcgaacgggguggagaacuccgacgguaucgaauccgccuacauccucuccagcaucccggcccucgggggcaucuccgucggguacaacgugcaaacgaaagacaacuucccgcugcuagacaucaucguguucgucaagagcgccgugauccggaccaccuacaaccacaucuacgacaccggccccacgaucggcaucaacacccagcacgacgagcacugcacgggccccugccccgccgugguaccgcacaaggagaacuggaucaccuucucccaggagcgcaccucacgguggggcugcgaggaguucgggugccuggccaucaacacaggcugcguguucggguccugccaggacaucauccaccccgagaccaagguguaccgcaaggcugucgaagaggaggugguccugaccgucugcaucaacuuccccggaaacaacuacugcaccgagaucaacgccaucgagccgaagaucacggaugagaucgaacuccaguucaagaccgucgacaccaagacccugcccaaccuacucgcggugcaaaaucacaagcuguacagcggccagaucaacgaccuaggguccuucagccaggggugcgggaacguccagaagacgaaccacuccauucucggaauggggaccgccaaguucgacuacgugugccacggugccagccggaaggacgugauaguccgccggugcuacaauaacaacuucgacuccugcaagcugcugaaggaggagaccagccucguguucgccgacaaccacgaaacccuggagguggcccacacgaagcaccugaucggcgagcuacaguucaagaucaugcugggggacauccgcuacaaguccuucgcggagagccccgaguuagagaucgacgccaaaugcgucggcugccccuccugcuucgagagcuacagcugcaacuuccaaaucgugaccaacaucgacaccgugugcuccgucgaaggaccgugcacccucuuccacaaccggaucauuaucagcgccuccaagcagagcuacggccugaagauguccugucagacgaagccaagccagaacgaggaguucaucaucugcaaucgcaaguauucagugcuguucaccaccaucgacaagaacgacaagaucgagguaaacaccggcgaccagacuagcuacaucuacgagaaggacucccggugcaagaccuggcucugcaagguccgcgacgaggggaucagcgugcuguucgagccccugaaggccuucuuuggauccuacuucagcaucaucuucuauguugucguggggaucaucgugcuguuucuggucaucuacaucuuccugcccauguucuucaagcucaaggacgugcugaagaagaacgaguaccuguaccuccaggagcugaagcaucgcuga

SEQ ID NO: 15842 - RNA, 4314 nt, Artificial Sequence; identical to SEQ ID NO: 12556
  derived and/or modified CDS sequence (opt11) from GERV__M21951.1__GP

SEQ ID NO: 15843 - RNA, 4260 nt, Artificial Sequence; identical to SEQ ID NO: 12557
  derived and/or modified CDS sequence (opt11) from IACOV(BeAn314206)__JN572066.1__GP

SEQ ID NO: 15844 - RNA, 4305 nt, Artificial Sequence; identical to SEQ ID NO: 12558
  derived and/or modified CDS sequence (opt11) from ILEV(KO/2)__AY859372.1__GP

SEQ ID NO: 15845 - RNA, 4305 nt, Artificial Sequence; identical to SEQ ID NO: 12559
  derived and/or modified CDS sequence (opt11) from ILEV(R5964)__KF234074.1__GP

SEQ ID NO: 15846 - RNA, 4305 nt, Artificial Sequence; identical to SEQ ID NO: 12560
  derived and/or modified CDS sequence (opt11) from MAGV__AY286443.1__GP

SEQ ID NO: 15847 - RNA, 4305 nt, Artificial Sequence; identical to SEQ ID NO: 12561
  derived and/or modified CDS sequence (opt11) from MAGV(ts8)__AY286444.1__GP

SEQ ID NO: 15848 - RNA, 4311 nt, Artificial Sequence; identical to SEQ ID NO: 12562
  derived and/or modified CDS sequence (opt11) from MAGV(AG83-1746)__KX100113.1__GP

SEQ ID NO: 15849 - RNA, 4305 nt, Artificial Sequence
  derived and/or modified CDS sequence (opt11) from MAGV(BeAr 7272)__KX100104.1__GP
auggagcugcucaucaucauccugcugcucggcagcgccgccuccagccccaucuccacccgcugcuuccacggcgggcagcugauagcggagagcaaguccgccaccagcaucucggaguucugccugaaggacgacgugagcaugaucaaaucagagguuacguacaucaagaacgacaccgggaucuacgggcacaacaaaguguuccggagcuggacaaucaaggacuggaagcucugcaacccgauccccaccgccgggggcuccaucaacgugaucgaggucaacagcgaccugucccuggccacgcgcgccuacguguguagccgggacugcaccaucacaaucgacaaggaggacgcgcagaucaucuuccagaccgacaagcucaaccacuucgagguguccggcacgacccugagcuccggcugguucaagaccaaggccagcgucacccuggaccgcacgugcgagcacaucaaggugaccugcggcaaaaagucccuccaguuccacgccugcuucaaacaccacaugucgugcauccgguucuuccaccacaccauccugccggggaccauggugagcuccaugugccagaacaucgagcugaucaucaucaucggccucacgcuggucaucuucauccugauggugauccucaccaagaccuacaucugcuaccugcugaugcccguuuuuaugccagucgccuacaucuacgggugggcguacaacaagagcugcaagaagugcaacugcugcggccucgccuaucaccccuucaccaacugcggcucccacugcgugugcgggcugaaguucgaggccagcgaccgcaugcgguuacaccgcgaguccggccucugccagggguacaagagccugcggaucgcccgcaugcugugcaaguccaagggcagcucccuagugauuagcggacugcuguccaugcuccugcugagcuucaucacgcccaucgaggggaccuugaccaacuaccccaacgagaagcaguacacucuggaagagaucgccgacgucguggagggcaucaucacggagcagcaccugaaggaguacguggucuucuacaccucccucuucgggggccugauccugcuccugacccugauccucagcaucaccaucaacaaggugacggaccugcuggcguccaccaacgugaucuacugcgaggagugcagcauguaccacucuaagaaggggaucaaguacaacggcgacuucaccaacaagugcggcuucugcacgugcagcgagcaggaggacgucgagggggugaucauccacaaggugucccggaagugcacguacaaguaccagcucaaguggguccgcgugaucaugaucauccuggcccuccuccugaccauacagaacaccguccugaucguggccgccgagguggacugcuggaccaagaaguccaucgaaaucgacugcaucgggccgcugcucaacaucgggagcugcacugacaagagcagccggaccuacgagaccgaggucaacaagcuggugcgccaguccaagguaacccacgccgacgccgagcagaucagcauucucggcuccacccucgacaaugccaucaaggccguccggagccagaagacguacgagaccaugcacuuccuggagaccguauuccugaugaagaacugcgauuacuacaacuccuucgagcacaacagcggauacucccaaaccaaguggaggcucaucgccaagacgagccacuucgauaucugcagccggcacagcacgcaccacuucugccgcugcgugaacgagggcaccaagugccagaacggcgacugggacuucgccggggagaugaacgacaccuacaacuccaagaaugacuucuaccugcacgaccuggaccucuucuacacgcugcuggagaacgcguuccccggcaccaccgagagccucuucuaccagcugcugcagaagaagaacaccacgggggccuccaagcuccugggcaagcugaucaccaaguacgggaacaacaacauguuugucgagaucuggaaguucggccaguacuuacugaagcugcccuacaucaacgacaccgagcucagcaccgaccggaaguccacgaucaucaagagccaacagguccugagccgcucccagaccggccggcaggagagccuguccagcgccaccccugggaccgccacgaaggagugcuccaacgccaaggacaucggcugcaucagcccgcgcuucgggauacccaucggcaaccucaccgcgugcggcgacucccccaacuacaagguguacaagacccccgagaagaucuacaagagcaacaaccgaggggaggugugguguuccgacgacgugcacugccugaccgacuucgagccggccgaagaggagguggucaacagaaucaagcagaugacgugcuucuugaccgacgugaccaccaagacggacguguucagcgucgccaucuccacgugcaagaugguggacaagggcgugugcaccgucaacgacgccaaguggaacauccucaagugcaacagcgggcuguacuauuucaccgaccaccgcgacggccaggacaccgggaacgacuucggcgaguacugcaucucccacagcugcaacaccgagcgguuccccaucaaccccgacguguugaaggacugcaucugggaguaccacucccgcaagagcaaguacaucuccaccgugagccucgagucccuggacgaguuccgucgcgcgaugagcgacaagcugagccacacccucaugaucuacaacuucaagcccacggccaaucugccgcacaucaagcccaccuacaaguucaucaccgccaacggcaucgagaacuccgacgggaucgacagcgcauacauccuguccagcauccccgcccucggcgggauguccgucggcuacaacauccagaccaaggacaacuucccccugcuggacaucaucguguucaucaaaagcgcgaucaucaagaccacauacaaccauaucuacgacaccgggccuaccaucggcaucaacacacagcacgacgagcacugcacuggccccugccccacccucaucccccacaaggagaacuggcugaccuucucccaggagcggaccagccgcugggggugcgaggaguucggcugccuagccaucaacacgggguguguguucggcuccugccaggacaucauccacccggaggccaaggucuaccggaaggccaucgaggaggagguggugcucaccgucugcaucaccuuccccgggaacaccuacugcacggagaucaacgccaucgagcccaagaucaccgacgagaucgagcuucaguucaagaccguggacaccaagacgcugccgaaccuccugauggugcagaaccacaagcuguauucuggccagauaaacgaccucggcuccuucagccaggggugcggcaacguccagaagaccaaccaguccgugaucggggcgggcaccgccaaguucgacuacgugugccacggggccagcaggaaagacgucaucgugcgucgcugcuacaacaacaacuacgaguccugcaagcugcugaaggaggagaccagccucauuuucgccgacaaccacgagacgcuggagguggccaacaccaagcaccugaucggcgagcuccaguucaagaucaugcugggcgacauccgguacaaguccuucgccgagagccccgagcuggaggucgacgccaagugcguggggugccccuccugcuucgagagcuacagcugcaacuuccagaucgugaccaacaucgacaccgucugcuccguagacgggcccugcacccucuuccacaaccgccugaucaucagcgccaccaagcaguccuacggguucaagaugagcugcccccggaagcccgagcccaccgaggaguuccagaucugcaaccgcaaguacaacgugcuguucaccacgaucgacaagaacgacaagaucgagaucaacaccggcgaccagaccuccuacaucuacgagaaggacaaccggugcaagaccuggcucugccgcguccgggacgagggcaucagcgugaucuucgagccccugaaggccuucuucggguccuacuucagcaucaucuucuacguggucgugggcaucaucgugcuguuccucacaaucuacaucuuccugccgauguuuuucaagcugcgcgacauccucaagcgcaacgaguaucuguaccugcaggagcucaagcacaaguga

SEQ ID NO: 15850 - RNA, 4311 nt, Artificial Sequence
  derived and/or modified CDS sequence (opt11) from MAGV(CbaAr 426)__KX100110.1__GP
augaagaugauccugcucaucaucauccugugugugaaccuggccgccgcgaaccccgucgccacccgcugcuuccacggugggcagcucaucgccgagacccggagcgccacguccaucagcgaguucugccugaaggacgacgucuccaugaucaagagcgagaucaccuacaccaagaacgacaccggcaucuucgggcacuccaagaucuacaagagcuggcuaaucaaggacuggaagcucugcaacccggugcccacugccggcggguccaucaacgucaucgaggugaacagcgaccugucccugaccaccaaggcguacgugugcagccgcgacugcaccaucacaaucgauaaagaggaggcccagaucaucuuccagaccgacaagcucaaccacuucgaggucuccggaaccacccugagcuccggcugguucaagacgaaggccagcgugacccuggaccggacuugcgagcacaucaaggugaccugcgggaagaagacgcuccaguuccacgccugcuuccgccaccacauguccugcguccgguucuuucacaacaccauccugcccggcaccauggugaacagcaugugccagaacaucgagcugaucaucauccucgggcugacacugaucaucuucacucucauggugauccugaccaagaccuacaucugcuacauccugaugccccucuucaugccgaucgcguacgccuacggcugggcguacaacaaguccugcaagaagugcaacugcugcgggcuggccuaccaccccuucaccaacugcggcagccacugcgucugcggccugaaguucgaggccuccgaccgcaugcggauccaccgcgagagcgggcucugccagggcuacaagagccugcggaucgcgcgccugcucugcaaguccaaggggagcucccugaucaucagcacgcugcucuccaugcugcugcucagcuucaucacccccaucgagggcaccaugaccaacuaccccgagacgcggcaguacucccuggaggaaaucgccgacgugguggagggccugcucagcgagcagaacaucaaggaguacgucguguucuacaccucccuguucggaagccugauccuccugcuggccuucauccucuccaucacccugaccaaggugacgaacgcccuggcccgcaccaacgucaucuacugcgaggaguguagcauguaccacgcgaagaagggcauaaaguacaacggggacuucaccaacaagugcggauucuguacgugcgacgagcaggaggacgaggaggggaucaucauccacaaggugaguaagaagugcaccuaccgguaccagcuccagugggccaaaaucaucaugaucauccuggugaugcugcucaugaugcagaacaccauccugaucgucgccgccgagaccgacugcuggaccaagaacagccuagagcuggacugcaucggcccgcuccugaccaucuccgacugcagcaacaaggaauccaagaacuacgaggaggaggccgcgaagcuggugagccaguccaagaucacgcaggccgacgccgagcaggucaccauccuuggcaacaccaucgacaccgcacugaaggcaauccgcagccagaagacguaccagaccaugcaccuccucgagagcguguuccugaugaagaacugcgacuacuacuccagcuucgagcacaacaguggguacagccaggcgaaguggcggcugaucgccaagaccucccacuucgacaucugcagccgacacuccaugcaccacuucugccggugcguggccgacggcaccaagugccagaacggggacugggacuucgccggcgagaugaacaacacguacagcaccaagaacgacuucuaccuccacgaccugaaccuguucuucacccuccaugagaccgccuuccccgggacgaccgagucccucuucuaccagcugauugccaagaagaacaccaccggcgccagcaagcuccugggcaagcugaucacgaaguacgggaacuccaagcuguucgucggcaucuggaaguucggucaguaccugcugacccuccccuacgugaacaccaccgagcugagcaagacgcgccgggagaccauccugaagacccaccagauccucacccgcucccagggcgggcggucagaguccaugagcuccgccgaggugggccagaucgccaaggagugcgcgaacgccaagaacgugggcugcaucagcccccgcuucgggaucccgaucgggaaccugacggccugcgggaacagccccaacuacaagauauacaagacacccaacaagaucuacaaguccaacaaccgcggcgaagugugguguagcgaggacgugcacugccuggccgauuucgagcccgccgacaccgaggucgugaacaaggugaagaaaaugaccugcuuccucuccgacgucaauacgcgggcggacauauucagcaucgccaucuccgccugcagaaugguggacaagggcgugugcaccgucaacggggccaaguggaacauccugaagugcgagucaggccuguauuacuucacugaccaccgggaggggcaagacaccggcaacgacuucggggaguacugcaucucccacagcuguaacacggaacgcuacccgaucaacccugacauccucaaggagugcaucugggaguaccacucccgcaagucgaaguacaucuccaccaucaaccuggagagccuggaggaguucaagcgggccaugucggacaagcucagccacacccugaugguguauaacuucaagcccaccgcgaaccuaccccacaucaaaccguccuacaaguuuaucacugccaacggaaucgaaaacagcgacggccuggagucagccuacauccugagcuccauccccgccaucgggggcaugagcaucggguacaacauccagaccaaggacaacuucccccuguuagaccugaucguguucgucaagagcgcggugaucaagaccaccuacaaucacaucuacgacaccggccccacgaucgggaucaacaccaaccacgacgagcacugcaccggcccuugccccaccaucaucccccacaaggagaacuggcugacguucucccaagagcggaccagccgguggggcugcgaggaguuugggugccucgcgaucaacaccggcugcguguucggauccugccaggacgucauccaccccgagaccaagaucuaccggaaggccguggaggaggaggugguccugacggugugcauaaacuucccgggcaacaccuucugcaccgagaucaacgccaucgagccuaagaucaccgaugagaucgagcugcaguucaagacgguggacacaaagacccucccuaaccugcuggccguccagaaccacaagcucuacagcgggcagaucaacgaccugggcuccuucagccagggcugcgggaacgugcagaagaccaaucaguccauccugggcgcggggacggugaaguucgacuacgucugccacggcgccucccgcaaggacaucaucgugcgacgcugcuacaccaacaacuacgacuccugcaagcuccugaaggaggagcggagccugaucuucgccgacaaccaugagacccucgagguggccaacacccgccaccugaucggggagcuacaauucaagaucaugcucggcgacauccgguacaaggccuucgcggagaagccggagcuggagaucgacgccaagugcgucggcugccccuccugcuucgagagcuacuccugcaacuuccaaaucgugacgagcaucgacaccgugugcagcgucgaggggcccugcacccuguuccacaaccgcaucaucaucaccgccgccaagcaaagcuacggcgugaagauguccugcaagacgaaacccgggccgguggaggaguucaccaucugcaaccggaacuaccgcgucagcuucgccaccaucgacaagaacgacaagaucgagaucaacaccggcgaccagacguccuacaucguggaaaaggacagccggugcaagaccuggcucugccgcgugcgcgacgagggcaucagcgucaucuucgagccccugaaggcguucuucggguccuacuucagcauagccuucuacaucaucaucggaaucgcagcccuguuccucauuaucuacaucuuucugcccauguucuucaagcugcgggacgugcucaagaagaacgaguaccuguaccuacaggagcucaagcacaaguga

SEQ ID NO: 15851 - RNA, 4305 nt, Artificial Sequence; identical to SEQ ID NO: 12565
  derived and/or modified CDS sequence (opt11) from MAGV(CoAr 3363)__KX100107.1__GP

SEQ ID NO: 15852 - RNA, 4305 nt, Artificial Sequence; identical to SEQ ID NO: 12566
  derived and/or modified CDS sequence (opt11) from MAGV(OBS 6657)__KX100116.1__GP

SEQ ID NO: 15853 - RNA, 4302 nt, Artificial Sequence; identical to SEQ ID NO: 12567
  derived and/or modified CDS sequence (opt11) from NORV(0234)__EU004188.1__GP

SEQ ID NO: 15854 - RNA, 4305 nt, Artificial Sequence; identical to SEQ ID NO: 12568
  derived and/or modified CDS sequence (opt11) from PLAV(75V3066)__KX100122.1__GP

SEQ ID NO: 15855 - RNA, 4305 nt, Artificial Sequence; identical to SEQ ID NO: 12569
  derived and/or modified CDS sequence (opt11) from PLAV(75V5758)__KX100128.1__GP

SEQ ID NO: 15856 - RNA, 4317 nt, Artificial Sequence; identical to SEQ ID NO: 12570
  derived and/or modified CDS sequence (opt11) from POTV(89-3380)__EU004189.1__GP

SEQ ID NO: 15857 - RNA, 4311 nt, Artificial Sequence; identical to SEQ ID NO: 12571
  derived and/or modified CDS sequence (opt11) from TENV(TSV-FE3-66FB)__FJ943508.1__GP

SEQ ID NO: 15858 - RNA, 4311 nt, Artificial Sequence; identical to SEQ ID NO: 12572
  derived and/or modified CDS sequence (opt11) from TENV(TSV-FL06)__FJ943506.1__GP

SEQ ID NO: 15859 - RNA, 4305 nt, Artificial Sequence
  derived and/or modified CDS sequence (opt11) from TLAV(61D240)__KX100119.1__GP
augcuguuccuccugauccuggccuuccucggcuucagcaccuccaaccccaucgccacccgcugcuuccacgggggccagcugaucgcggagagcaagucagccaccagcaucuccgaguucugcuugaaggacgacgugagcaugcucaaguccgaggucguguacaccaagaacgacaccgggcuguucggccacaacaagguguuccggagcuggaccaucaaggacuggaagcugugcaacccgauccccacagccgggggcaccaucaacgucaucgaggugaacaaggaccucucccugaugaccaagaccuacaucuguagccgcgacugcacgaucaccaucgacaaggaggaggcccagaucaucuuccagaccgacaagcugaaccacuucgagguguccggcaccacucucaacagcgggugguucaaguccaaggccagcgucacccuggaucggaccugcgagcacgugaagguaaccugcggcaagaagucucugcaguuccaugcgugcuucaagcaccacaugagcugcguccgcuucuuccacaacacgauccuccccgggaacaugaucaccuccaugugccagaacaucgagcugaucaucaucuuaggccucacccuggccaucuucauccugauggugaugcucaccaagacguacaucugcuaccugcugaugcccaucuucaugccgaucgcuuaccucuacgggugggccuacaacaagagcugcaagaagugcaacugcuguggccuggcguaccaccccuucacgaacugcggcucccacugcgugugcgggcugaaguucgaggccucugaccggaugcgcauccaccgggagagcggccucugccagggguacaagucccugcgcaucgcccggcugcucugcaagucgaagggcuccagccuggucaucuccggccugcucagcaugcugauacuguccuucgucacccccaucgaagggaccaucacgagcuaccccgagucccgcaaguacacccucgaggagaucaccgacgucgucgagggccuggugagcgagcagaauaucaaggaauacaucguguucuacaccucccuguucggaagccucauccugcugcucgccuucaucauguccaucacgcugagcaagaucacauccauccuggcccggcgcaacgucaucuacugcgaggagugcagcauguaccacuccaagcguggcaucaaauacaacggggacuucaccaacaagugcggcuucugcacuugcaacgagcaggaggacgcggagggccucgugauccacaaggugagcaagcgcugcaccuacaaguaccagcugaagugggccaagguccugauggugaccuuagugcugcugcugaucgcccagaacaccauccucaucgucgccgccgggaccgacugcuggacgaagaagucccucgacaucgacugcaucggcccgaugcuggacaucgguagcugcaccaacaagaacacccgaaacuacgacaccgaggcgcagaaacucgugagccagucuaaggucagccagcuggacgccgaccaggccuccuugcucggcaacagcaucgacuccgccaucaaggccauccgcgcgcagaagaccuaccccacgaugcaccuccuggagaccaucuuccucaugaagaacugcgacuacuacaccagcuucaaccacaacuccggguacagccaggccaaguggcggcugaucgccaagaccggccacuucgacaucugcucccgccacagcacgcaccacuucugccggugcaucaacgacggcaccaagugccagaauggggacugggacuucgccggcgagaugaacgagaccuacaacuccaagaacgacuucuacagccacgaccugaaccucuucuacaccaucuucgagaacgccuuccccgggacgaccgagucccuguucuaccagcugauucagaagaagaacaccaccggcgccagcaagauccucgggaagcugaucacgaaguacggcaacaagaacauguucgugggcgucuggaaguucgggcaguaccugcucacccugcccuacaucaacaacaccgagcugucccagaaucgccggcagaccauccucgccacgcaggagagccuuucccgcucucacagcggucgccaggaaagcaugagcuccgccauccagggcagcgucaccaaggagugccacaacgccaaggacgugggcugcauauccccgcgguucggcauacccaucgggaaccugaccgcgugcggcgacagccccaacuacaagaucuacaagacccccgagaagcuguacaaguccaacaacaagggggaaguguggugcagcaacgacguccacugccugaacgacuucgagccagccgacgaggagguggucaacaaggucaagaagcugacgugcuuccucaccgacguguccgugaagaccgacaucuuuagcgucgccgccuccacgugcaagauggccgacaagggcgugugcaccgugaacgacgcgaaguggaacaucaucaagugcgacagcggguuguacuacuucaccgaccaccgcgagggccaggacaccggcaacgacuucggggaguacugcaucucccacagcugcaacaccgagcgguuccccaucaaccccgacauccugaaggacugcacgugggaguuucacucccgcaagagcaaguacaucuccaccaucagcuuagagucccuggaggaguuccggcgcgccaugaccgagaagcugagccacacccucacgaucuacaacuucaagcccaccgccaaccugccgcacauccggcccaccuacaaguucaucaccgccaacggcgucgagaacagcgacgggauagaguccgccuacauccugagcuccauccccgcgcucggcgggaucagcgugggguacaacgugcagacgaaggacaacuucccccugcuggacaucaucgucuucaucaaguccgccgugauccgcaccaccuauaaccacaucuacgacaccggcccgaccaucgggaucaacacgcagcacgacgagcacugcaccggcccaugccccgccguggucccucacaaggagaacuggaucaccuucagccaggagcggaccucccgcuggggcugcgaggaguucggcugccucgccaucaacacggggugcguguucggaagcugccaggacaucauccacccggagaccaagguguaccggaaggccgucgaggaggaggugauccugaccgugugcaucaacuuccccggcaacaacuacugcaccgagaucaacgcgauagagcccaagaucacggacgagaucgaguugcaguucaagaccgucgacaccaagacccucccgaaccuacuggccgugcagaaccacaagcucuacuccgggcagaucaacgaccuggguagcuucucccaggggugcggcaacgugcagaagacgaaccacagcauccuggggaugggcaccgccaaguuugacuacgucugccacggcgccucccgcaaggacgugaucgugcggcgcugcuacaacaacaacuucgacagcuguaaacucuugaaggaggagaccucccugaucuucgcggauaaccacgagacccucgaggucgcccacacgaagcaccugaucggcgagcugcaguucaagaucaugcucggcgacauccgguacaagagcuucgccgagucccccgagcuggagaucgacgccaagugcguggggugccccagcugcuuugagucguacagcugcaacuuccagaucgugaccaacaucgacaccgucugcagcguggagggccccugcaccuuguuccacaaccgcauaaucaucuccgccaauaagcagagcuacggccucaagauguccugccagacgaagccgaaccagaacgaggaguucaucaucugcaaccggaaguacagcguucuguucaccaccaucgacaagaacgacaagaucgaagucaacaccggggaccagacguccuacaucuacgagaaggacagccgcugcaagaccuggcugugccgggugcgcgacgaaggcaucuccgugcuguucgagccacugaaggcguuuuucgggagcuacuucuccaucaucuucuacgucguggugggcauuaucguccuguucuuaaucaucuacaucuuccugcccauguucuucaagcugaaggacgugcucaagcgcaacgaguaccuguaccugcaggagcucaagcacaaguga

SEQ ID NO: 15860 - RNA, 4305 nt, Artificial Sequence
  derived and/or modified CDS sequence (opt11) from NRIV(9800535)__AY593725.1__GP
augcuguuacugcuggugcuccugauccccugcuacgucagcgccuccccgguggugacccgcugcuuccacggcgggcagcugaucgccgagaagaagucccagaccgcggucuccgaguucugccucaaggaugacgucagcacaaucaaaucggagaucacguacgagaagaacaacaccggacuguucgcccacagcaaggugcugcggaacuggauaaucaaggacuggaagaauugcaaccccguccccaccgccgggggcuccaucaacgucaucgaggugaacacggaccucagccugaccaccaagacuuacgucugcucccgcgacugcacgaucaccguggacaaggaggacgcccagaucaucuuucaaaccgagaagcugaaccacuucgaagugagcgggaccacgcuauccagcggcugguucaagaccaaagccuccgucacccuggaccggaccugcgagcacaucaaggugacgugugggaagaagacccugcaguuccacgccugcuucaagcaccacaugagcugcauccgcuuuuuccacgggaccauccuccccgggacgauggccacguccaucugccagaacaucgagcugaucaucaucaucagccugacccucaucaucuucauccugaugaucauccugacuaaaaccuacaucugcuaccucuuaaugccgcuguucaugccaaucgccuacuucuacgggugguccuacaacaagagcugcaagaagugcagcugcugcggccuugccuaccaccccuucacgaacugcgggagccacugcguguguggccucaaguucgaggcgagcgaccggaugcgcauccaucgggaguccggccugugccagggguacaagagccuccgcgucgcccggcugcugugcaaguccaagggcagcucccucgugaucuccauccugcuguccaugcucauccugagcuucgugacccccaucgaggggacccugaccaacuacccggagucccgaaaguacgaccucgaggagauugccgauguccuggagggcuucaucguggaaaagggcaucaaggaauauguggucuucuacacaagcaucuucggggcucugcuccugcugaucgcccucgugauuacaaucacccugaacaaggugaccgaauaccugacgaacaucaacguucucuacugcuacgagugcuccauguaucacagcaagaagaacaucaaguacaucggcgacuuuaccaacaagugcggguucugcacgugcggcgagcuggaggaccaggaggggcugaagauccacaaggugucccgaaagugcaucuacaaguaccagcucaccuggagcaagaucaucaugaccauccugguuugucuguugaucgcgcagaacacaauucucaucguggccgccagugacgacugcuggaccaagaagucgcuggagauggagugcaucggcccccugcagcaggucgacacgugcgacgacaaggcuucgcgcagcuacuccggugaggcccgaaagcucgugagagcgagcaagaucagcgaccuggacgccgcccaggucggguugcucggcuccaccaucgagagcgccaucgccuccaucagaaaacagcgcaccuaccccaccaugcaccuucuggagagcguauuccucgggaagcacugugacuacuacaagaccuucgagcacaacuccggcuacagccaggcuaaguggcggcugaccgccaaaacgcaccauuucgacaucugcucccgccauagcacccaccacuucugccggugcaucuccgacgggaccaagugccagaacggcgaccuggacuucgcaggggagaugaacagcaccuaccaguccaagaaggacuucuucgagcacgacuucaagcuguuuugcacccuagucgagaacgccuuccccgggacaaccgagagccuguucuacgagaugcugaguaagaagaacaccacgggcaucaagcagcugcuggacaagcucacacgcaaguucgggaacaacaacauguucgugggcaucuggaaguucgggcaguaccugaugagccugccuuacaucaacgaaaccuccuugacccccgcccagaucagcaagauccuggaggugacggaccagcaccaccgguccaucagcggccgccaggagagccuggcguccgccaccccaggcagcaaguccaaggaaugcgggcaugccaaaaaggucagcugcaucagcccccguuucagcguuccgauggagggccucauggcgugcggggacagccccaacuacaagaucuacaagacacccaccaagcuguacaagucgaacaacaagggcgagguguggugcuccggcgauguccacugcagccaggagcugucccccgcgucacaggaguccguggaccggaucaagcagaucacuugcuuccucaccgagccggaggugucugacgacgucuucucaaucgccaucagcacuugcaagguucaagacaaggggguaugcaccgucaacgaggaccgcuggaacgugaucaagugcgacuccggccuaaucuacuacaccgaccagcgggacggacaggacaccggcaacgacuucggcgaguacugccugagccacucuugccgcaucgagcgguuccccaucaaucccgccaucauccgcgacugccucugggaguaccacagccgcaagucaaaguacaucaccucccuggaccuagagaaccucgaagaguucaagcgggcuaucagcgagaagcugagccacacccugaucguguacaacuucaagccgacugccaaccucccgcacaucaagcccgucuacaaguacauaaccgugcagggcguggaaaacagcgacggcguggacuccgccuacauugccgccagcaugcccgcccuaagcgggacgagcaucggcuacaacaucauguccagggacaauuucccccuauucgacaucaucaucuucaucaagucagccauaauaaaagcgaccuacaaccacaucuacgacacggggccgaccaucggcauuaaugugaugcacgacgagcacugcaccgggcagugcccgaccgacaucccccacaaggaaaacuggaucacguucgcccaggagcgaaccucccgguggggcugcgaggaguucgguugccucgccgugaacaccgggugugucuucggcagcugccaggacaucauucgccccgagaccaagguguaccggaaggccguggaggaguccguccuccugaccgugugcaucacguaccccgggaagaccuucugcacugagaucaacgccaucgaacccaaaaucaccgaugagcuugaguugcaguucaagacgguggacaccaagacccugcccaacauccucgcgguccaaaaccacaaacuguauagcggccagaucaacgaccugggauccuucagccagggcugcggcaacauacagcgcaccaacuccagcaucaucgggacgggcaccgccaaguuugacuacgugugccacggggccucccggaaggacaucaucgugcgccggugcuacaacaacaacuacgagagcuguaagcuccugaaggaggagcagagccugauguucgccgacaaccacgagaccaucgacgucgcgaacgugcgccaccuccugggcgaccugcaguucaagcucaugcugggcgaccugcgguacaaauccuucgccgagaauccggaccucgagaucgaggccaagugcgugggcugccccuccugcuucaccuccuacagcuguuccuucaagaucgccagcaauaucgacacggucugcucaaucgagggccccugcaccaccuuccacaaccgccugaugaucaccagcacgaagcaggacuacggcaucaagaugucuugcaagaccaagcccaaggagaccgaggaguuccagaucugcaagaagacuuacacggugcuguucaccaccguugagaagaacgacaagaucgagaucucaaccggcgaccagacguccuucauccaggagcgcgaugaccggugcaagaccuggcucugccgcguccgggacgaggggaucagcguuaucuucgaaccaauccgcgccuucuucgguuccuacuucagcaucgcguucuacguggucaucuccaucaucgugcuguuccuggccaucuacaucuucuuacccaugguguucaaacugcgggacguccugaagcgcaacgaguaccucuaccugcaggagaucaagcacaaguga

SEQ ID NO: 15861 - RNA, 4305 nt, Artificial Sequence; identical to SEQ ID NO: 12575
  derived and/or modified CDS sequence (opt11) from NRIV(GSA/TS7/5170/WT)__KM514677.1__GP

SEQ ID NO: 15862 - RNA, 4305 nt, Artificial Sequence; identical to SEQ ID NO: 12576
  derived and/or modified CDS sequence (opt11) from NRIV(TND/S1/19801/WT)__KM514679.1__GP

SEQ ID NO: 15863 - RNA, 4305 nt, Artificial Sequence; identical to SEQ ID NO: 12577
  derived and/or modified CDS sequence (opt11) from NRIV(9800521)__JX857326.1__GP

SEQ ID NO: 15864 - RNA, 4305 nt, Artificial Sequence
  derived and/or modified CDS sequence (opt11) from NRIV(Adrar)__KJ716849.1__GP
augcugcuccugcuggugcuccugauccccugcuacgucagcgccuccccgguggugacccgcugcuuccacgguggucagcugaucgccgagaagaagucccaaaccgccgucuccgaguucugccucaaggacgacgugagcacgaucaaguccgagaucaccuacgagaagaacaacaccggccuguucgcccacagcaaggugcugcgcaacuggauuaucaaggacuggaagaacugcaaccccguccccaccgccgggggcuccaucaacguuaucgaggugaacacggaccucagccugaccaccaagaccuacgucugcucccgcgacugcacgaucaccguggacaaggaggacgcacagaucaucuuucagaccgagaagcugaaccacuucgaggugagugggaccacgcucuccagcggcugguucaagaccaaggccuccgucacccuggaccggaccugcgagcacaucaaggugacgugcggcaagaagacccugcaguuccacgcgugcuuuaagcaccacaugagcugcauccgcuucuuccacgggaccauccuccccggcaccauggccacguccaucugccagaauaucgagcugaucaucaucaucagccugacccucaucaucuucaucuugauggugauccugaccaagacguacaucugcuaccuccugaugccgcuguucaugcccauagccuacuucuacgggugguccuacaacaagagcugcaagaagugcuccugcugcggccucgccuaccaccccuucacuaacugugggagccacugcgucugcggccugaaguucgaggcgagcgaccggaugcgcauccaccgggaguccggccugugccagggguacaagagccuccgcguggcccggcugcugugcaaguccaagggcagcucccuagugaucagcauccugcuguccaugcucauccugagcuucgucaccccuaucgaggggacccugaccaacuacccggagucccgcaaguaugaccucgaggaaaucgccgacgugcuggagggcuucaucguggagaagggcaucaaggaguacgucguguucuacacgagcaucuucggggcccugcuccugcugauggcccucguaaucaccaucacccugaacaaggucaccgaauaccugacgaacaucaacgugcucuacugccacgagugcuccauguaccacucaaagaagaacaucaaguacaucggcgacuucaccaacaagugcggguucugcacgugcggcgagcuggaggaccaggaggggcugaagauccacaaggucucccggaagugcaucuauaaguaccagcucaccuggagcaagaucaucaugaccauccuggugugccugcugaucgcucagaacaccauccucaucguggccgccuccgaugacugcuggacgaagaagucccuggagauggagugcauuggaccccugcagcaggucgacacgugcgacgacaaggccagccgcagcuacucaggcgaggccaaaaagcucgugcgggcgucuaaaaucagcgaccuggacgccgcccaggugggacugcucggcuccaccaucgagagcgccaucgcuuccauucgcaagcagcggaccuaucccaccaugcaccuccuggagagcgucuuccuggggaagcacugcgacuauuacaagacuuucgagcacaacaguggcuacagccaggcgaaguggcgccugaccgccaagacgcaucacuucgacaucugcucccggcacagcacccaccacuucugccgcugcaucuccgacgggaccaagugccagaacggcgauugggacuucgccggcgagaugaacagcaccuaccaguccaagaaggacuucuuugagcacgacuucaaacuauucugcacgcucguggagaacgccuuccccgggaccaccgagagccuguucuacgagaugcugaguaagaagaacaccacgggcaucaagaagcuccuggacaaacuuacccggaaguucgggaacaacaacauguucgugggcaucuggaaguucgggcaguaccucaucagccugccguacgucaacgagaccucccugacccccgcccaagugagcaagauccucgaggugacggaccaacaccaccgcuccaucagcggccggcaggagagccuggcguccgccacccccggcagcaaguccaaggagugcgggcacgccaagaaggucagcugcaucagcccccgcuucagcgugccgauggagggccugauggccugcggggacucccccaacuacaagaucuacaagacccccgcgaagcucuacaaaagcaacaacaagggcgagguguggugcuccggcgacguccacugcagccaggagcugucccccgccagccaggaguccguggaccgcaucaagcagaucacgugcuuccugaccgagcccgaggugagcgacgacgucuucuccaucgccaucagcacgugcaaggugcaggacaagggggugugcaccgucaacgaggaccgguggaacgugaucaagugcgacuccggccucaucuacuauaccgaccagcgcgaagggcaggacaccggcaacgacuucggggaguacugccugagccacuccugccggaucgagcgcuuccccauuaaccccgccaucauuagcgauugccugugggaguaccacagcaggaaguccaaguacaucacaagccucgaccuggaaaaccuggaggaguucaagcgcgccaucuccgagaagcucagccacacacugaucguguacaacuuuaagcccaccgcgaaccugccgcacaucaagccaaucuacaaguacaucacgguccagggcguggagaacagcgacggcguggacagcgccuacaucgccgccuccaugcccgcccucagcgggaccuccaucggcuacaacaucaugagccgggacaacuucccccuguucgacaucaucaucuucaucaaguccgcgaucaucaaggccaccuacaaccacaucuacgacaccgggccgacgaucggcaucaacgucaugcacgacgagcacugcaccgggcagugccccaccgacaucccccacaaggagaacuggaucaccuucgcccaggagcgcacgucacgguggggcugcgaggaguucggcugccuggccgugaacaccgggugcguguucggcuccugccaggacaucauccgcagcgagaccaaggucuaccggaaggccgucgaggaguccgugcuucugaccgucugcaucaccuacccggggaaaacguucugcaccgagaucaacgcgaucgagcccaagauuaccgaugagcuggagcuccaguucaagaccguggacacgaagacccugcccaacauccuggccgugcagaaccacaagcucuacagcggccagaucaacgaccugggguccuucagccagggcugcggcaacauccagaagaccaaccuguccaucaucgggaccggcacggccaaguucgacuacgucugccacggggccagccgcaaggacaucaucgugcggcgcugcuacaacaacaacuacgagagcugcaaacuccugaaggaggagcagucccugauguucgcggacaaccacgagaccaucgacguggccaacguccggcaccuccugggcgaccugcaguucaagcucaugcugggggaucugcgcuacaagagcuuugccgagaaccccgaccucgagaucgaggccaagugcgugggcugcccguccugcuucaccagcuacuccugcagcuucaagaucgccuccaacaucgacaccgucugcagcaucgagggccccugcacgaccuuccacaaccggcugaugaucaccuccaccaagcaggacuacgggaucaagaugagcuguaagacgaagcccaaggagaccgaggaguuccagaucugcaagaagaccuacaccguccuguucacgaccguggagaagaacgacaagaucgagaucuccaccggcgaccagacuagcuucauccaggagaaggacgaccgcugcaagaccuggcucugccgggugcgcgacgagggcaucuccgucaucuucgagccgauccgcgcguucuucggcagcuacuucuccaucgccuucuacguggugaucagcaucaucguccuguuccuggccaucuacaucuucuuaccgaugguguucaagcugcgggacgugcugaagcguaacgaguaccucuaccugcaggagaucaagcacaaguga

SEQ ID NO: 15865 - RNA, 4305 nt, Artificial Sequence
  derived and/or modified CDS sequence (opt11) from NRIV(DakArD28542)__JX857317.1__GP
augcuguuacugcugguacuauuaauccccugcuacgucagcgccuccccggugguuaccagaugcuuccacggcggacagcugaucgccgagaagaagucccagaccgcggucuccgaguucugccucaaggacgacgugagcacgaucaaguccgagaucaccuacgagaagaacaacaccggccuguucgcucacagcaagguguugcggaacuggaucaucaaggacuggaagaacuguaaccccguccccaccgccgggggcuccaucaacgugaucgaagugaacacggaccucagccuaacaaccaaaaccuacguaugcucccgugacugcacgaucaccguggacaaggaggacgcccagaucaucuuccagaccgagaagcucaaccacuucgaggugagcgggaccacgcucuccagcggcugguucaagaccaaggccuccguaacccuggaccggaccugcgagcacaucaaggugaccugcggcaagaaaacccuucaguuccacgcgugcuucaagcaucacaugagcugcauccgcuucuuccacgggaccauccuccccggcaccauggccacguccaucugccagaacaucgagcugaucaucaucaucagccugacccucaucaucuucauccucauggugauccugaccaagaccuacaucugcuaccuccugaugccgcuguucaugcccaucgccuauuucuacgggugguccuacaacaagagcugcaagaagugcuccugcugcggccucgccuaccaccccuucacuaacugcgggagccacugcgucugcggccugaaguucgaggcuagcgaccggaugcgcauccaucgggaguccggccugugccagggguacaagagccuccgcguagcccggcugcugugcaaguccaagggcagcucccucaucaucagcauccugcuguccaugcucauccugagcuucgugacccccaucgaggggaccuugaccaacuacccggagucccgcaaguacgaccucgaggagaucgccgacguccuggagggcuucaucguggagaagggcaucaaggaguacguggucuucuacacgagcaucuucggggcgcuguuccuccugauggcccuggugaucaccaucacccucaacaaggugaccgaguaccugacgaacaucaacguccuguacugccacgagugcuccauguaccacagcaagaagaacaucaaauacaucggcgacuucacaaacaaguguggguucugcacgugcggcgagcucgaggaccaggaggggcugaagauccacaaggugagccggaagugcaucuacaaguaccagcugaccuggagcaagaucaucaugaccauccucgucugccugcugaucgcgcagaacaccauccugauaguggccgccuccgacgacugcuggaccaagaagucccucgagauggaaugcaucggcccccugcagcaggucgacacgugcgacgacaaggccagccgcagcuacuccggcgaagccaaaaagcugguccgggcgaguaagaucagcgaccucgacgccgcccagguggggcugcuggggcccaccaucgaguccgccaucgccagcauccgcaagcagcggaccuacuccaccaugcaucugcuggagagcguguuccuggggaagcacugcgacuacuacaagaccuucgagcacaacuccggcuacagucaggcgaaguggcgucucaccgcgaagacgcaccacuucgacaucugcucccggcacagcacccaccauuucugccgcugcauauccgacgggaccaagugccagaacggcgacugggacuucgccggcgagaugaacagcaccuaccaguccaagaaggacuucuucgagcacgaccugaagcuguucugcacgcucgucgagaacgccuuccccgggaccacggagagccuguucuacgagaugcuguccaagaagaacaccacgggcgugaagaagcuccuggacaagcugacccggaaauucgggaacaacaacauguucgugggcaucuggaaguucgggcaguaccucaugagccugccguacgucaacgagaccucccugacccccgcccagguggcgaagauccucgaggugacggaccagcaccaccgcagcaucuccggccggcaggagagccuggccagcgcaacccccggcuccaagagcaaggagugcucccacgccaagaaggucagcugcaucagcccccgcuucagcgugccgauggaggggcugauggcgugcggcgauuccccgaacuacaagaucuacaagacccccgccaagcucuacaagagcaacaacaagggagagguguggugcuccggcgacguccacugcagccaggagcugucccccgccagccaggaguccguggaccguaucaagcagaucacgugcuuccugaccgagccggaggugagcgacgacgucuucuccaucgccaucagcacguguaaggugcaggacaagggggugugcaccgucaacgaggaccgguggaacgucaucaagugcgacuccggacucaucuacuacaccgaccagcgcgacggccaggacaccgggaacgacuucggcgaguacugccugagccacuccugccggauugagcgcuuccccaucaaccccgcaaucaucagcgacugccugugggaguaccacucccggaaguccaaguacaucaccagccucgaccuggagaaucuggaggaguucaagcgcgcgaucuccgagaagcucagccacacccugaucguguacaacuucaagcccaccgccaaucucccgcacaucaagccggucuacaaguacaucacggugcaggggguggagaacuccgacggcgucgacagcgccuacaucgccgccuccaugcccgcgcucagcggcaccuccaucggguacaacaucaugagccgggacaacuucccccuguucgacaucaucaucuucaucaaguccgccaucaucaaggccaccuauaaccacauauacgacaccggcccgacgaucgggaucaacgugaugcacgacgagcauugcaccggccagugccccaccgacaucccccacaaggagaacuggaucaccuucgcccaggagcgcacgagccggugggggugcgaggaguucggcugccuggccgugaacaccggcugcgucuucggguccugccaggauaucauccgcccggagaccaagguguaccggaaggcgguggaagagagcguccuccuaaccgugugcaucaccuaccccggcaagacguucugcaccgagaucaacgcuaucgagcccaagaucaccgacgagcuggagcuccaguucaagaccguggacacgaaaacccugcccaauauccuggccguccagaaccacaagcucuacuccgggcagaucaacgaccugggcagcuucucccaagggugcggcaacauccagaagaccaacagcucgaucaucggcaccgggacggccaaguucgacuacgugugucacggcgcgagccgcaaggacaucaucgugcgccgcugcuacaacaacaacuacgagucgugcaagcugcucaaggaggagcagucgcugauguucgccgacaaccacgagacgaucgacgucgccaacgugcggcaccuccucggcgaccugcaguucaagcugaugcucggcgaccugcgcuacaagagcuucgccgaaaacccggaccuggaaaucgaggccaagugcguggggugccccuccugcuucaccagcuacuccugcagcuucaagaucgcguccaacaucgacacagucugcagcaucgagggccccugcacgaccuuccacaaucggcucaugaucaccuccaccaagcaggacuacggcaucaagaugaguugcaagacgaaacccaaggagaccgaagaguuccagaucugcaagaagaccuacaccgugcuguucacgaccguggagaagaacgacaagaucgagauauccaccggggaccagaccagcuucauccaggagcgggacgaccggugcaagacguggcugugccgcguccgcgacgagggcaucuccgugauuuucgagccgauccgggccuucuucgggagcuacuucuccaucgccuucuacguggucgugagcaucaucgugcuguuccuggccaucuacaucuuccugcccauggucuucaagcuccgcgacgugcugaagcggaacgaguaccuguaccuccaggagaucaagcacaaguga

SEQ ID NO: 15866 - RNA, 4305 nt, Artificial Sequence; identical to SEQ ID NO: 12580
  derived and/or modified CDS sequence (opt11) from NRIV(SUD-HKV141)__JX857323.1__GP

SEQ ID NO: 15867 - RNA, 4305 nt, Artificial Sequence; identical to SEQ ID NO: 12581
  derived and/or modified CDS sequence (opt11) from NRIV(SUD-HKV66)__JX857320.1__GP

SEQ ID NO: 15868 - RNA, 4344 nt, Artificial Sequence
  derived and/or modified CDS sequence (opt11) from BWAV(M459)__NC_034490.1__GP
auggccauguucgagcugaucgugcuccuggccuucagcuacgucaccggcgugccccaggagcugacccgcugcuucaccgggggcuccgugguccggcagcacuggagcaagaacgcgaucagugagcucugccugaaggacgacgugagcaucaucaaguccgagaucgaguacaagaagaacgagaccgggaccuucgcccugagcaagaucuaccgcaaguggaucaccacggacugggagaagugccagccgcagaaguccaccggcgggcacaucagcgugcuugagguccggcacgaccugacccuggccuccgccaccuacaucugcggcaaccccugcaccaucaacguggaccgcgagauggcccaggugcaucuccagaccgagggcgucaaccacuucgagaucagcgggaccaccaucaaguccggcugguuuaagacgaccaccuacaucacccuggaccagacgugcgagcaucugaaggugagcugcgggaagcagucagugcaguuccacgcaugcuucaagcagcacauggccugcguccgguuccuccaccgcaccauccugcccggcaacauggccaacagcaucugccagaacaucgagaucaucauccugcucgcccugacccuguccaucuucauccuccuguguauccugacaaagacguacaucugcuacauccuccugcccauuuucaucccgaucagcuacaucuacggguauuucuacaaccgguccugcaagaaaugcagccagugcggccugguguaccaccccuucaccgagugcggccgcaacugcgugugcggggcgcgguacgacacguccgagcgcaugaagcuccaccggcugagcggccugugccccggguacaagagccucaaagccgcccgcguccuguguaaguccaagggcagcgccuccauccugagcauccucaucucccugcugauccucaccuucgugacgcccaucaacggccugaugcugaaggacaccgacauuacaaaccucaagaucgacacccugccugacgacaugcuggagcucauccauaacguggacuaccugaagcugauccucgagaucaacaucacgaucuucggguucauccugaucauaauccuguucaugcuccugauguucuaccgguaccaacacaucuucaucagcaucuacgucaucgacugcaaggagugcaacauguaccacuccaagagcggccugagauacaacggggacuucaccaacaagugcaugaccugcacgugcggcgagguggacgacauggaggggcucaacaagcacaagaagcgguacaacugccugaucaaguacaagacgaccauccugcagcacuucuuccuguccauccucgugugccugauccugaaggagagcguccucuucgccgcggcccagucugaggagaucaucaagugccuggagcaggagagccugaccuccaagugcaccggcccccuccugaagacgccccagugcaccgagcagcagaagaaccuacucuucaucgagaucgccaagcagauggagaaggacaacaucaucaccagccuggacaacgcccugaucgccaagcuccccaacgagaucgcggguuccauggcuauccuggacaccaagaaguacuaccacgagcagaucacccuggaguacgccauacucagcaaguacugcgacuacuacaagaaguacgaggggaauacgggcuacucccagaccaccuggcgcaccuaccugcggagccaagaccuggagaucugccucauccugccguaccaguucuucugccgcugcuuuaaguccgggacaggcugcaucgacaccaagauggagauaaaaagcaccauggacaccuacuacagcucccaccagacgaaguucgacagcgaccugaacuacaugcuccacgugauccaccuggccuuccggggguccgccaccagcuacaucgcgaagugccugaucgagaagaacuacaccgagaccaucuccuaccucacgaagauccaggagaaguaccccaacaaccagcugcugaagguggccaucuucuucaccaaccaccuccugaaccagagccuggucgagaacuucgagguguccaccgaguggagccgcuacaagcacuccaccgcccagcccgaacacgaguggaagaagggcagcgagcucaagaugcucgaccccaacaaacugaagacgggcccggccauccagaccugccuccacaucaaggaccugcacugcaucagcccccggagcagggccccuacauccggcaucaucacgugcggccugaacgaccaggcgugcgucuaccgcaaacccgacaagaagaucuacgccagccacaugacccagcacggguucugcgugauggauggccacugccucaagccguucgagcccaucuccggggagaugcugcagaucaucaagaaguccaagugcuggaccgaggauaucgaggaucugaucaccgagggccaggacaagggccggaucuccugccagcccaucgacguggggaacugcaacgucagcggcaaccucuggaccaucacacugugcagcgacaaaaaguucuacuacaccgacaacaagcacgugcacgacaacuccaaggacaucggguacuacugcauggaggagaacugcaagaucccccgcuucccgauccaccccgacuucgugaaggacugugagugggaccugaaccacaucaagaucgaccaccucaagcagaucaacaucgaggacaucaacagcuacaagaagauccugaccgagaagcugaccacggcccucaacuccuucaaauacaagggcaacgagaaccugccccacagcauccccaaguacaaguacaucaccauccaggguacccagaccaucgacgggaucgagaacgccuucaucgaggucgagaucccggcgcuguccggcagcgccacgggguucaagaucuccagccgggacggcaucgagcuguucgacgccauucuguacguuaagcaggccuccuucagcuccguguacaagaagcuguacgucaccgggcccaccaucggcaucaacaccaagcaugacgagcgcugcacgggcgccugccccaugacccucccgcacagcuacggguggcugaccuucuccaaggagcggaccagccaguggggcugcgaggaguacgggugccuggcgaucuccgacggcugcguguucgggagcugccaggacaucaucaaggacgaccucaccaucuaucgcaaggagacggaggagcugucccuggccgagaucugcaucaccuucaugcacaacaccuucugcaccagcaucgacucaacgacccccaccaucaccgacauucucgaggcccaguucaagacuguggagagcuucaagcugcccaacaccgucggccugaagaugcacaagcucuacaucggcaccaucaacgacaucgggguguacaaaaaggccugcggcaacgugcaaaaguacaauaacaccauccuggggagcggcucccccaaguucgacuacgucugccaccuggccaagcggaaggacgugauccuccgcaagugcuucgacaacgacuacaacagcugcaagcugcugaagguagcgaacgacuuacggaucgaggaggacggggagaagcugaaggucaucaacuacaagaaggugaugggcacgcugaaguucaaggccaucuucggcgacaucaaguacaaaucauucacccaggacguggacaucgacgccgaagcgaccugcgucgggugccucaacugcuucgagaacaucaacugcgagaucaaggugcagagcccgcuggagaccacgugcgagguggagagcagcugcgaccuguucaccacccgcauccucuuccaccaggacauccacaaguacgcccugaagcugaucugcuccaaggaggccagcuccaaguucuggauccgguucugcaacaaggagaucaaaagcucgaucagccucaucaacgccgcccccauccuggagcuggcccccaucgaccagaccuccuacgucaaggaggaggacgagcgcugcggcacauggaugugccggguggcgcaggagggaaucggcgugaucuucgagcccuucaagaaucucuucgggagcuaccugggcaucuucuacaucaucaucaucgucaucauccugcucgugcuguucguguacaucuuccugccgaugauccucaagcugaaggagauccugcaaaagaacgagguagccuaccagcgcgacaugaagauacgguga

SEQ ID NO: 15869 - RNA, 4344 nt, Artificial Sequence; identical to SEQ ID NO: 12583
  derived and/or modified CDS sequence (opt11) from BWAV(UgAr1888)__KJ867186.1__GP

SEQ ID NO: 15870 - RNA, 4332 nt, Artificial Sequence
  derived and/or modified CDS sequence (opt11) from BWAV/PGAV(SAAr1)__KJ867177.1__GP
augaucugcaucugcaucuucguggccaucuuccccgccaucuacgcuauaccggacagcuacucccgcugcuucaccggcgggaccguagugaaggagauguggagcaaggaugccgugacggagcugugcaucaaagaugacgucuccaucgucaagaccgagaccagcuacaagaagaacgggaccgggacguucgcccucaacaaggugacacggaaguggcugaugaccgacugggagaagugcaagccccagaaguccagcuccggacacaucaacgucaucgaggugcgcgacgaccugacccucgccacgagcaccuacaucugcuccagcuccugcaccaucaacguggaccgggagaccgcccagauccagcugaacacggacagcaucaaccacuucgagaucgcggggaccaccaucaagaccggcugguucaaguccacgacccuggucgcccucgaccagaccugcgagcaccugaaggugagcugcggcaagcaguccgugcaguuccacgccugcuucaaccagcacaugagcugcguucguuuccugcaccggaccauccuccccgggaacauggcaaaguccaucugccaaaacaucgagaucaucauccuggugggucugaucauccucaucuuccugcugcucugcauccugacgaagaccuacaucugcuacauccuucuccccaucuucaucccgcugagcuacgcguacggguacuucuacaacaaggccugcaagaagugcucccagugcggccuggucuaccaccccuucaccgagugcgggagcaacugcgucugcggagcccgcuacgacaccagcgagcggaugaagcuccaccgcaucuccggccugugccccggguacaagucucugcggacggcccgcgugcucugcaaguccaagggcagcgccuccauccugagcauccugaucuccauccucauacugauguucgugacccccaucaacggguacaugaucaccaacgaguucgacgagggcaagcugaccgucgacagccugccggacgacaugcuguccaugaucagucgucuguccgcgcuccaguucaucuucacucugaacaucgccuguagcguucuggugacccuccugaccugccuguuccucaucaucuucuaccgcuuccagcaccgguuccuguccaaguacgccaucaacugcaccgagugcgacauguaccaccagaagaagggccugaucuauaauggggacuucaccaacaagugcaugaccugcacgugcggcgaggucaacgacauggaggggcucaacaagcacaagaagcgcuacaacugccugaucaaguacaaggccgccugguuccugaaccucaccaucaccaucaucugccugaugcugaucaaggacggcagcaugauggcggccgccgagaccaacaucgagaccugcauggccaagcccucccucacaaccgacugcacggggcccuuccugaagaucaccaagugcgacgaaagucagaaggcccugcccuuccaggagaucgcgaagcagcuggugaaguccaacguccucacccugcuggacaagcacaucgucgagaagcucccgaacgagaucgccggcagccuguccauccuagacaagaagcagcacuaccacgagcaacuggcaguggaguacgggauccugagcaaguacugcgacuacuacgagcuguacaagagcaacuccggguacagccaguccaccuggggcacguaccuccggagccacgacuucgagaucugcuuacugcuccccuaccaauacgucugccgcugcuucaaguccgggaccggcugcaccgacaccaaguucgaguucgagcagaagaugaacgagacguacaacagcaagaacgacauguacaacuccgacuucacccuggcccugaccgucuugcaccuggccaugcgggggaccgcgagcacguacaucaucgacaacgugcugcagaagaacuacuccaacgucaucgaguaccucaacaccaccaagaacaacuuuaagagcaaccaaguguucggugugcuggucgacuucaccaucuaccugcuccgccacgccuccuacgccaaguacaaccugccacagagccugaagaaguuccgguccgugagcuccgaccucacgaccaucagcggccgcuccagcgggcagaacaucguaucagaccugcaccagggcgacgucaucaagacuugccugaacaucaagcagcucaacugcaucucccccaagagccggaccacgaccaccaaucugaucacgugcggguccagccagaucuccguguacaaccugccgcgcggccagcucuacgagagcguuaccaccgagcacgggacaugcgccggcgacggccacugccugaccgacuucaugcccaucaacuccgacuuccuggcgacgcucaagaaguccaagugcuggaccaccgacauccccaacaucaucaagcuggucgagucagacgggaagaucagcugccaacccaucgacgugggcuccugcaacgugagcgggaacaucuggaccaucacgaagugcagcgacaacaaguacuacuacaccgacaacaagcacguccacgacgacgagaaggacaucggccacuacugcauggaggagaccugcaaguucgugcgcuucccgaucaacgacaaguucgugagcaacugcgagugggaccugaaccacaucgagaucaacaagcucaaccaggucgagcuggacaacaucaaugccuacaagaaggugcugaccgagaagcucacguccagccuguccguguucaaauacaagcucacacagaaccucccccacgucauccccaaguucaaguacaucaccauccagggcacccagaccguggacgggaucgagaacaguuucaucgagguggagauccccgcccuguccggcgccgcgagcggauuuaaaaucaugacaaaggagaacaacgagcuguucgacgccauccucuacgucaagcaggccagcuucuccuccaucuacaagaagaucuacaccaccggcccgaccaucgggaucaacacgaagcacgacgagaaguguaccggcgccugccccgugaaccugccccacuccaccggguggcugaccuucgccaaggagcggacgagcaccugggggugcgaggaguacggcugccucgccaucaacgaugggugcguguucggcucuugccaggacauaaucaaggacgagauguacaucuucaagaaggagaccgaagaggucgcgcugguggagaucugcaucagcuucaaccacaagaccuucugcacggacguggacucaaccacccccaucaucaccgacacgcuggaggcccaguucaagaccguggagagcuacaagcucccgaaccacguggccuuaaagcagcacaagcuguacguggggcaaaucaaugacuucgggguuuacaagaaggccugcggcaacgugcagaagaucaacaacacaaucuacggggagggcacgccccgcuucgacuaccucugccaccuggccaagcggaaggacgugcugguccgcaagugcuucgacaacgacuacaacuccugcagccuccugaccaucgcggacgaccugcggcucgaggaggacggggagaagcugaaggugaucaacuaccgcaaggugcugggauccaugaaguucaaggcccucuucggggacauccgguacaagagcuucaccgaggacaucgagcuggacgucgaggccuccugcgccggcugcaucaacugcuuugacaacauccacugcgagaucaagcugaccaacggccucgacaccucgugcuccuucgagagcuccugcgaugcguucaacagccgcauccuguucaacuccaaccagcacgucuacagcacgaagcugaucugcaccaaggagcagaccaaggccuucgagaucaagaucugcgggaagaccaucaaggcagaccucguggucacggaggccaagcccauccuggagcugaccccgaucgaccagaccagcuacaucaaggaggaggacacccggugcggcacgugguucugccgccucaccaaagagggguucuccgugcugcuggagcccuucaagaaccucuucggcagcuaccucgggauugccuacaccaucauaaucgcgcugcucugccuguucguguucaucuauaucauccugcccaugaucaugaagcucaaggagguccugaagcagaacgagaucgccuaccagaaggagcagaaaaagcgguga

SEQ ID NO: 15871 - RNA, 4332 nt, Artificial Sequence; identical to SEQ ID NO: 12585
  derived and/or modified CDS sequence (opt11) from BWAV/PGAV(191B-07)__KJ867180.1__GP

SEQ ID NO: 15872 - RNA, 4326 nt, Artificial Sequence
  derived and/or modified CDS sequence (opt11) from CEV(283)__KX817313.1__GP
augaucuucaugcugauccucuucgccguggccgcggccagccccgucuaccagcgcugcuuccaggacggcgccaucgugaagcagaacccguccaaggaggccgugaccgaggucugccugaaggacgacgugagcaugaucaagaccgaggcccgguacacgaagaacuccaccgggguguucagcaauaacgucgcgauccgcaaauggcugguguccgacuggcacgauugccggccccgcaaaguggucggcgggcacaucaacgugaucgaggugggcgacgaccucacccugcacaccgaaagcuacgucugcuccgccgacugcacgauugggguggacaaggagaccgcccaggugcggcugcagaccgacaccacgaaccacuucgagaucgcuggcaccaccgucaagagcggcugguucaaguccaccacguacaucagccucgaccagaccugcgagcaccugaagguguccugcggccccaagagcauccaguuccacgcgugcuucaaccagcacauguccugcgugagauuccugcaccggaccauccuccccggcagcaucgccaacuccaucugccagaacgucgagaucaucauccuggugacccuggcccuccugaucuucauccugcucagcaucaucuccaagacguacaucugcuaccugcugaugccgaucuucauccccaucgccuacaucuacgggcucaucuacaacaagagcugcaagaaaugcaagcugugcggccugguguaccaccccuucaccgagugcgggacccacugcgucugcggcgcccgcuacgacaccuccgaccggaugaagcuccaccgcgcgagcggccugugccccggguacaagucucugcgggccgcccgcgugaugugcaagaguaagggcccggccuccauccucuccauaaucacggccgugcugauccugaccuuugucacccccauuaacgcaaugauggugggggagagcaaggagaccuuugagcuagaggagcugcccgacgacaugcuggagauggccaacaaccucaacacguacuacaugcugugcgucgccaacuacgccgugaccuggucccugcucaucguggcccugaucauuggccugcuguucaagaaguaccagcaccgauuccuggacaucuacgcgauguacugcgaggagugcgacauguaccacgaccgcagcggaaucaaguggaacggggacuucaccaacaagugcggccacugcacgugcgggcaguacgaggacgccuccggccugcucguccaccguaagaccuacaauugccugauccaauacaagagcaaguggauuaugaacuucuuggugaccuacgugauccucguccugcugaaggacuccguggugaucguccaagccaaaggcguggacuucagcgagugcaucgaggccgagaaggugcgcuggaacugcaccggccccuucgucaaccucggcaacugugagaagaagcagaagaaggagccguacuccaacaucgccgcgcagcugaaggggcugggcgccaucagcaucuuggacgugcccaucaucgccucuauccccgaggacaucgccggggcgcuccgguacaucgaggaccagcgcagcuaccacucccagcugaccguagaguacgccaugcugacgcgguacugcgacuacuacacacaguucuccgacaacaguggcuacagccagaccaccuggcgcgucuaccucaggucccacgacuucgaggccugcguacuguaccccaaccagcacuucugccgcugcgugaagcacggggacaagugcagcagcuccaacugggacuucgccagcgagaugaagaacuauuacuccggcaagcagucgaaguucgacaaggaccugaaccucgcccugacgucccugcaucacgcguuccgcggcaccagcuccagcuacaucgccgggcuccuguccagcaaggccaacgacgagcugguccaguacaccuccaagauccgggagaaguucccgggcaacgcccuccugaaggccguuaucgacuacaucgcguacaugaaggggcugaccgagaugagcaacuucaagaaggacgaguucugggacgagcucguguacguccccgaccccaccaagcccccgaagcugucccgcagcuccggcacgguguacgacuucaagagcgccaccuccaaccugggggagaagaacugcaaggacgugaaaggcgucgugugccucagcccccggucgggcgugaccuacgacuccauuaucgccugcggcgagggcagcucccccaacaucuaccgcauccccaagaccggggucuaccagagcaacuccgagccgagcaacuacugcguguccgacagccacugccuggaggacuucgaggugaucaaccaggaggagcuggacgcaaucaagaagucccgguguugggagguagacuaccucuacgccaaccccuccaagcaguccgacggcauccgcagcugccggaugcgcgaugcgggacauugcaacgugacgaccaaccgguggcccaucauccagugcgacgacaacaaguacuauuacucagagcugcagcgcgacuacgacaaggagcaggacaucgggcacuucugccugagcccgcggugcaccaccgugcguuucccgauccaccccaagcacgucuccaacugcgacuggcaggucagccauuccacgguggacaagguagacgugcacaaccucgaggacaucgagcaguaccggaaggccauuacccagaagcugcagaacagccuguccaucuucaaguacgcccgcaccaagaaccucccccacaucaagccgaucuacaaguacauuaccaucgagggcacggagaccgccgaggggaucgagagcgcguacaucgagagcgagauccccgcccuggccggcaccuccaucggguuuaagaucaacaccaaggagggcaagcaccuccucgacgugaucgccuacgucaagcaggcuagcuacuccucucuguacaacaagauguacgugacgggccccaccguggggaucaacaccaagcacgacgagcugugcaccggccccugcccggucaacgugccccacucggacggguggcucacguucgcgcgggagcgcaccucuuccuggggcugcgaggaguucgggugccuggccaucagcgacggcugcguuuucggcucgugccaggaccugaucaaggaggagcucgccgucuaccggaaggagaccgaggaggccaccaacguggagcuuugccugacguucagcgauaagaccuacugcaccgagcucaaccccaucacccccaucaucacgaaucuguucgaggugcaguucaagaccgucgagaccuacucccugccacgcgugguggccguccagaaccacgagauccggaucgggcagaucaacgacuugggaaucuacucaaaggguugcggcaacgugcagaaggucaauaacaccaucuacgggaacggcgugcccaaguucgacuaccugugccaccuggcgucccgcaaggaaguuaucguccgcaagugcuucgacaacgacuuccaggccugcaaguuccuccagagcccgcccuccuaccggcuggaggaggacgacggaagcaucacggugaucgacuacaagaagauccuggggaccaucaagaugaaggccauccucggcgacgugaaguacaagaccuucgccgagaacaucgacaucaccgccgagggagucugcacgggcugcgugaacugcuucgagaacauccacugcgagcugacgauccacaccaccaucgaggccuccugccccgugaccagccccugcacgcuguuccacgaccgcauccugaucacccccgacgagcacaaguacgccaugaaggucaucugcaccgagaaacagaccgguacgcugcccuucaagauaugcaacuccaagguggacgccacccugacccucguggaggccaagccgauccuggagcuagcgagcgucgaccaaacagccuacauccgggagaaagacgagcgcugcaagacguggaugugccgggugcgcgacgagggcauccaggugauccuugagcccuucaagaaccuguucggcagcuacaucgggaucuucuacaccuccauccugaucgucaucaccaucuucaucaucaucuacguaauccuccccaucuguuucaagcugaaggacacccugcagaagcacgaggacgccuacaagcgggagaugaagauccgcuga

SEQ ID NO: 15873 - RNA, 4326 nt, Artificial Sequence; identical to SEQ ID NO: 12587
  derived and/or modified CDS sequence (opt11) from CEV(BFS283)__AF123483.1__GP

SEQ ID NO: 15874 - RNA, 4329 nt, Artificial Sequence; identical to SEQ ID NO: 12588
  derived and/or modified CDS sequence (opt11) from CHATV(Mohko ILO8-3)__KF719222.1__GP

SEQ ID NO: 15875 - RNA, 4329 nt, Artificial Sequence; identical to SEQ ID NO: 12589
  derived and/or modified CDS sequence (opt11) from CHATV(Mohko M07-1)__KF719225.1__GP

SEQ ID NO: 15876 - RNA, 4329 nt, Artificial Sequence; identical to SEQ ID NO: 12590
  derived and/or modified CDS sequence (opt11) from CHATV(Mohko M07-2-83)__KF719228.1__GP

SEQ ID NO: 15877 - RNA, 4326 nt, Artificial Sequence; identical to SEQ ID NO: 12591
  derived and/or modified CDS sequence (opt11) from CHATV(LEIV-15854)__HQ734820.1__GP

SEQ ID NO: 15878 - RNA, 4326 nt, Artificial Sequence; identical to SEQ ID NO: 12592
  derived and/or modified CDS sequence (opt11) from CHATV(LEIV-17756)__EU621834.1__GP

SEQ ID NO: 15879 - RNA, 4326 nt, Artificial Sequence; identical to SEQ ID NO: 12593
  derived and/or modified CDS sequence (opt11) from CHATV(LEIV-18733)__HQ734821.1__GP

SEQ ID NO: 15880 - RNA, 4326 nt, Artificial Sequence; identical to SEQ ID NO: 12594
  derived and/or modified CDS sequence (opt11) from CHATV(LEIV-22712)__HQ734822.1__GP

SEQ ID NO: 15881 - RNA, 4332 nt, Artificial Sequence; identical to SEQ ID NO: 12595
  derived and/or modified CDS sequence (opt11) from INKV(KN3641)__U88059.1__GP

SEQ ID NO: 15882 - RNA, 4332 nt, Artificial Sequence
  derived and/or modified CDS sequence (opt11) from INKV(SWAR83-161)__U88060.1__GP
auggaggugcugaaccucaucuggcugcugacccucuguagcgccucccccgucuuccagcgcugcuuccaggacggcgccaucguaaagcagaacccaagcaaggaagcggugaccgaggucugccugaaggacgacguguccaugaucaagacggaggccaaguacaucaaaaacgccaccgggaccuucgccaacaacaucgccaugcggaaauggcugguggcggacuggcacgacugccgcccccagaaguccuccggcgggcacaucaacgucaucgaggugggcgacgaucucagccugcacaccgagaguuacaucugcagcgccgacugcgugaucacggucgacaaggagaccgcccagauccgccugcagaccgacaacaccaaccacuucgaaguggcagggacgaccgugaagucuggcugguuuaagagcaccaccuauaucacgcucgaccagaccugcgagcaccugaaggucuccugcggccccaagagcauccaguuucacgcgugcuucaaccagcacauguccugcgugcgcuuucugcacaggaccauccuccccgggagcaucgccaauuccaucugccagaacaucgagaucaucauccuggugacccugagccucgccaucuucaucuuccugacgaucgucuccaagaccuaugugugcuaccugcucaugccgaucuucaucccgaucgccuacaucuacggcuggaucuacaacaagagcugcaagaagugcaagcugugcgggcugguguaccaccccuucaccgagugcggcacccacugcgucugcggggcccgcuacgagacguccgaccggaugaagcuccaccgcgcuagcggccugugccccggcuacaagaaccugcgggccgcgcgcgugaugugcaagagcaaggggccggcauccgugcucagcaucaugaccgccauccugauccugaccuucgucacccccaucuccgcgauggugaucggcgagagcuccgagguguacacgcucgacgagcugccugacgacaugguccagauggccgagagggugaacaucuacuaccagaucaucaucaucaauuacagcaucaccugggccuuccuccuguucgggcugguccuggccuacuucuucaagaaguaccagcaccgcuucuuguccuucuacgccauguacugcaaggagugcgacauguaccacgagcgggcgggccugaccuacuggggcgacuucaccaacaagugccgccaguguacgugcgggcaguucgaggacgugaccggccugauggugcacaagaaguccuacaacugcaucaucaaguacaaggccaaguggauccgggacauccugaucaccuaccugaucaucaugcugaucaaggacucccuccuguucgucggggccaccggcacggacuucgccgcgugcaucgacgagaagaccgugaccuggaacugcaccgggcccuuucugaaccucggaaagugcgacaagagccagaagaagaucggcuacgcggacaucgccgaccaacugaaggggcugggcgccaucuccguacucgauaucccgaugaucaagcgcaugcccgacgagaucagcgggucccugaaguacaucgacggccuugagacguaccacgagcagcucaccgccgaguacgcguuccugacccgguacugcgacuacuacacccaguacaccgacaacagcggguacucccagacggucuggcgcaccuaccugcggucacacgacuucggcgccugcgugguguacccaaaccagcacuucugccgcugcgucaagcacggcgacaagugcaacuccgcaaagugggacuucgccaacgagaugaagaccuucuacaccgggcagaaggcaaaguucaacaaggaccugaaccucgcgcugcuggugcuccacaaggccuuccggggcacggggaccucauacaucgccgaguccauggcccgcaaggacaaccgcagcaugacccacuucgcccuggagaucaagaagaaguuccccaccaacgcgcugcucacggcccugaucgacuacaucagcuaccugcagucccucgccgagaugagcaccuucgagcuggacgaggacugggaggacuucaaauacaagccggagcccaccgaagcgccccagcugcggucccaccgcaccgaccaguacaacuucaagaacgccgacagcaacuccaacgugaaggucugcaagaacauccagaaggugagcugcaucucuccccggagccgcgccaaguuugagaacaucaucgccugcggcgagcacgccaacccguccguguacaugaugcccaacgucagcaucuaccaguccaacagcgagcggucccacuacugcaucgccgacagccacugccucgaggaauacgaggugguggaguccgagcugcugaacgcgcucaagaaguccaagugcugggccaaggagauggacgacaucguccugcacaaacagagcgacgggcugcgcagcugccggaugaaggacacgggcaacugcaacgugcaggagaacgacuggaccaucgugcucugcgagaacggcaacuacuacuacuccgaggcccaccgcgacuacgacaaggaccaggacgucgggcacuuuugccugagcccccggugcagcaccauccgcuaccccaucaacaagcggcacauccgcaacugcgacuggcagaucucccauagcaccaucgacaagaucuccgugcaggagcuggccgacauagagcaguacaagaaggccaucagccagaaguuacagacgucccugagcaucuucaaauacgugaagaccaagaaccugccgcacaucaagcccgcguacaaguacaucaccgucgagggcaucgagaccguugaggggaucgagaacgccuucaucgaguccgagauccccgcccucgccggcacggccaucggcuucaagaucaacagccgggaagggaacuaccugauggacguaauuggcuaugucaaguccgcgagcuacuccgccaccuacaccaagcuguacaccacggggcccaccaucggcgugaacaccaagcacgacgagaagugcaccgggccaugcccacccauaaucgaccacaaggagggcuggcucacguucgccaaggagcgcaccagcaccuggggcugcgaggaguucgggugccucgccguuuccgacggcugcgucuucggaagcugccaagacaucaucaaggacgaacuugccguguaccggaagaccacggaggagcucaccaccguggagcuaugccugaccuucuccgauaagacguacugcaccaaccucaacgcgaucacccccaucaucaccgacaaguucgagguccaguuuaagaccguggagagcuacacgcugccccgcaucaucgcgaucaagaaccacgagaucaagguuggccagaucaacgaccuggggguguacuccaagggcugcggaaacgugcagaagaucaacgggaccaacuacggcaacggggugcccaaguucgacuaccucugccaccuggccagccggaaggaggucaucauucgcaagugcuucgacaacgauuaccaggccugcaaguuccugcagagcccgcccuccuaccggcucgaggagcaccagggcaccgugaccgugaucgacuauaagaagauccuggggaucaucaagaugaaggcgauccugggcgacgucaaauacaagaacuaccagagcaacaucgagaucaacgccgagggcacgugcgccgggugcaucaacugcuucgagaacauccacugcgaguucacaauccauaccaccguggaggccuccugccccaucgugacggacugcgucagcuuccacgaccgcauccucaucacccccgacgagcauaaguacgcccugaagguggugugccaggagaagcccaaacugucccuuaaguucaagaucugcaacaccaacaucgacgcgagcaugaccaucgucgacuccaagccgauccuggagcuggcccccguggaccagacgaccuacauccgcgaaaaggacgagcggugcaagaccuggaugugccgcgugcgggacgaggguuuccaggucauccucgagcccuucaagaaccuguucgggagcuacauaggcaucuucuacaccgggauccugugcaucaucugccuccugaucgugaucuacaucauccugcccaucugcuucaaacuccgcgacacgcugcggcagcacgaggacgccuacaagaaggagaugaagauccgcuga

SEQ ID NO: 15883 - RNA, 4332 nt, Artificial Sequence
  derived and/or modified CDS sequence (opt11) from INKV(Lovanger)__KU681435.1__GP
auggaggugcugaaccucaucuggcugcugacccucugcagcgccucccccgucuuccagcgcugcuuucaggacggcgccaucgugaagcagaacccgucgaaggaggcggugacggaggucugccugaaggacgacguauccaugaucaagacggaggccaaguacaucaagaacgccaccgggaccuucgccaacaacaucgccaugcggaaguggcugguggcggacuggcacgacugccgcccccagaaguccuccggcgggcacaucaacgucaucgaggugggcgacgaccucagccugcacaccgaguccuacaucugcagcgccgacugcgugaucacggucgacaaggagaccgcccagauccggcugcagaccgacaacaccaaccacuucgagguggccgggacgaccgugaaguccggcugguucaagagcaccaccuacaucacgcucgaccagaccugcgagcaccugaaggucuccugcggccccaagagcauccaauuccacgcgugcuucaaccaacacauguccugugugcgcuuccugcaccggaccauccuucccgggagcaucgccaacuccaucugccagaacauugagaucaucauccuggugacccugagccucgccauuuucaucuuccucacgaucgucuccaagaccuacguuugcuaccugcucaugccgauauucauccccaucgccuacaucuacggguggaucuacaacaagucuugcaagaaguguaagcugugcgggcugguguaccaccccuucaccgagugcggcacccacugcguaugcggggcccgcuacgagacguccgaccggaugaagcuccaccgcgcgagcggccugugccccggcuacaagagccugcgggccgcccgcgugaugugcaagucccgggggccggccagcguccucuccaucaugaccgccauucugauccugaccuucgucacccccaucagcgcgauggugauaggcgaguccagcgagguguacacgcucgacgagcugcccgacgacaugguccagauggccgagcgcgugaacaucuacuaccagaucaucaucaucaacuacuccaucaccugggccuuccuccucuucgggcugguccuggccuacuucuucaagaaguaccagcaccgguuccucagcuucuacgccauguacugcaaggagugcgacauguaccacgagcgcgcgggccucaccuacuggggcgacuucaccaacaagugccggcagugcacgugcgggcaguucgaggacgugaccggccugauggugcacaagaaguccuacaacugcaucaucaaguacaaggccaaguggauccgcgacauccucaucaccuaccugaucauaaugcugaucaaggacagccucuuauucgucggggccaccggcacggacuucgccgccugcaucgacgagaagaccgugaccuggaacugcaccgggcccuuccugaaccucggccggugcgacaagucccagaagaagaucggcuacgcggacaucgccgaccagcugaaggggcugggcgccaucagcgugcucgacaucccgaugaucaagcgcaugcccgacgagaucuccgggagccugaaauacaucgacggccuggagacguaccacgagcagcucacagccgaguacgcguuccugacccgguacugcgacuacuacacccaguacaccgacaacuccggguacagccagacggucuggcgcaccuaccugcggucccacgacuucggcgccugugugguguaccccaaccaacacuucugucgcugcguaaagcacggcgacaagugcaacagcgccaagugggacuucgccaaugagaugaagaccuucuacaccgggcagaaggccaaguucaauaaggaccucaaccucgcgcugcuggugcuccacaaagccuuccgcggcacggguaccuccuacaucgcggagagcauggcccggaaggacaaccgcagcaugacacacuucgcccuggagaucaagaagaaguuccccaccaacgcgcugcucacggcccugaucgacuacaucuccuaccugcagagccucgccgagauguccaccuucgagcuggacgaggacugggaggacuucaaguacaagccggaacccaccgaggcgccccagcugcggagccaccgcacggaccaguacaacuucaagaacgccgacuccaacagcaacgugaaggucugcaagaacauccaaaagguguccugcaucagcccccggucccgcgccaaguucgagaacaucaucgccugcggcgagcacgccaacccgagcguguacaugaugcccaacgucucaaucuaccagagcaacuccgagcggagccacuauugcauagccgacucccacugccucgaggaguacgaggugguggagagcgagcuacugaacgcgcucaagaaguccaagugcugggccaaggagauggacgacaucguccugcacaagcaggcugacgggcugcgcagcugccggaugaaggacacgggcaacugcaacgugcaggagaacgacuggaccaucgugcugugcgagaacgguaacuacuacuacagcgaggcccaccgcgauuacgacaaggaccaggacguggggcacuucugccugagcccccguugcagcaccauccgcuacccgaucaacaagcggcacauccgcaacugcgacuggcagaucucccacagcaccaucgacaagaucuccgugcaggagcuggccgacaucgagcaauacaagaaggcuaucucacagaagcuccagacgucgcugagcaucuucaaguacgugaagaccaagaaccugccgcacaucaagcccgccuacaaguacaucaccgucgagggcguggagaccguggaggggaucgagaacgccuucaucgaguccgagauccccgcccucgccggcacggcgaucggcuucaagaucaacagccgggaggggaacuaccugauggacgucaucggcuacgugaaguccgccagcuauuccgccaccuacaccaagcuguacaccacggggcccaccaucggcgugaacaccaagcacgacgagaagugcaccgggccgugcccgcccaucaucgaccacaaggagggcuggcucacguucgccaaagagcgcaccagcaccuggggcugcgaggaguucgggugccuggccgucuccgacggcugcguguuugggagcugucaggacaucaucaaggacgagcugguggucuacaggaagaccacggaggagcucaccaccguggagcugugccugaccuucuccgacaagacguacugcaccaaccucaacgcgaucacacccaucaucaccgacaaguucgaggugcaguucaagaccgucgagagcuacacgcugccccgcaucaucgccaucaagaaccacgagaucaagguaggccagaucaacgaccuggguguguacuccaaaggcugcggcaacguccaaaagaucaacgggaccaacuacggcaacggguggcccaaguucgacuaccucugccaccuggccagccggaaggaggugaucauccgcaagugcuucgauaacgacuacaaggccugcaaguuccugcagagcccgcccuccuaccgccucgaggagcaccagggcaccguaaccgucaucgacuacaagaagauccuggggacgaucaagaugaaggcgauccuaggcgacgugaaguacaagaacuaccagucuaacaucgagaucaacgccgaggggaccugcgccggcugcaucaacugcuucgagaacauccacugcgaguucaccauccacaccacgguggaagccuccugccccaucgucaccgacugcguuagcuuccacgaccggauccucaucacccccgacgagcacaaguacgcccugaagguggucugccaggagaagcccaagcugucccucaaguucaagaucugcaauaccaacaucgacgcgagcaugacgaucguggacuccaagccgaucuuggagcuggcccccguggaccagaccaccuacauccgcgagaaggacgagcggugcaagaccuggaugugccgcguccgagacgagggcuuccaggugauccucgagcccuucaagaaccuguucgggagcuacaucggcaucuucuacacggggauccugugcauuauuugccuccugaucaucaucuacaucauacugcccaucuguuucaagcucagggacacccugcggcagcacgaggacgcauacaagaaggagaugaagauccgcuga

SEQ ID NO: 15884 - RNA, 4332 nt, Artificial Sequence; identical to SEQ ID NO: 12598
  derived and/or modified CDS sequence (opt11) from INKV(Lovanger)__KX554936.1__GP

SEQ ID NO: 15885 - RNA, 4335 nt, Artificial Sequence; identical to SEQ ID NO: 12599
  derived and/or modified CDS sequence (opt11) from JSV__AF123487.1__GP

SEQ ID NO: 15886 - RNA, 4335 nt, Artificial Sequence; identical to SEQ ID NO: 12600
  derived and/or modified CDS sequence (opt11) from JSV(BFS 4474)__KX817319.1__GP

SEQ ID NO: 15887 - RNA, 4323 nt, Artificial Sequence; identical to SEQ ID NO: 12601
  derived and/or modified CDS sequence (opt11) from LUMV__AF123484.1__GP

SEQ ID NO: 15888 - RNA, 4323 nt, Artificial Sequence; identical to SEQ ID NO: 12602
  derived and/or modified CDS sequence (opt11) from LUMV(SAAr 1881)__KX817325.1__GP

SEQ ID NO: 15889 - RNA, 4329 nt, Artificial Sequence
  derived and/or modified CDS sequence (opt11) from MELV__U88057.1__GP
augaucgccuuaaucuuccucaucgccaucgcggccgccagccccguguaccagcgcugcuuccaggacggcgggaucgucaagcagaauccguccaaggacgccgugaccgaggugugccugaaggacgacgucagcaugaucaaaaccgaggccaaauacaugaagaacgacacgggcaccuucuccaacaacguggcgaugcggaaguggcugguggccgacuggcacgacugccgcccccaaaaguccagugggggccacaucaacgucaucgaggugggggacgaccucagccugcacacagaggccuacaucugcucugccgacugcaugaucagcguugauaaagagaccgcgcagauccggcuucagacggacuccaccacccacuucgagauugccggcaccacggucaagagcgguugguucaaguccaccaccuacaucacccucgaccagacgugcgagcaccugaaggugucuugcgggcccaaguccauccaguuccacgccugcuucaaccagcacaugagcugcgugcgcuuccugcaccgcaccauccuccccggcuccaucgcaaacagcaucugccagaacaucgagaucaucauccuggucacccugacccuccugaucuucaucuuccugucgauccugagcaaaacguacaucugcuacauccugaugccgauguucaucccaguggccuacaucuacggguggaucuacaacaaguccugcaagaagugcaagcugugcggucucguguaccaccccuucaccgagugcgggacccacugcgucugcggcgcgcgcuacgagaccagcgaccgaaugaagcugcaccgcagcuccggccugugccccggguacaagagccuccgggccgcccgcgugaugugcaaguccaagggcccggccucaauccuguccgugcugacggccguccucauccugaccuucgugacgcccaugaacgcgcugacccucgggagcuccgaggagaacuacaagcuggagaaccugcccgacgacaugcucgacauggccgagcggaucgacaucuacuaccuuucgaucauccugaacuacuccaucacguggggccucgugauccugcugggccucaccuucauccuguuccgccgguuccagcaccgcuuccugaacugcuacgccauguacugcagcgagugcgacauguaccacgacaagaacgggcucguccggaacggcgacuucaccaacaagugccgccagugcacuugugggcaguacgaggacgccgccggccugaucauacaccaaaaguccuacaacugccugaucaaguacaaggccaaguggauccggaacauacuccugaccuacauaauccugauccucaucaaggacagcgugcugcugaccuccgccgaggggcccgacuucagcgugugcauagagcagaaggccaucuccuggaacugcaccggcccguuccucaaccuggggcgcugcgagaagacccagaagaaggccagcuacgcuacgaucgcgacccagcugcgguccaucgacgccaucagcguccuggacauccccaugaucgccaagauccccgaggacaucuccggggcccuaaaguacaucgagagccugaagaccuaccacgagcagcugaccgcggaguacgccaugcucacgcgcuacugcgacuacuacacccaguucagcgacaacuccggcuauagccagaccuccuggcggaaguuccugcgcagccacgauuucgaguccugcaucaucuaccccaaccaacacuucugucgcugcgugaagcaggaugagaagugcagcuccgccaagugggacuucgccagcgagaugaagggguucuaccugaacaagcaagccaaguucaacaaggaccucaaccuggcgcuguccaccuuccacaaggccuuccggggcaccccgaucagcuacgucacggagcucaucuccaagaacaagaacagcucccuucuaauguacgugagugagaucaagcgcaaguuucccgggaacgcccuccugguggcccuccucgacuucaucauguaccugcagucccugagcgagaucuccggcuucgagcucggcgacgagugggaggacuucaaguacgaccccgagcccacggagccggcccuaaugccccggagccaccgcagcgaccaguacaacuucaagaacgcggccuccgucucaaagaccaagaccugcgagaacaucaagcgggugcugugccucagcccccgcagccgggccacguucgacgacguggucgccugcggggaguucgccaaccccucuguguacaugcugccgaacaucaccaucuaccagagcaacaucgagcgcucgcacuacugcaucgcggacagccacugccuggaggaguucgagcucgugaagcccgagcugcugaccgcccucaagaaguccacgugcugggccggcgagaucgacgacaucguccugcacaagcagagcgacgggcugcgguccugccgcaucaaggacaccgggaccugcgacgugcucggcaacgaguggaccaucgugcuaugcgagaacaacaacuucuacuacagcgagguccaccgggacuaugacaaggaccaggacaucggccacuucugccugagcccccgcugcaauaucauccgguaccccaucaacccucgccacauccggaccugcaaguggcagaucagccacuccacgauugacaagaucaccgugcacgagcucgccgacaucgagcaguacaagaaggcgauuacccagaagcugcagaacagccuguccaucuucaaguacaagcgcaccaagaaccucccccacaucaagcccaucuacaaauacaucgccaucgagggcacggagaccguggaggggaucgagaacgccuacaucgagagcgagaucccggcccuggccggcacagcgaucggguucaagaucaacuccaaggacggcaaccaccugauggacgucaucggcuacgugaaguccgccagcuacuccagcaccuacacgaagcucuacaccaccgggcccaccaucggcaucaacacaaagcacgacgagaaaugcaccggguccugccccacccaggugaagcacaaaaccggcuggcuaacguucgccaaggagcggacaagcacaugggggugcgaggaguucggcugccuggccaucuccgacggcugcgucuucgggagcugccaggacaucaucaaggacgaguugaccguguaccgcaagacgaccgacgaggugaccgagcuggagcugugccucaccuucgccgacaagacguacugcaccaaccugaacgcggucacccccaucaucaccgacaaguucgaggugcaguucaagaccguggaauccuacagccugccgcggaucaucgccgucaagaaccacgagaucaaggugggccagaucaacgacaucgggguguacuccaaaggcugcgggaacguccagaaggugaacggcacgagcuacggcaacggggugcccaaguucgacuaccucugccaccuggccucccgcaaggaaguuaccauccgcaagugcuucgacaacgacuaccaggcaugcaaguuccugcagacccccagcuccuaccggcucgaggagcaccagggcacagugacgaucaucgacuacaagaagauccuggggagcaucaaaaugaaggccauccugggcgacgugaaguacaagaacuacgcguccaacaucgacaucaacgccgaggggagcugcgccgguugcaucaacugcuucgagaacauccacugcgaguucaccauccacuccaccgucgagaccagcugccagauagaguccgacugcacgagcuuccacgaccgcgugcucaucacccccaacgagcacaaguacgcccugaagcugaucugucacgacaagccggcgagcucccucaaguucaagaucugcaacaccaagguagaggcagccaugacccuggucgacgcccggcccaucaucgagcuggcccccguggaccagacggcguacauccgcgagaaggacgaacggugcaagaccuggaugugccgcguacgggacgagggcauccaggucaucuucgagcccuucaagaaccucuucgggagcuacaucggcaucuucuacgccaucgugaucugcaucaucgugcuguuccugaucgucuacaucgugcuaccgaucugcuucaagcugaaggacacccugaagcagcacgaggacgccuacaagcgcgagaugaagauccgguga

SEQ ID NO: 15890 - RNA, 4326 nt, Artificial Sequence
  derived and/or modified CDS sequence (opt11) from SAV__AF123486.1__GP
augaucccccuccuguuccuggugacccuggucagcgccgggccgguguuccagcgcugcuuccaggacggggccaucgugaagcagaaccccuccaaggaggcggucaccgaggugugcauuaaggaugacgugagcaugaucaagacggaggcccgguacguccgcaacuccagcggcguguucuccaacaacguggcccuccggaaguggcuggucagcgacuggcacgacugcaagcccaagaagguguccgggggccacaucaacgugaucgaggucgggaacgaccugacccuccacaccgagucguacgugugcuccgccgacugcaccaucggcauugacaaggagacggcccagauccgccugcagaccgacaccaccaaccacuucgagguggcgggcacgaccgucaagagcgggugguucaagucuaccacauacaucacacuggaccaaaccugcgagcaccuuaaggugagcugcggccccaaguccauccaguuccacgccugcuucaaccagcacaugagcugcgugcgguuccugcaucgaaccauccugccggggaguauggccaacagcaucugccagaacauagagauaaucauccucaccacgcuggcccugcucaucuuccugcugcucaccauccuguccaagaccuacaucugcuaccugcucaugcccaucuucauccccaucgcgcaccuguacggccugaucuacaacaagagcugcaagaagugccagcucugcgggcuggucuaccaccccuucaccgagugcggcacgcacugcgugugcggcgcccgguacgagaccuccgaccgcaugaagcugcaccgggccagcgggcucugcccaggcuacaagagccugcgcgccgcccgggugaugugcaaguccaaggggcccgcaagcaaccuguccaucaucaccgccguccucaccuugacguucgugacccccauuaacggccugaccaucggcgacagcaaggaagugcucaacccagaugagcugccggacgauaugcuggagauggcccagaagcucaacauguaccagcugaucugcaucaucaacuacaccgccacgugguccaucaucaucaucgggcuggccgucuucuacaucuucaagaaguaccagcaccgcuucuacaacuacuacgcgauguacugccaggagugcgacauguaccacgagcggagcggccucaaguggaacggggacuucaccaacaagugccgccagugcacgugcggcgaguacgaggacgccgccgggcugaucucccaccgcaagagcuacaacugcuugcuccaguacaaggugaagugggucaugaacuuccugaccaucuacguggcccugaucauccucaaggacuccacccucaucgugcaggccgcgggcaccgacuucagcgacuguaucgagaccgaggaacugaacuggaacugcaccggccccuuccucaaccuggggaacugugagaagaagcagaagaaggaguccuacagcaacaucgccgagcagcugaagggccugcaggccaucuccguccucgacaucccccugaucgcccggauccccgaggacaucagcgggggccugcgguacaucgaguccauccgcacgcaccacgcccagcucaccgcggaguacgccaugcugacccgguauugcgacuaccacaagcuguucggggacaacagcggcuacucccagaccaccuggcgcauguaccuccggagucacgacuucggcgccugcauccuguacccgaaccagcacuucugccgaugcgugaagcacggggagaagugcuccagcagcuccugggacuucgccucggagaugaagaacuacuacuccggcaagcaggggaaguucaacaaggaccugaaccucgcgcugcagagcauccaccacgccuuccgcggcacguccagcuccuacaucgccaccaucuuaucagagaagcggaacgaccagcucguggaguacauggagaagcugcgcgagaaguucaucgggaacgcacugcuccgggccguccuggacuucaucaccuacaugaagucccugaccgagaugacgaacuucaagcacgacgaguucugggacgaguucgugcaccuccccgcgcccaccaaggcccccagcaugcgccgguccggcaacgagaacuacgacuucaaggccccgaccucacccgccggcacgaaguccugcaagaacaucaagaacguggucugccugucuccccgcuccggggccagcuacgagggcaucguggcgugcggggagcccuccgcuccgcagaucuucaagaugcccagcgagagcauuuaccacaacaacgccgaccaguccauguacugcaucgccgacacgcacugccugcaggacuacagccccguggaggacgaggagcucaacgccaucaagaaguccaaaugcugggaaaccgaguucaccaacgcgguccccuucaagcaaagcgacggcauccgguccugccgcaugcgggacagcgguaacugcaacgugaccacgaaccuuuggccggugaugcagugcgacgacgggaaguucuacuacuccgagcaccagaaggacuacgacaaggaccaagacaucggccacuucugcuugagcccccgcugcaacaugguccgguuccccaucuccgagaagaacauccucgccugcgacuggaucgugagccacccgaacaucgacaagauagacgugcacucccuggaggaccuggagcaguacaagaaggcaaucacccaaaagcuccagaccagccuguccaucuucaaguacgccaagaccaugaaccucccccaugucaagcccaucuacaaguacaucagcaucgaggggacggagaccgcggagggcguggagaacgccuucaucgaguccgagauccccgcccucgccgggaccagcaucggcuucaaggugaacuccaaggacggcaaacacaucauggacaucaucggguacgucaagaccgccagcuacuccagcguguacacgaagcuguacaccaccagcccgaccacgggcgugaacaccaagcacgacgagcugugcacagggcccugccccaaacagaucgagcacaagaacggcuggaucaccuucuccaaggagcgcacgagcuccugggggugcgaggaguucggcugccucgcgauuucugacggcugcgucuucgggaguugccaggacaucaucaaggacgagaugagcguguaccggaaggagaccgaggagaccaccaucguggagcugugccugacguucuccgacaagaccuacugcgucgagcucaaccccgugaccccgaucaucaccgaccuguucgaggugcaguucaagacggucgagaguuacacccugccccgcaucguggccgugaagaaccacgaggucauggugggccagaucaacgaccucgggguguacaguaagggcugcgggaacguccagaaggugaacggcaccguguacggcaacgguguccccaaguucgacuaccugugccaccuggccagccggaaggaggugaucauccgcaagugcuucgacaacgacuaccaggccugcaaguuccuccaguccccuagcuccuaccggcuagaggaggacgccagcaccgugucuaucaucgacuacaaaaagauccugggcaccauuaagaugaaggcgauccucggggacguccgcuauaagacuuucagcgaguccaucgacaucagcgccgaggggaccugcaccggcugcgugaauugcuucgagaacauccacugcgaguucaccauccacuccacgguggaggccagcugcccggucguaagcacgugcacccuguuccacgaccggauccuuaucggccccgacaaccacaaguacgccaugaaggugaucugcaccgaggcccccaagaccucccucagcuucaagaucugcaacaccaaggucgacgcggccaucaccauuguggauuccaagcccaucguggaacuagccccggucgaccagaccgccuacauccgcgagaaggacgaccgcugcaagacguggaugugucgggugcgcgacgagggcaugcagguccugagcgagcccuucaagaaccuauucgggagcuacaucggcaucuucuacaccgggcuugcggugcugaucaucgcacucaucgccguguacaucguuaugcccaucugcuucaaggugaaggacaucuugaagaagcacgacgacgccuaccgucgcgagcugaagauccgguaa

SEQ ID NO: 15891 - RNA, 4326 nt, Artificial Sequence
  derived and/or modified CDS sequence (opt11) from SAV(20230)__KX817331.1__GP
augaucccccuccuguuccuggugacccuggucagcgccggcccgguguuccagagaugcuuccaggacggggccauagugaagcagaacccauccaaggaggcagucaccgagguaugcaucaaggacgacgugagcaugaucaagacggaggcccgguacguccggaacuccagcggcguguucuccaacaacguggccuugaggaaguggcuggucagcgauuggcacgacugcaagcccaagaaggucuccgggggccacaucaacgugaucgaggucgggaacgaccugacccuccacaccgaaagcuacgugugcuccgccgauugcacaaucggcaucgacaaggagacagcacagauccgcuugcagaccgauaccaccaaccacuucgagguggcaggcacgacugucaagagcgggugguucaaguccaccaccuacaucacgcuggaucagaccugcgagcaccucaaagugagcugcggccccaagucuauccaguuccacgcaugcuucaaccagcacaugagcugcgugcgguuccugcaccgcaccauccugcccgggucuauggccaacucuauaugccagaacaucgagauuaucauccucaccacgcuggcccugcucaucuuccugcugcucacuauccuguccaagaccuacaucugcuaccugcucaugcccaucuucauccccaucgccuaccuguacggucugaucuacaacaagucaugcaagaagugccagcucugcgggcugguuuaccaccccuucaccgagugcggcacccacugcgugugcggagcccgauacgagaccucggaccgcaugaagcugcacagagccagcggauuguguccgggcuacaagagccugcgcgccgcccgggugaugugcaaguccaagggacccgcgagcauccugucuaucaucaccgccguccucaucuuaaccuucguaacgccgauuaacggccugaccaucggcgacagcaaggagguguucaaccucgacgagcugcccgacgacaugcuggagauggcccagaagcucaacauguaccagcugaucugcaucaucaacuacaccgcaacgugguccaucaucauaaucggguuagccgucuuuuacaucuucaagaaguaccagcaccgcuuuuacaacuacuacgcgauguacugccaggagugcgacauguaccacgagcggagcggccucaaguggaacggggacuucacgaacaaaugccgccagugcacgugcggcgaguacgaggacgccgccgggcugaucucccacaagaagaguuauaacugccuacuccaguacaaggugaagugggucaugaacuuccugaccaucuacguggcccugaucauccucaaggacagcacccugaucguccaggccgcgggcacagauuuuagcgauugcaucgagaccgaggagcugaacuggaacugcaccggcccguuccucaaccuggggaacugugagaagaagcaaaagaaggagucauacucaaauauagccgagcagcugaagggccugcaggccauauccguccuagacaucccccugaucgcccggauccccgaggacaucagcgggggccugcgcuacaucgagucuauccggacccaccacgcccagcucacggcggaguacgccaugcugacccgcuacugcgacuacuacaagcuguucggggacaacagcggcuacucccagaccaccuggcgaauguaccuccgcagccacgacuucgaggccugcauccuguaccccaaccggcacuucugucgcugugugaagcacggcgagaagugcuccagcagcuccugggacuucgccagcgagaugaagaacuacuacuccgggaagcagggcaaguucaacaaggaccugaaccuagcgcugcagagcauccaccaugccuucagggguaccuccagcuccuacaucgccacgauucugagcgaaaagcggaacgaccagcucguggaguacaugaagaagcugcgcgagaaguuuaucggcaacgcccugcuccgggccguccuggacuuuaucaccuacaugaagucgcugaccgagaugaccaacuucaaacacgaugaauuuugggacgaguucgugcaccucccggcgcccacuaaggcccccagcaugcgccgguccgggaacgagaacuacgacuucaaggcccccaccagcccggccgguaccaaguccugcaagaacaucaagaacguggucugucuaagcccacgcuccggcgccucguacgagggcaucguggcgugcggcgagcccuccgcgccccagaucuucaagaugccuagcgagagcaucuaccacaacaacgccgaccaguccauguacugcaucgccgacacccacugccugcaggacuacagccccguggaggacgaggagcucaacgccaucaagaaguccaagugcugggagacggaguucaccaacgccguccccuucaagcagagcgacgggauccgauccugccgcaugcgggauagcggaaacugcaacgugaccaccaaccuguggcccgugaugcagugugacgacggcaaguucuacuacuccgagcaccagaaggacuacgacaaggaccaggauaucgggcacuucugccugagcccgcgcugcaacaugguacgguuccccaucucggagaagaacauccucgccugcgacuggaucgugagccaccccaacaucgacaaaaucgacgugcacucccuggaggaccuggaacaguacaagaaggccaucacgcagaagcuacagaccagccuguccaucuucaaguaugccaagaccaugaaccugccgcacaucaagcccaucuacaaguacaucagcaucgagggcaccgagacagcugaaggggucgaaaacgccuucaucgagucggagauccccgcgcucgccggcacaagcaucggauucaaggugaacuccaaagacggcaagcacaucauggacaucaucggcuacguuaagacggccagcuacuccagcgucuacaccaagcuguacacgaccgggccuaccacgggcgugaauacgaagcacgacgagcugugcaccgggccgugccccaagcagauugagcacaaaaacggcuggaucaccuucagcaaggagagaaccuccagcugggggugcgaggaguucgggugcuuggcgaucuccgacggcugcguguucgggagcugccaagacaucaucaaggacgagauguccguguaccggaaggagacggaggagaccaccaucguggagcugugccuaaccuucagcgacaagacguacugcguggagcuaaaccccgucacccccaucaucaccgaccuguucgaggugcaguucaagaccguggaguccuacacgcugccgagaaucgucgccgugaaaaaccacgaggugauggucggccaaaucaacgaccucgggguuuacagcaagggcugcgggaacgugcaaaaggucaacggcaccguguacggcaacgggguacccaaguucgacuaccugugucacuuggccucgcggaaggaggucaucauccgcaagugcuucgacaacgacuaccaggccugcaaguuccuccaaagccccuccagcuaccggcuggaggaggacgccuccaccgugagcauuaucgacuacaagaaaauccuggguaccaucaagaugaaagcaauccucggcgacgugcgcuacaagacguucuccgagagcaucgacaucuccgccgagggcacgugcaccgggugcgucaacugcuucgagaacauccacugcgaguucaccauccacagcacggucgaggccuccugccccguggucagcacgugcacccuguuccacgaccggauccugaucggcccggacaaccacaaguacgccaugaaggugaucugcaccgaggcccccaagaccagccuguccuucaaaaucugcaacacgaagguggacgcggccaucaccaucgucgacagcaagcccaucguggagcuggcccccguggaccagaccgccuacauccgcgagaaggacgaccgcugcaagaccuggaugugcagaguccgcgacgagggcaugcagguccugcucgagccguucaagaaccuguucggguccuauaucggcauauucuacacugggcuggcggugcucauaaucgcccugaucgccguguauaucgugaugcccaucugcuucaaggucaaggacauccugaagaagcacgacgacgccuaccggcgcgagcucaagauccgguga

SEQ ID NO: 15892 - RNA, 4329 nt, Artificial Sequence
  derived and/or modified CDS sequence (opt11) from SDNV__AF123490.1__GP
augaucuguauccugcuccugaucgcccuggccagcgcuucccccguguaccagcgcugcuuccaggacggcgccauagucaagcaguacccggccaaggacgccgugaccgaggugugccucaaggacgacgucagcaugauaaagacccaggccaauuacaugaagaauacgaccgggaccuucuccaacaacguggcgaugcggaagugguugguggccgacuggcacgacugccgcccccagaaguccuccggcgggcacaucaacgucaucgagguuggcgacgaccugagccuccacaccgaggccuacauaugcuccgcugacugcgugaucagcaucgacaaggagacggcgcagauccggcugcagaccgauuccaccaaccacuuugaggucagcgggaccacggugaaguccggcugguucaagagcaccaccuacaucacccuggaccagacgugcgagcaucucaagguguccugcggccccaagagcauccaguuccacgccuguuucaaccagcacaugucgugcguccgcuuccugcaccggaccauccugcccgggagcauggccaacuccaucugccagaacaucgagaucaucauccucgugacccugacccugaugaucuucauccuccugacgaucaucagcaagaccuacaucugcuacauacugaugccgaucuucauccccaucgccuacaucuacggguggaucuacaacaaauccugcaagaagugcaagcucugcggguuaguguaccaccccuucaccgaaugcggcacccacugcgucugcggggcccgcuacgaaacgucugaccggaugaagcugcaccgcagcuccggccucugccccggcuacaagagccugcgggcggcccgcgugaugugcaagucccgggggccggcgagcauccuguccauccucaccgccguucugauccugaccuucgucacccccaugucggcccucgugaucggcuccucugaggagcuguacaagcuggacgagcuccccgacgacaugaucgacauggcggagaaggugaaccuguacuaccuggucaucgugcucaacuacuccgccaccugggggcugcugcuccugaugggcauccuggcccuccuguucaagaaguaccagcacaucuuccugaacuacuacgccauguacugcacagagugcgacauguaccacgauaagaaagagcucaccuacaacggcgacagccccaccaacgccuggcagugcacgugcgggcaguacgaagacgcgaccgggcugaucgugcaccagaagucguacaacugccuggucaaguauaaggugaaguggaucaagaacaucuuaaucauguacaucguccugacccugaucaaagacagcgugcucaucgccuccgccgaggggccggacuucgcgaccugcaucgaggagaagacgaucaccuggaacugcaccggccccuuccugaaccuggggcgcugcgacaagacccaaaagaaaacggacuacgcuaccaucgccagccagcugaaggggaucgacgccaucuccauccucgacguucccaugaucagcaagauucccgaggacaucuccggcgcccugaaguacauugagagccugaagaccuaccacgagcagcucaccgccgaguacgcgauguucacccgguacugcgacuacuacacgcaguucuccgacaacagcggguacagccagaccaccuggcgcaccuaccugcggucccacgacuucgagguaugcaucgccuacccgaaccagcacuucugccgcugcgugaagaacggcgagaagugcagcuccgcccagugggacuuugccacggagaucaagggguacuacaccggccggcagaacaaauucaacaaggaccugaaccucgcccugaugaccuuccacaccgcguuccgcgggacggccaccagcuacgugaccgagcugaucuccaaagggaagaacagcucccuccugauguacgccagcgccaucaaguccaaguucaacggcaacgcgcugcucaaggcgcugcuggacuucaugauguaccuccagagucuaggggagaucuccggcuucaaacugaccgacgagugggaggacuucaaguacgaggaggagcccacggagcagacccucaugccccgggggcaccgcggcgggcaguacaacuucaagaacgccgccagcaacggcaagaccaaggucugcaagaacgugaagaaggugcugugccugagcccccggagccgcgccaccuucgacgacgucaucgccugcggcgaacacgcgaacccguccguguacaugaucccuaacacgaccaucuaccagagcaacaccgagcgcucccacuacuguaucgccgacagccacugccucgaggaguacgagcuggugaagcccgagcugcucaccgcccugaagaagucccgguguugggccggggacaucgacacgauaguccugcacaaacaguccgacggccuccgcagcugccggaucaaggacaccggcuccugcaacgugaugggcaacgacuggaccaucgugcugugcgaggacaacaaguacuacuacagcgagguccaccaggacuacgacaaggaccaggacgugggccacuucugccugagcccccgcugcaacaccauccgguacccaaucagcccccgccacaucaacuccugcaaguggcagaucagccacuccacgaucgggaagaucagcgugcacgagcucgcggacaucgagcaguacaagaaggccaucucccagaagcugcagaccagccuauccaucuucaaguacgccaagaccaagaaccucccccacaucaagcccgucuacaaguacaucgccaucgagggcaccgagaccguugaggggguggagaacgccuucauagagagcgagaucccggcgcuugccggcacggccaucggguucaagaucaacuccaaggagggcuaccaccugauggacaucaucggcuacgucaagagcgccuccuacagcuccaccuacaccaagcucuacacgaccgggcccaccaucggcaucaacaccaagcacgacgagaagugcacggggagcugccccggcaccauccaccacaagaccggguggcugaccuucagcaaggagcggaccuccacguggggcugcgaggaguucggcugccuggccgugagcgacgggugcguguacggcuccugccaggacaucaucaaggacgagcucaccgucuaccguaagaucagcgacgaggugaccgaaguggagcugugccugaccuucuccgacaagacguacugcaccaaccucaacgcggucaccccgaucaucaccgacaaguucgaggugcaguucaagacgguggagagcuacucccugccccggaucgucggggugcgaaaccacaagauucaaaucggccagaucaacgacaucgggguguacagcaagggcugcggcaacguccagaaggugaacgggaccaacuacggcaacggggugcccaaguucgacuaccugugccaccucgccucccggaaggaggucaucauccgcaagugcuucgacaacgacuaccaggccugcaaguuccugcagacccccgccagcuaccggcuggaggagcaccaaggcaccgugacgaucaucaacuacaagaagauccucggguccaucaagaugaagccguacugggugaugcugcgcuacaagaacuacgccaacagccuggacaucaacgcagaggggacaugcucuggcugcgucggcugcuucgagaacauccacugcgaguucaccauccacaccacgaucgaggccucuugccagaucgaguccgacugcaccaccuuccacgaccggauccucgugacccccaacgagcacaaguacgcucugaaggugaucugucaugacaaacccaagacgaucuuuaacuucaagaucugcaacaccgagaucgaggccgcgaucgccaucgucgacgccaagcccaucaucgagcuggccccggucgaccagaccgccuacauccgugagaaggacgagcggugcaaaaccuggaugugccgcgugcgggacgagggcauccagguccuccuggagcccuucaagaaccuguucgggagcuacaucggcaucuucuacacgauccucaucgugaucuucauccuggugaucaucaucuacaucauccugcccaucugcuucaagcuccaggacacccugaagcagcacgaggacgcguauaagcgcgagaugaagauccgcuga

SEQ ID NO: 15893 - RNA, 4329 nt, Artificial Sequence; identical to SEQ ID NO: 12607
  derived and/or modified CDS sequence (opt11) from SDNV(BeAr103645)__KX817334.1__GP

SEQ ID NO: 15894 - RNA, 4326 nt, Artificial Sequence
  derived and/or modified CDS sequence (opt11) from SSHV__EU262553.1__GP
augaucugcauccugauccucuucgccgugaccgccgcgucacccgucuaccagcgcugcuuccaagacggcgccaucgugaagcagaacccguccaaggaagccgugaccgaggucugccugaaggacgacgugagcaugaucaagacggaggcccgguacaucaagaacgccaccgggguguucuccaacaaugucgcgauccgcaaguggcuggugagcgacuggcacgacugccggcccaagaagaucaccggugggcacaucaacgugaucgaggucggcgacgaucucucccugcacaccgagagcuacguaugcuccgccgacugcacgaucgggguggacaaggagaccgcccagguccgccugcagaccgacaccacgaaccacuucgagaucgcgggcaccaccgucaaaagcggcugguucaaguccaccacguacaucacccucgaccagaccugcgagcaccugaaggugagcugcgggcccaaguccauccaauuccacgcgugcuuuaaccagcacaugagcugcguucgcuuccugcaccgcaccauccuccccgguuccaucgccaacagcauuugccagaacaucgagaucaucauccuggugacacugacccuccugaucuucauccugcucuccgugcugagcaagaccuacaucugcuaccugcuaaugccggucuucauccccaucgccuacgccuacgggaucaucuacaacaaguccugcaagaaaugcaagcugugcggccugguguaccaccccuucaccgagugcgggacgcacugcgugugcggcgcccgguacgacaccagcgaccgcaugaagcuccaccgggcguccggccugugccccggauacaagagccugcgcgccgcccgggucaugugcaagagcaagggcccggccuccauccucagcgugaucaccgccauccugauccugaccuucgugacgccgaucaacuccauggucgugggggagucgaaggaggucuucgagcucgagcagcugcccgacgacaugcuggauauggcgcuccgcaucaauuucuacuacuuugugugcaucaugaacuacgccgucaccuggggccugaucaucaucggccugcucaucgggcugcuguucaagaaguaccagcaccgguucuccaaccucuacgccauguacugugaggagugcgacauguaccacgacaggagcggccugaagcggaacggggacuucaccaacaagugccgucagugcacauguggccaguacgaggacgccaccgggcugaugacccaccggaagaccuacaacugccucguccgcuacaaggccaagugggugaugaacuuccugaucgcguacaugcugcucacccugaucaaagacuccgccaucgugguccaggccgccggcaccgacuucacaacaugccuggagaccgagaacaucaauuggaacugcaccggccccuuccucaaccuggggaacugccagaagcagcagaaaaaggagccguacgccaacaucgcgacccagcugaagggccuccaggccaucagcgugcuggacaugcccaugaucgccuccauccccgaggacauugccggggcguuacgguacaucgaggagaaggagaccuuccacgugcaacugaccgccgaguacgccaugcucagccgcuacugcgacuacuacgcccaguucuccgacaacagcggcuacucccagaccacguggcgggucuaccugcgcagccacgacuucgacgccugcauccuguaccccaaccagcacuucugccgcugcgugaagcacggggacaaaugcuccagcuccaaccgggacuucgcgaacgagaugaagaacuacuacagcgguaagcagaacaaguucgacaaggaccucaaccuggcccugauggcccuccaccacgccuuccgcggcacauccagcgccuacaucgcgaccaugcugagcaagaaguccaacgacgaccugaucgccuacaccaacaagaucaaggagaaguucccggggaacgcccuccugaaggccaucguggacuacaucgcguacaugaagucccugagcgagaugagcuccuucaaguacgacgaguucugggacgaccuccuguacaagagcgcgcccacgaaagcccccucccugagccggggcagcgagcccagcuacaacuucaagcucgucguguccagccgcuccaucaagagcugcaagaacgugaaguccgucgugugccugagcccgcggucgggggugagcuacgacagcaucaucgccugcggcgaccccaacgggcccuccgucuaccgcaagcccagcgacggcguguuccaguccaacgccgaucagagcaccuacugccuggcggacucccacugccucgaggacuucgagguggucagccaggaggagcuggacgccauaaagaaguccaagugcugggaggccgaguacccggacgugaagcugagcaagcugaccgacggcgugaaguccugccggaugaaggacagcgggaacugcaacgucgccgccaaccgcuggcccaucauccagugcgagaacgacaaguucuacuacuccgagcugcaaaaggacuacgacaaaacccaggacaucggccacuucugccugagccccgggugcuccacggugcgguuucccaucaacccgaagcacaucagcaacugcaacuggcaggucucccgcagcuccaucgcgaagaucgacgugcauaacaucgaggacaucgaucaguaccggaaggccaucacccagaagcuccagaccagccugucccuguucaaguacgccaagaccaagaaccucccccacaucaagcccaucuacaaguacaucacgaucgagggcaccgagaccgccgagggcaucgagagcgccuacaucgagagcgagaucccggcgcuggccgggaccuccaucggcuucaagaucacgagcaaggaggggaagcaucugcuggacgugaucggcuacgugaaguccgccagcuacuccagcaucuacaccaagcuguacaccaccgggcccacguccggcaucaacaccaagcacgacgagcugugcaccggccccugccccgccaagaucaaucaccagaccggguggcucacguucgccaaggagcgcaccagcucauggggcugcgaggaguucgggugccuggcgaucagcgacggcugcgucuucggcuccugccaggacaucauccgggacgagcugaccguguaccgcaaggagaccgacgaggugacggacgucgagcucugccugacuuucagcgacaagaccuacugcaccaaccugaacccuaucacgcccaucaucaccgaccucuucgaggugcaguucaagaccguggaaaccuacucccugccccggaucgucgccauccagaaccacgagaucaagaucggccaggugaacgaccugggcguguacagcaaggggugcggcaacguccagaaggugaacgggacgguguacggcaacgggguccccaaguucgacuaccucugccaccuggccucccgcaaggaggucaucgugcggaagugcuucgacaacgacuaccaggccugcaaguuccugcagucaccggcguccuaccggcucgaggaggacagcggcaccguuaccgugaucgacuacaagaagauccuuggcaccaucaagaugaaagccauccugggggacgugaaguacaagaccuucgccgacaacgucgacaugacggccgagggcuccugcaccgggugcaucaacugcuucgagaacauccacugcgagcucacccugcacaccacgaucgaggccagcugccccaucgugagcacgugcaccguguuccacgaccggauccuggucacccccaacgagcacaaguacgcacucaagguggucugcaccgagaagcccggcaacacccugaccauccgcaucugcaacaccaagguggaggccagucuggcacucguggaugccaagccgauccuggagcuggcccccgucgaccagacggcguacauccgcgagaaggacgagcggugcaagaccuggaugugccgcgugcgggacgaggggcuccaggugauccuggaacccuucaagaaccuguucggcagcuacaucggaaucuucuacaccuucaucaucuccaucaucgcccuccugaucaucaucuacaucguccugcccaucugcuucaagcuccgcgacacccugcggaagcacgaggacgccuacaagcgcgagaugaagauccgguga

SEQ ID NO: 15895 - RNA, 4326 nt, Artificial Sequence; identical to SEQ ID NO: 12609
  derived and/or modified CDS sequence (opt11) from SSHV__K02539.1__GP

SEQ ID NO: 15896 - RNA, 4335 nt, Artificial Sequence
  derived and/or modified CDS sequence (opt11) from SORV__AF123488.1__GP
auggaggugcugucccucaucuggcugcugacccucugcuccgccagccccgucuuccagcgcugcuuccaggacggcgccaucgugaagcaaaacccguccaaggaagcggugaccgaggucugucugaaggacgacgugaguaugaucaagaccgagaccaaguacgugaagaacaccaccgggacguucgccaauaacaucgccaugcggaaguggcugguugccgacuggcacgacugccgcccccaaaaguccagcggagggcacaucaacgugaucgaggugggcgacgaccucucccugcauaccgagagcuacaucugcuccgccgacugcgucaucaccguggacaaggagaccgcgcagauccggcugcagacggacaacaccaaccacuucgagguggccgggaccaccgucaagagcggcugguucaaguccacgaccuacaucacccucgaccagaccugcgagcaccugaaggugucaugcggcccgaaguccauccaguuccacgccugcuucaaccagcacaugagcugcgugcgcuuccugcaccggacgauccuccccggguccaucgccaacucuaucugccagaacaucgagauuaucauccuggucacccugucccucgugaucuucaucuuccugaccaucgugagcaagaccuacaucugcuaccugcucaugccgauuuucauccccaucgcguucaucuacggcuggaucuacaacaagucuugcaagaagugcaagcugugcgggcuggucuaccaccccuucacggaaugcggcacccacugcgugugcggggcccgcuacgagaccagcgaccggaugaaacuccaccgcgccagcggccugugccccggcuacaagucccugagggccgcccgcgugaugugcaagagcaaggggccggcgucaauccucagcauccucaccgccauccugauccucacguucgucacccccaucuccgcaaugguggugggcgagagcaacgagaucuacacccuggaugaccugcccgacgacaugguccaaauggccgagcggaucaacaucuacuaccagauccucaucaucaacuacggggugaccugggccuuccugcugcucggcuuaguccuggcguacuucuucaagaaauaccagcacaaguuccucgacuacuacgccauguacugcgaggagugcgacauguaccacgagaaguccggcaugacguacuggggcgacuucaccaacaagugccgacagugcacgugcgggcaguucgaagacgccaccgggcugauggugcacaagaaguccuacaacugccuggugaaguauaaagccaaguggauccggaacauccucaucgccuaccugaugaucaugcuggucaaggacagccuccuguucgugggcgcgacccgcgccgacuucgccagcugcguggacgagaagacugucaccuggaacugcaccgggcccuuccugaaccucggccggugcgauaagacgcagaagaagaccggcuacaaggacaucgccaaccagcugaaggggcugggcgugaucuccauccucgacauaccgaugaucgagaagaugcccgacgagaucagcgggucccugaaguacaucgacagccuggagaccuaccacgagcagcugacggccgaguacgcguuccucacccgcuauugcgacuacuacacgcaguacaccgacaacuccggcuacagccagaccguguggcggaccuaccugcgcucccacgacuucggggccugcgucguguaccccaaccagcacuuuugccggugcgugaaguacgacgacaagugcaacucugcaaagugggacuucgccaacgagaugaagacguucuacaccggccgcaaggucaaguucaacaaggaccugaaccucgcguuacuggugcuccacaaggccuuccggggcacagggaccgccuacaucgccgaggccauggcgcgcaaggacaacggcucgauggcccacuucgcccuggagauccgcaagaaguuccccacgaacgcccugcuugccgcgcugaucgacuacaucguguaccugcagagccucgccgagaucagcaccuucgagcuugaggaggacugggaggacuucaaguacaagccggagcccaccgaguccacccugcagccccggagccaccgcuccgaccaguacaacuucaagaacgccgacagcaacuccaacgucaaggugugcaagaacgugaagaagguccucugcgugagcccccggucccgcgccaaguucgagaacaucaucgccugcggggagcacgcgaacccgagcguguacaugaugcccaacaucuccaucuaccagagcaacuccgaacggagccacuacugcaucgccgacucccacugccuggaggaguacgaaaucgucaacacggaguuauuaaccgcccuaaagaagucccgcugcugggccaaggaaauggacgacguggugcugcacaagcagagcgacggccuccggagcugccgcaucaaggacacgggguccugcaacguccugggaaaugacuggaccaucgugcugugcgagaacggcaacuacuacuacagcgagauccacaaggacuacgacaaggaccaggacguggggcacuucugccucagcccccggugcuccacgauccgcuaccccaucaaccggcgccacauccggaagugcgacuggcagaucagccacuccaccaucgacaagaucagcguccaggagcuggcggacaucgagcaguacaagaaggccaucucccagaagcugcagaccagccucuccaucuucaaguacgugaagaccaagaaccugccgcacaucaagcccgccuacaaguacaucacgguggaaggaaccgagacaaucgaggggaucgaaaacgccuucaucgagagcgagauccccgcccuggcgggcaccgccaucggcuucaagaucaacucccgcgaggggaacuaccucauggacgucaucggcuacgucaagagcgccuccuacucggccacguacaccaagcuguacaccacagggcccacgauugguaucaacacccggcacgacgagaaguguaccgggccgugccccgugaccaucgaccacaaggacggcuggcugacguucuccaaagagcgcaccagcaccuggggcugcgaggaguucgggugccucgccguguccgacggcugcguguucggcagcugccaggacaucaucaaggacgagcuggcgguguaccggaagacuacggaggagcugaccaccgucgagcucugccugaccuucuccgacaagaccuacugcacgaaccugaacgccaucacccccaucaucaccgacaaguuugaggugcaguucaaaaccguggagagcuacacgcucccgcgcaucaucgccgucaagaaucacgagaucaaggugggccagaucaacgaccucgggguguacuccaaggggugcggcaacguccagaaagugaacggaaccaacuacggcaacggggugcccaaguucgacuaccugugccaccucgccagccggaaggaggucauccugcgcaagugcuucgacaacgacuaccaggccugcaaguuccugcagagccccgcguccuaccgccucgaggagcaccagggcaccgugaccgugaucgacuacaagaaaauccuggggagcaucaagaugaaggccauccugggcgacgucaaguacaagaacuaccaguccaacaucgagaucaacgccgagggcacgugcgccgggugcgugaacugcuucgagaacauccacugcgaguucaccauccacaccaccguggagacgagcugccccaucgucaccgacugcguguccuuccacgaccggauccucaucacccccgacgagcacaaguacgcgcuaaagaucgucugccaggacaagcccaaggugagccugaaguucaagaucugcaacaccaacauugacgcauccaugacgaucguggacagcaaacccauccucgaguuggcccccgucgaccagaccgccuacaucaaggagaaggacgagcgcugcaagaccuggaugugccgggugcgcgacgagggguuccaagugauccuggagccguucaagaaccucuucggguccuacaucggaaucuucuacaccgggauccugagcguuaucugccugcucaucgucaucuacaucgugcugcccaucugcuucaagcugcgggacacgcucaagcagcacgaggacgccuacaagaaggagaugaagauccgcuga

SEQ ID NO: 15897 - RNA, 4335 nt, Artificial Sequence; identical to SEQ ID NO: 12611
  derived and/or modified CDS sequence (opt11) from SORV(SORV-252)__JN815081.1__GP

SEQ ID NO: 15898 - RNA, 4335 nt, Artificial Sequence; identical to SEQ ID NO: 12612
  derived and/or modified CDS sequence (opt11) from SORV(NJO-94F)__KX817337.1__GP

SEQ ID NO: 15899 - RNA, 4323 nt, Artificial Sequence
  derived and/or modified CDS sequence (opt11) from TAHV__AF123485.1__GP
augauguucgugcuguucuucaucgcccucagcgccgcgucccccgucuaccagcgcugcuuccaggacggcgccaucgugaagcagaacccgagcaagcaggccguuaccgaggucugccugaaggacgacguguccaugaucaagaccgaggcccgguacuuccgcaacgccacggggacauacgcgaacaacguggccauccggaaguggcuggucagcgacuggcacgacugucgcccuaagaagguguccggagggcacaucaacgugaucgaggucggcgacgaccucacccuccacaccgaggccuacgugugcaacgccgacugcacgaucgggguugacaaggagaccgcgcagguccggcugcagacagacaccacgaaccacuucgagaucgccggcaccaccgugaaguccggcugguucaaguccaccacguacaucacccucgaccagaccugcgagcaccugaaggugagcugcgggcccaaguccauccaguuccaugccugcuucaaccagcacaugagcuguguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgcauacaucuacggggucaucuacaacaagagcugcaagaagugcaagcugugcggccugguguaccaccccuucaccgagugcgggacgcacugcguaugcggcgcgcgcuacgagaccuccgaucggaugaagcuccaccgcgccucgggccugugccccggguacaagagccugcgggccgcccgugucaugugcaagagcaagggcccggcuagcauccucuccaucaucaccgcggugcugauccugaccuucgucacgcccaucaacgccauggucgccggggacacccaggagaccuucaagcucgaggacuugcccgacgacaugcugagcauggccaugaaggugaacauguacuacaucaugugcaugaucaacuacgccgucaccugguccuucauccucugcgcgcuguuaaucgcccuccuguucaagaaguaccaacacagauuccuaaacuucuacgccauguacugccacgagugcgacauguaccacgaccgcagcggccucaaauacaacggcgacuucacgaacaagugccggcagugcaccugugggcaguaugaggacgccgccggccugcuaacccaccgaaagaccuacaacugccucgugcaguacaaguccaaguggcugacgaacuuccugaucguguacaucauccucaugcuaaucaaggacagcguccugaucgugcacgcggacgggaccgacuucgagaagugcuccggggagguggacaucaccuggaacugcaccgggcccuuccucaaccucgggaacugcgagaagaagcagaagaaggagagcuacaacaacaucgccacgcagcugaagggccucgacgcuaucuccguccuggacaucccgaugaucucuaagauccccgaggacaucgccggggcgcugcgguucaucgaggagcagcgcuccuaccacgugcagcugaccgccgaguacgccaugcucacccgguacugugacuacuacacccaguucaccgacaacagcggcuacucccagacgaccuggagaguguaccugcggagccacgacuucaaggccugcauccuguaccccaaccagcacuucugccgcugcgucaagcacggggacaaguguuccagcuccaacugggacuucgccaacgagaugaagaacuacuacagcggcaagcaguccaaguucgacaaggaccucaaccuggcgcugaugagccuccaccacgccuuccgcggcaccagcuccuucuacaucgccaaacugcugaaggagaagaagaacgaggaccucgugaccuacgccgagaagaucaagggcaaguaccccggcaacgcccugcugaaggcgaucaucgacuacaucaaguacauggaggaccucacggagaugaacaacuucaagcacgacgaaaugugggacgacuucaucuucgaggugccgcccaccaagagccccuccauccggcgguuagagagcuccuacgacuucaagaccaacgucaacagcaaccccucccacaucugcaagaacaucaagaccguugugugccugagcccgaaauccggggugagcuacgacaguaucaucgccugcggugagcccagccagcccuccaucuaccggaagcccgacagccaggucuuccaguccaacgccgaccagacgcacuucugccucagcgacacccacugccuggagaacuacgagaccgugggggaggagaucaucgacgccauaaagaaguccaagugcugggagaccgaguucacagaguauauccaguucaagcagagcgacggcguccggagcugccggaugaaagacuccggggagugcaccgugacuacuaacagauggccgaucauccugugcgacaacgacaaguucuacuacagcgagcuccagaaggacuacgacaaggaccaggacaucggccacuucugccugagcccccguugcaacacgauccgccaccccaucaaccggaagcacaucagcaacugcaccuggcaagucucccacaacaacauugacaagauugaggugcacgagcuggaggaccucgagcaguacaagaaggccaucacccagaagcugcagaccagccugacccucuucaaguacuccaagaccaagaaccugccccacaucaagccuauguacaaguacaucaccaucgagggcaccgagacggcggaggggcuggagagcgccuacaucgaguccgagauccccgccuuagccggcaccagcaucggguucaagaucaccuccaagagcggcaagcaccuccuggacgugaucggcuacgugaaguccgcgagcuacuccgcagucuacaccaagcuguacacgaccgggcccaccaucggcgugaacaccaagcacgacgagcugugcacggggccuugccccgugaacgucccccacggcaccggguggcugaccuucgccaaggagcgcaccagcuccuggggcugcgaggaguucggcugccucgccaucagcgacgggugcguguucggcuccugccaggacaucaucaaggacgagaucacgguguaccggaaggaaaccgaggagaccaccgacgucgagcugugccugaccuucgccgacaagacguacugcaccaaccucaacgcgaucacccccaucauaaccgaccaguucgaggugcaguucaagaccguggaggccuacagccugccgcgcaucaucgccguccggaaccacgagaucaugguggggcaaaucaacgacaucggcguguacagcaaggggugcggcaauguccagaaggugaacaacaccaacuacgguaacggggugcccaaguucgacuaccugugccaccucgccucccgcaaggaggucaucgugcggaagugcuucgacaacgacuaccaggccugcaaauuccugcagacccccgcgagcuaccgccuggaggaggaaggcggguccguaaccgucaucgacuacaagaagauccucggcacgauaaagaugaaggccauccugggggacgugaaguacaagaccuucgccgacaacguggaccugaccgucgagggcguaugcacaggcugcaucaacugcuucgagaacauucacugcgagcugacgauucacagcaccguggaggccucuugccccgucgugagcuccugcaccguguuccacgaccggauccugaucaccccgaacgagcacaaguacgccaucaagguaauuugcaacgagaagcccgggccaacgcugcccuucaagaucugcagcgcgaagaccgacgccgccaugacccucgccgacgcgaagccgauccuggagcuggcccccguggaccagaccacguauaucaaggagaaggacgagcgcugcaagaccuggaugugccgcguccgcgacgaaggcuuucaggugauuuucgagcccuuuaagaaccucuucggguccuacaucggcaucuucuacaccuucaucaucagccugauggccaucuucaucgugaucuacaucguucugcccaucugcuucaagcuacgcgacacccugcggcagcaugaggacgccuacaagcgcgagaugaagauccgguga

SEQ ID NO: 15900 - RNA, 4323 nt, Artificial Sequence
  derived and/or modified CDS sequence (opt11) from TAHV__AF229129.1__GP
augauguucgugcuguucuucaucgcccucagcgccgcgucccccguauaccagcgcugcuuccaggacggcgccaucguuaagcagaacccgagcaagcaggccgugaccgaggucugccugaaggacgacguguccaugaucaagaccgaggcccgguacuuccgcaacgccacggggaccuacgcgaacaacguggccauccguaaguggcuggucagcgacuggcacgacugccgccccaagaagguauccggcgggcacaucaacgugaucgaggucggcgacgaccucacccugcacaccgaggcguacgugugcaacgccgacugcacgaucgggguggacaaggagaccgcgcagguccggcugcaaaccgacaccacgaaccacuucgagaucgccggcaccacagucaagagcggcugguucaaguccaccacguacaucacccucgaccagaccugcgagcaccuuaaggugagcugcgggcccaaauccauccaguuccacgccugcuucaaccagcacaugagcugcgugcgcuuucugcaccggaccaucuuacccggcuccauagccucuuccaucugccagaacguggagaucaucauccugacggugcugacccuccugaucuucauccugcucagcauccuguccaagaccuacaucugcuacauccugaugccgauauucaucccgcucgccuacaucuacggggucaucuacaacaagucuuguaagaagugcaagcugugcggccugguguaccaccccuucaccgagugcgggacgcacugcgugugcggcgcgcgcuacgaaaccuccgaccggaugaagcuccaccgcgccagcggccugugccccggguacaagucccugcgggccgcccgcgucaugugcaagagcaagggcccggccagcauccucuccaucaucaccgcgguucugauacugaccuucgugacgcccaucaacgccauggucgcgggagacacccaggagaccuucaaacuugaggaccugcccgacgacaugcugagcauggccaugaaggugaacauguacuacaucaugugcaugauaaacuacgccgucaccugguccuucauccucugcgcacuacugaucgcccuccuguucaagaaguaccagcaccgguuccugaacuuuuacgccauguacugccacgagugugacauguaccacgaccgcagcggccucaaguacaacggcgacuucacgaacaagugccggcagugcacgugcgggcaguauggcgacgccgccgggcugcugacccaccgcaagaccuacaacugccuaguccaguacaaguccaaguggcugaccaauuuccuuaucggcuacaucauccucaugcugaucaaggacagcgugcugcuaguccacgcggacgggaccgacuucgagaagugcuccggcgaggccgauaucaccuggaacugcaccggcccguuccugagccuggggaacugcgagaagaagcaaaagaaggagucauacaacaacaucgccacgcaacucaagggccuggacgccaucagcgugcuggacaucccgaugaucuccaagauccccgaagacaucgcuggggcccugcgguucaucgaggaacagcgcagcuaccaugugcagcucaccgccgaguacgccaugcugacccgguacugcgacuacuacacccaguucaccgacaacuccggcuacagccagacgaccuggcgcgucuaccugcggucccacgacuucgaggccugcauccucuacccuaaccgccacuucugccgcugcgugaagcacggggacaagugcagcuccagcaacugggacuucgcgaacgagaugaagaacuacuacuccggcaagcagagcaaguucaacaaggaccugaaccuggcccucaugagccugcaccacgcauuccggggcaccuccagcuucuacaucgccaagcugcucaaggagaagaagaacgaggaccuggugaccuacgccgagaagaucaaggggaaguaccccggcaacgcccuguuaaaggccaucaucgacuacaucaaguacaugaaggggcugacggagaugaacaacuucaagcacgacgagaugugggacgacuucaucuucgaggucccgcccaccaagucccccagcgugcgccggcuggaguccagcuacgacuucaagaccaacgugaacuccaaccccagccacaucugcaagaacaucaagaccgucgugugccucucacccaagagcggcguguccuacgacagcaucaucgccugcggggagccgucccagcccagcaucuaccgcaagcccgacagccaggucuuccagagcaacgccgaccagacgcacuucugccuguccgacacccacugccuggagaacuacgagacagugggcgaggagaucaucgacgccaucaagaaguccaagugcugggagaccgaguucacggaguacacccagcucaagcagagcgacggcgugcggagcugccgcaugaaggacagcggggagugcacugucaccacgaaccgguggccgaucauccugugcgacaacgacaaguucuacuacuccgagcugcagaaggacuacgacaaggaccaggacaucggccacuucugccucagcccccgcugcaacaccauccggcaccccaucaaccgcaagcacaucuccaacugcaccuggcaggucaaccacaacaacaucgacaagaucgaggugcacgagcuggaggaccuggagcaguacaagaaggcgaucacccagaagcuccagacgagccugacccuguucaaguacuccaagaccaagaaccucccccacaucaagccgauguacaaguacauaaccaucgaggguacggagaccgccgagggcaucgagagcgccuacaucgaguccgagauccccgcccuggcgggcaccagcaucggguucaagaucaccuccaagagcggcaagcaccuccucgacgugaucggcuacgugaaguccgccagcuacuccgccguguacacgaagcuguacaccaccggccccaccaucggggucaacacgaagcaugacgagcugugcaccggcccgugccccgugaacgugccccacggcaccggguggcucaccuucgccaaagagcggacgagcuccuggggaugcgaggaguucgggugccuggccaucagcgacggcugcgucuucggguccugccaggacauaaucaaggacgagaucaccguguaccgcaaggagaccgaggagaccaccgacguggagcugugccucacguuugcggacaagacguacugcaccaaccugaaugccaucacccccaucaucacggaccaguucgagguccaguucaagaccguggaggccuacagccugccgcggaucaucgccgugaggaaccacgagaucauggucggccagaucaacgacaucggcguauacagcaaggggugcggcaacgugcagaaggucaacaacaccaacuacgggaacggcgcccccaaguucgacuaccucugccaccuggcgucccggaaggaggugaucguucgcaagugcuucgacaacgacuaucaggcaugcaaguuccugcagacgcccgccagcuaccggcucgaggaggagggcggguccgucacggugaucgacuacaagaagauccugggcaccauuaagaugaaggccauccugggggacgugaaguacaagaccuucgccgacaacgucgacuugaccguggagggcgugugcacggggugcgucaacugcuuugagaacauccacugcgagagcacaauccacuccaccguggaggcgagcugccccgugaucuccagcugcaccgucuuccacgaccgcauccugaucacgccgaacgagcacaaguacgccaucaaggugaucugcaacgagaagcccggccccacccugcccuucaagaucugcuccgccaagaccgacgccgcgaugacccucgccgacgccaagccgauccuggagcuggcccccguggaccagacgaccuacaucaaggagaaggucgagcggugcaagaccuggaugugccgcgugcgcgacgagggguuccaggucaucuucgagcccuucaagaaccucuucggcagcuacaucggcaucuucuacaccuucaucaucucccugauggccaucuucaucgugaucuacaucgugcuucccaucugcuucaagcuccgggacacgcugcgccagcacgaggacgcguauaagcgggagaugaagauccgcuga

SEQ ID NO: 15901 - RNA, 4323 nt, Artificial Sequence; identical to SEQ ID NO: 12615
  derived and/or modified CDS sequence (opt11) from TAHV(22595-6)__HM036218.1__GP

SEQ ID NO: 15902 - RNA, 4323 nt, Artificial Sequence; identical to SEQ ID NO: 12616
  derived and/or modified CDS sequence (opt11) from TAHV(92' Bardos)__HM036209.1__GP

SEQ ID NO: 15903 - RNA, 4323 nt, Artificial Sequence; identical to SEQ ID NO: 12617
  derived and/or modified CDS sequence (opt11) from TAHV(92' Bardos)__HM036212.1__GP

SEQ ID NO: 15904 - RNA, 4323 nt, Artificial Sequence
  derived and/or modified CDS sequence (opt11) from TAHV(Souche D C14019-29)__HM036215.1__GP
augauguucgugcuguucuucaucgcccucucugccgcgucucccgucuaccagcgcugcuuccaggacggcgccaucgugaagcagaacccuagcaagcaggccgugaccgaggucugccugaaagacgacguguccaugaucaagaccgaggccagguacuucaagaacgccacggggaccuacgcgaacaacguggccauccgcaaguggcuggugagcgacuggcacgacugccggcccaagaagguauccggcgggcacaucaacgugaucgaggucggcgacgaccucacccugcacaccgaggccuacguuugcaacgccgacugcacgaucgggguggacaaggagaccgcgcagguccgccugcagaccgacaccacgaaccacuucgagaucgcgggcacuaccgugaaguccggcugguucaaguccaccacguacaucacccucgaccagaccugcgagcaccugaaggugagcugcgggcccaaguccauccaguuccacgccugcuucaaccagcacaugagcugcguccgguuccugcaccgcaccauccuccccggcuccaucgccagcuccaucugccagaacguggagauaaucauccugacggugcugacccuccugaucuucauccuccucagcauccuuuccaagaccuacaucugcuacauccugaugccgaucuucaucccccucgccuacauuuacggggucaucuacaacaaauccugcaagaagugcaagcuguguggccugguguaccaccccuucaccgagugcgggacgcacugcgugugcggcgcgcgguacgagaccucugaccgcaugaagcuccaccgagccagcggccugugccccggauacaagucccugcgcgccgcccgggucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuauaucaugugcaugaucaacuacgccgucaccugguccuuuaucuuaugcgcgcugcugaucgcccuccuguucaagaaguaccagcacagauuccugaacuucuacgcaauguacugccacgagugugacauguaccacgaccggaguggccucaaauacaacggcgacuucacgaacaagugccgccagugcacgugcgggcaguacgaggacgccgcuggccugcugacccaccggaagaccuacaacugccucgugcaguacaaguccaaguggcugaccaacuuccuaaucguguacaucauccucaugcugaucgaggacagcguccugaucgugcaugcggacgggaccgacuuugagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauucccgaggacaucgcaggggccuuacgcuucaucgaggagcagcgguccuaccacguccagcugaccgccgaguacgccaugcucacccgcuacugcgacuacuacacucaguucaccgacaacagcggcuacucccagacgaccuggcggguguaccugcgcagccacgacuucgaggccugcauccuguaccccaaccggcacuucugccgcugcgucaagcacggggacaagugcuccagcuccaacugggacuucgcgaacgagaugaagaacuacuacagcggcaagcaguccaaguucaacaaggaccucaacuuagcccugaugagccuccaccacgccuuccgcgggaccagcuccuucuacaucgccaagcugcugaaggagaagaagaacgaggaccucgucaccuaugccgagaagaucaagggcaaguaccccggcaaugcgcugcugaaagccaucaucgacuacaucaaguacaugaaggaccucacggagaugaacaacuucaagcacgacgagaugugggaggacuucaucuucgaggugccgcccaccaagagcccguccgugcggcgacuggagagcucuuacgacuucaagaccaacgucaacagcaaccccucccacaucugcaagaacaucaagaccguggugugccugagcccgaaguccggggugagcuacgacuccaucauagccugcggcgaacccagccagcccuccaucuaccggaagcccgacagucagguguuccaguccaacgccgaccagacgcacuucugccucagcgacacccacugccuggagaacuacgagacugugggggaggagaucaucgacgccaucaagaaguccaagugcugggagaccgaguucacggaguacauccaguucaagcagagcgacggcgucaggucaugccggaugaaggacuccggggagugcaccguggcgaccaaccgcuggccgaucauccugugcgacaacaauaaguucuacuacagcgagcuccaggaggacuacgacaaggaccaggacauaggccacuucugccugagcccccggugcaacaccauccgccaccccaucaaccguaagcacaucagcaacugcacuuggcaggucagccacaacaacaucgacaagaucgaggugcacgagcuggaggaccucgagcaguacaagaaggccaucacccagaagcugcagaccagccugacccucuucaaguacuccaagacgaagaaccugccacacaucaagccgauguacaaguacaucaccaucgagggcaccgagaccgccgaggggaucgagagcgccuacaucgaguccgagauccccgcgcuggccggcacgagcaucggguucaagaucacauccaagagcggcaagcaccuccuggacgugaucggcuaugugaaguccgccagcuacuccgccgucuacaccaagcuguacaccacggggcccaccaucggcgugaacaccaagcacgacgagcucugcaccgggccuugccccgugaacgucccccacggcacgggguggcuaaccuucgccaaggagcgcaccagcuccuggggcugcgaggaguucgguugccuggcgaucagcgacgggugcguguucggcuccugccaggacaucaucaaggacgagauuaccguauaccggaaggagacggaggagaccaccgacgucgagcucugcuugaccuucgccgacaagaccuauugcaccaaccugaacgcaaucacccccaucauuaccgaccaguucgaggugcaguucaagaccguggaggcauacagccugccgcgcaucaucgccguccguaaccacgagaucaugguggggcagaucaacgacaucggcguuuacagcaaggggugcggcaacguccagaaggugaacaacacgaacuacggcaacggggugcccaaguucgauuaccugugccaucuggcgucccgcaaggaggucaucgugcggaagugcuucgacaacgacuaccaggccugcaaguuccuccagacccccgccagcuaccgccuggaggaggagggcggcuccgugaccgucaucgacuacaagaagauccugggcaccaucaagaugaaggccauccucggggacgugaaguacaagacguucgccgacaacguggaccugaccgucgagggcgugugcaccggcugcaucaacugcuucgaaaacauccacugcgaacugaccauccacaguacgguggaggcgucuugccccgucguuagcuccugcaccguuuuccacgaccggauccucaucaccccgaacgagcacaaguacgccaucaaggucaucugcaacgagaaacccgggcccauccugcccuuuaagaucugcagcgccaaaaccgacgccgcgaugacgcuggccgacgccaagccgauccucgaacuggcccccguggaccagaccaccuacaucaaggagaaggacgagcgcugcaagaccuggaugugccggguccgcgacgagggcuuccaggugaucuucgagcccuucaagaaccuguucgggucguacaucggcaucuucuacacguucaucaucagccucauggccauauuuaucgugaucuacauaguccugcccaucugcuucaaaauccgcgacacacugcggcagcacgaggacgcguacaagcgcgagaugaagauccgguga

SEQ ID NO: 15905 - RNA, 4323 nt, Artificial Sequence; identical to SEQ ID NO: 12619
  derived and/or modified CDS sequence (opt11) from TAHV(1014)__GQ386833.1__GP

SEQ ID NO: 15906 - RNA, 4323 nt, Artificial Sequence; identical to SEQ ID NO: 12620
  derived and/or modified CDS sequence (opt11) from TAHV(105)__GQ386829.1__GP

SEQ ID NO: 15907 - RNA, 4323 nt, Artificial Sequence; identical to SEQ ID NO: 12621
  derived and/or modified CDS sequence (opt11) from TAHV(106)__GQ386830.1__GP

SEQ ID NO: 15908 - RNA, 4323 nt, Artificial Sequence
  derived and/or modified CDS sequence (opt11) from TAHV(181)__GQ386831.1__GP
augauguucgugcuguucuucaucgcacucagcgccgcgucccccgucuaccagcgcugcuuccaggacggcgccaucgugaagcagaacccgagcaagcaggccgugaccgaggucugccugaaggacgacguguccaugaucaagaccgaggcccgguauuuccgcaacgccacggggaccuacgcgaacaacguggccauccggaaguggcuggucagcgacuggcacgacugccgccccaagaaggucuccggcgggcacaucaacgugaucgaggucggcgacgaccucacccugcacaccgaggccuacgugugcaacgccgacugcacgaucgggguggacaaggagacggcgcagguccggcugcagaccgacacaacgaaccacuucgagaucgccggcaccaccguaaaguccggcugguucaaguccaccacuuacaucacacucgaccagaccugcgagcaccugaaggugagcugcgggcccaaguccauccaguuccacgccugcuucaaccagcacaugagcugcguccgcuuccugcaccgaaccauccuccccggcuccaucgccagcuccaucugccagaacguggagaucaucauccugacggugcugacccuccugaucuucauccugcucaguauacuguccaagaccuacaucugcuacauccugaugccgaucuucaucccccucgccuacaucuacggggucauuuacaacaagagcugcaagaagugcaagcugugcggccugguguaccaccccuucacagagugcgggacgcacugcgugugcggcgcgcgcuacgagaccuccgaccggaugaagcuccaccgcgccagcggccugugccccgguuacaagucccugcgggccgcccgcgucauguguaagagcaagggcccggcuagcauccucuccaucaucaccgcgguacugauccugaccuucgugacgcccaucaacgccauggucgccggggacacccaggagaccuucaagcucgaggaccugcccgacgacaugcucagcauggccaugaaggugaacauguacuacaucaugugcaugaucaacuacgccgucaccugguccuucauacucugcgcgcugcugaucgcccuccuguucaagaaguaccagcaccgguuccugaacuucuacgccauguacugccacgagugcgacauguaccacgaccgcagcggucugaaauacaacggcgacuucacgaacaagugccggcagugcacgugcgggcaguauggcgacgccgccgggcugcugacccaccgcaagaccuauaacugccucgugcaauacaaguccaaguggcugacgaacuuccugaucggcuacaucauccucaugcugaucaaggacagcgugcugaucguccacgcggacgggaccgacuucgagaagugcuccggcgaggccgacaucaccuggaacugcacaggcccauuccucaaccuggggaauugcgagaagaagcagaagaaggagagcuacaacaacaucgccacgcagcugaagggccucgacgcaaucagugugcuggacaucccgaugaucagcaagauccccgaggacaucgcgggggcccugcgguucaucgaggagcagcgcuccuaccacgugcagcugaccgccgaguacgcuaugcucacccgguacugcgacuacuacacccaauucaccgacaacagcggcuacucccagacgaccuggcgcgucuaccugcggagccacgacuucgaggccugcauccuguaccccaaccgccacuucugccgcugcgugaagcacggggacaagugcuccagcuccaacugggacuucgcuaacgagaugaagaacuacuacagcggcaagcaguccaaguucgacaaggaccucaaccuggcccugaugagccuccaccacgccuuccggggcaccagcuccuucuacaucgccaaacugcugaaggaaaagaagaacgaggaccucgugaccuacgccgagaaaaucaaggggaaguaccccggcaacgcgcugcucaaggccaucaucgacuacaucaaguacaugaaggggcuuacggagaugaacaacuucaagcacgacgagaugugggacgacuucaucuucgaggucccgcccaccaagagccccuccguccgccggcuggagagcuccuacgacuucaagaccaacgugaacagcaaucccucccacaucugcaagaacaucaagaccgucgugugucugagcccgaaguccggcgugagcuacgacaguaucaucgccugcggggagcccagccagccguccaucuaccgcaagcccgacagccaggucuuccaguccaacgccgaccagacgcacuucugccucagcgacacccacugccuggagaacuacgagaccgugggcgaggagaucaucgacgccaucaagaaguccaaaugcugggagacggaguucacggaguacauccaguucaagcagagcgacggcgugcggagcugccgcaugaaggacuccggggagugcaccgucaccaccaaucgguggccgaucauccugugugacaacgacaaguucuacuacagcgagcuccagaaggacuacgacaaggaccaggacauuggccacuucugccugagcccccgcugcaacacgauccgccaccccaucaaccgcaagcacaucagcaacugcaccuggcaggucaaccacaacaacaucgacaaaaucgaggugcacgaacuggaggaccucgagcaguacaagaaggcgaucacacagaagcugcagaccucccugacccucuucaaguacagcaagacuaagaaccugccccacaucaagccgauguacaaguacaucaccaucgaggggaccgaaacggccgagggcaucgaguccgccuacaucgagagcgaaauccccgcccuggcgggcaccuccaucggguucaagaucaccagcaaguccggcaagcaccuccuggacgugaucggguacgucaagagcgccuccuacagugccguguacaccaagcuguacacgaccggccccaccaucggggugaacaccaagcacgaugagcucugcacuggcccgugccccgugaacgugccccacggcaccggguggcugaccuucgccaaggagcggaccuccagcuggggcugcgaggaguucgggugccuggccaucuccgacggcugcgucuucgggagcugccaggacaucauuaaggacgagaucacgguguaccgcaaagagaccgaggagacaaccgacguggagcucugccugaccuucgcggacaaaacguacugcaccaaccugaacgcaaucacccccaucaucaccgaccaguucgagguccaguucaagaccguggaggccuacucccucccgcggaucaucgccguacgcaaccacgagaucauggucggccagauaaacgacaucggcguguacagcaaggggugcggcaacgugcagaaggucaacaacaccaacuaugguaacggcgugcccaaguucgacuaccugugccaccuggccagccggaaggaggucaucguccgcaagugcuucgacaacgacuaccaagcgugcaaguuccuccagacccccgccuccuaccggcuggaggaggagggcgggagcgugacggugaucgacuacaagaagauccugggcacgauuaagaugaaggccauccuuggggacgucaaguacaagaccuucgccgacaacguugaccugaccguggagggcgucugcaccgggugcaucaacugcuucgagaacauccacugcgagcugacgauccacuccaccguggaggccagcugccccguggucuccagcugcaccguguuucacgaccgaauccucaucaccccgaacgagcacaaguacgcgaucaaggugaucugcaacgaaaagcccggccccacgcugcccuucaagauuugcuccgccaagaccgacgccgccaugacccuggcggacgccaagccgauccucgagcuggcccccgucgaccagaccacguacaucaaggagaaggacgagcggugcaagaccuggaugugccgcgugcgcgacgagggguuccaggucaucuucgaacccuucaagaaccuguucggcagcuacaucggaauauucuacaccuucaucaucucccucauggccaucuucaucguaaucuacaucgugcugcccaucugcuucaagcugcgggacacccuccgccagcacgaggacgccuacaagcgggagaugaaaauccgcuga

SEQ ID NO: 15909 - RNA, 4323 nt, Artificial Sequence
  derived and/or modified CDS sequence (opt11) from TAHV(236)__GQ386832.1__GP
augauguucgugcuguucuucaucgcccucagcgccgcgucccccgucuaucagcgcugcuuccaagacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggugggcacaucaacgugauagaggugggcgacgaccucacccugcacaccgaggccuaugugugcaacgccgacugcacgaucggcguggacaaggagaccgcccaggugcggcugcagaccgacaccacgaaccacuucgagaucgcgggcaccaccgugaaguccggcugguucaaauccaccacguacauuacccucgaccagaccugcgagcaccugaagguguccugcgggcccaaguccauacaauuccacgccugcuucaaccagcacaugagcugcguccgcuuccugcaccggaccauccuccccggcuccaucgccagcuccaucugccagaacguggagaucaucaucuugacggugcugacccuccugaucuucauccugcucagcauccuguccaagaccuacaucugcuacauccugaugccgaucuucauccccuuagccuacaucuacggggucaucuacaacaagagcugcaagaagugcaagcugugcggccucguguaccacccauucaccgagugcgggacgcacugugugugcggcgcgcgguacgagaccuccgaccggaugaagcuccaccgcgcgucaggccuguguccgggguacaagucccugcgggccgcccgcgucaugugcaagagcaagggcccggccagcauccucagcaucaucaccgcggugcugauccugaccuucgugacgcccauuaacgccauggucgccggggacacccaagagaccuucaagcucgaggaccugcccgacgacaugcugagcauggccaugaaggugaacauguacuacaucaugugcaugaucaacuacgccaucaccugguccuucauucucugcgcgcugcugaucgcccuccuguucaagaaguaccagcaccgguuccugaacuucuacgccauguacugccacgagugcgacauguaccacgacaggagcggccucaaauacaacggcgacuucacgaacaagugccggcagugcacgugcgggcaguacgaggacgccgccggccugcugacccaccgcaagaccuacaacugccugguccaguacaaguccaaguggcugaccaacuuccugaucguguacaucauccucaugcuaaucaaggacagcgugcugaucguccacgcggacgggaccgacuucgagaagugcuccggcgaggccgacaucaccuggaacugcacugggcccuuccucaaccugggcaacugcgagaagaagcagaagaaggaguccuacaacaacaucgccacgcagcugaagggccucgacgcgaucuccgugcuggacaugccgaugaucagcaagaucccugaggacauagcgggggcccugcgguucaucgaggagcagcgcuccuaccacguucagcugaccgccgaauacgccaugcucacccgguacugcgacuacuacacccaguucaccgacaacagcggcuacucccagacgaccuggcgcgucuaccugcggagccacgacuucgaggccugcauccuguaccccaaccagcacuucugccgcugcgugaaacacggggacaagugcuccagcuccaacugggacuuugcgaacgagaugaagaacuacuacagcggaaagcaguccaaguucgacaaggaccucaaccuggcccugaugagccuccaccacgcuuuccgggggaccagcuccuucuacaucgccaaacugcugaaggagaagaagaacgaggaccucgugaccuacgccgagaagaucaaaggcaaguaccccggcaacgcgcugcugaaggccaucaucgauuacaucaaguacaugaaggaccucacggagaugaacaacuucaagcacgacgagaugugggacgacuucauauucgaggucccgcccaccaagagcccauccgugcggcgccuggagagcuccuacgacuuuaagaccaacgugaacagcaaccccucccacaucugcaagaacaucaagaccgucaucugccuuagcccgaagaguggggugagcuacgacuccaucaucgccugcggcgagcccagccagcccuccaucuaccgaaagccugacagccagguguuccaguccaacgccgaccaaacgcacuucugccuaagcgacacccacugccuggaaaacuacgaaaccgucggggaggagaucaucgacgccaucaagaaguccaagugcugggagaccgagcugacggaguacauccaguucaagcagagcgacggcgugcgcagcugccggaugaaggacuccggggagugcaccgugaccaccaaucgcuggccgaucauccucugcgacaacgacaaauucuacuacucugaacugcagaaggacuacgacaaggaccaggacaucggccacuucugccugagcccccggugcaacacgauccgccaccccaucaaccggaagcacaucagcaacugcaccuggcaggucucccacaacaacaucgacaagaucgagguucacgagcucgaggaccuggagcaguacaagaaggcgaucacccagaaacugcagaccagcuugacgcuguucaaguacuccaagaccaagaaccugccccacaucaagccgauguacaaauacaucaccaucgagggcaccgaaacggccgaggggaucgagagcgccuacaucgaguccgagauccccgcccucgcgggcaccagcaucggguucaagaucaccuccaagagcggcaagcaccuccuggacgucaucggcuacgucaaguccgccagcuacuccgcaguguacaccaagcuguacacgaccgggcccaccaucggcgugaacacuaagcacgacgagcuguguacggggccgugccccgucaacgugccccacggcacuggguggcugaccuucgccaaggagcgcaccagcuccuggggcugcgaggaguucggcugccucgccaucagcgacgggugcguguucggcuccugccaggacaucaucaaggacgagaucacggucuaccggaaggagaccgaggagaccaccgacguggaacugugccugaccuucgcggacaagacguacuguaccaaccucaacgccaucacccccaucaucaccgaucaguucgaggugcaguucaagacggucgaggccuacagccugccgcgcaucaucgccgugcggaaccacgagaucaugguagggcagaucaacgacaucggcgucuacagcaaggggugcggcaacgugcagaaggugaacaacaccaacuauggcaacgggguucccaaauucgacuaccugugccaccucgccucccgcaaggaggugaucgugcggaagugcuucgacaacgacuaccaggcgugcaaguuccugcagacccccgccagcuaccgucuggaggaggagggcuccagcguuaccgugaucgacuacaagaagauccucgggacgaucaagaugaaggccauccugggcgacgugaaguacaagaccuucgccgacaaugucgaccugaccguggagggggugugcaccggcugcauaaacuguuucgagaacauccacugcgagcucacgauccacuccaccgucgaggccagcugccccgugguauccagcugcaccgucuuccacgaccggauccugaucaccccgaacgagcacaaguacgcgaucaaggugauaugcaacgagaagcccggccccacgcugcccuucaaaaucugcuccgccaagaccgacgccgccaugacccucgcggacgccaagccgauccuggagcuggcccccguggaccagacuacguacaucaaggagaaggacgagcgcugcaagaccuggaugugccggguccgcgacgagggguuccaggugaucuucgagccauucaagaaccucuucggcagcuacaucgggaucuucuacaccuucaucaucucccugauggccaucuucaucgucaucuacaucgugcugcccaucugcuucaaguuacgcgacgcccugcggcagcacgaggacgcguacaagagagagaugaagauccgguga

SEQ ID NO: 15910 - RNA, 4323 nt, Artificial Sequence; identical to SEQ ID NO: 12624
  derived and/or modified CDS sequence (opt11) from TAHV(29)__GQ386823.1__GP

SEQ ID NO: 15911 - RNA, 4323 nt, Artificial Sequence; identical to SEQ ID NO: 12625
  derived and/or modified CDS sequence (opt11) from TAHV(4019)__GQ386834.1__GP

SEQ ID NO: 15912 - RNA, 4323 nt, Artificial Sequence; identical to SEQ ID NO: 12626
  derived and/or modified CDS sequence (opt11) from TAHV(4020)__GQ386835.1__GP

SEQ ID NO: 15913 - RNA, 4323 nt, Artificial Sequence; identical to SEQ ID NO: 12627
  derived and/or modified CDS sequence (opt11) from TAHV(4030)__GQ386836.1__GP

SEQ ID NO: 15914 - RNA, 4323 nt, Artificial Sequence; identical to SEQ ID NO: 12628
  derived and/or modified CDS sequence (opt11) from TAHV(4033)__GQ386837.1__GP

SEQ ID NO: 15915 - RNA, 4323 nt, Artificial Sequence; identical to SEQ ID NO: 12629
  derived and/or modified CDS sequence (opt11) from TAHV(4034)__GQ386838.1__GP

SEQ ID NO: 15916 - RNA, 4323 nt, Artificial Sequence; identical to SEQ ID NO: 12630
  derived and/or modified CDS sequence (opt11) from TAHV(4057)__GQ386839.1__GP

SEQ ID NO: 15917 - RNA, 4323 nt, Artificial Sequence; identical to SEQ ID NO: 12631
  derived and/or modified CDS sequence (opt11) from TAHV(4060)__GQ386840.1__GP

SEQ ID NO: 15918 - RNA, 4323 nt, Artificial Sequence; identical to SEQ ID NO: 12632
  derived and/or modified CDS sequence (opt11) from TAHV(5060)__GQ386841.1__GP

SEQ ID NO: 15919 - RNA, 4323 nt, Artificial Sequence; identical to SEQ ID NO: 12633
  derived and/or modified CDS sequence (opt11) from TAHV(76)__GQ386824.1__GP

SEQ ID NO: 15920 - RNA, 4323 nt, Artificial Sequence
  derived and/or modified CDS sequence (opt11) from TAHV(83)__GQ386825.1__GP
augauguucgugcuguucuucaucgcccucagcgccgcguccccugucuaccaacgcugcuuccaagacggcgccaucgugaagcagaacccgagcaagcaggccgugacggaggucugccugaaggacgacguguccaugaucaagaccgaggcccgguacuuccgcaacgccacggguaccuacgcgaacaacguggccauacggaaguggcuggucagcgacuggcacgacugccgccccaagaagguguccggcgggcacaucaacgucaucgaggucggcgacgaccucacccugcauaccgaggccuaugugugcaacgccgacugcacgaucgggguggacaaggagaccgcgcagguccggcugcagaccgacaccacgaaccauuucgagaucgccggcaccacagugaaguccggcugguucaaguccaccacauacaucacccucgaccagacgugcgagcaccugaaggugagcugcgggcccaaguccauccaguuccacgcaugcuucaaccagcacaugagcugcguccgcuuccugcaccggaccauccuccccggcuccaucgccagcuccaucugccagaacguggaaaucaucauccugacagugcugacccuccugaucuucauccugcucagcauccuguccaagaccuacaucugcuacauccugaugccgaucuucaucccccucgccuacaucuacggggucaucuacaacaagagcugcaagaaguguaagcugugcggccugguguaccaccccuucaccgagugcgggacgcacugcgugugcggcgcgcgcuacgagaccuccgaccggaugaagcuccaccgcgccagcggccugugccccggguacaaaucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaucugcccgaugacaugcugagcauggcgaugaaggugaacauguacuacaucaugugcaugaucaacuaugccgucaccugguccuucauccucugcgcgcugcugaucgcccuccuguucaagaaguaccaacaccgguuccuuaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagacguacaacugccucgugcaguacaaguccaaguggcugacgaacuuccugaucguguacaucauccucaugcugaucaaggauagcguccugaucgugcacgcggacgggaccgacuucgagaagugcuccggcgaggccgacaucaccuggaacugcacugggcccuuccucaaccugggcaacugcgagaagaagcagaagaaagaaagcuacaacaacaucgccacgcagcugaagggccucgacgccaucuccgugcuagacaucccgaugaucagcaagauccccgaggacaucgcgggggcccugcgguuuaucgaggagcagcgcuccuaucacguccagcugaccgccgaguacgccaugcucacccgguacugcgacuacuacacccaguucaccgacaacagcggcuacucccagacgaccuggcgcguguaccugcggagccaugacuucgaggugugcauccuguaccccaaccagcacuucugccggugcgucaagcacggggacaagugcuccagcuccaacugggacuucgccaacgagaugaagaacuauuacagcggcaagcaguccaaguucgacaaggaccucaaccuggcacugaugagccuccaccacgcauuccgcgggaccagcuccuucuacaucgccaaacuucugaaggagaagaagaacgaggaccucgugaccuacgccgagaagaucaagggcaaguaccccggcaacgcucugcugaaggcgaucaucgacuacaucaaguacaugaaggggcucacggagaugaacaacuucaaacacgacgaagugugggacgauuucaucuucgaggucccacccaccaagagcccuuccgugcggcgccuggagagcuccuacgacuucaagaccaacgugaauagcaaccccucccacaucugcaagaacaucaagaccgucgugugccugagcccgaaguccggggugagcuacgacuccauaaucgccuguggggagcccucucagcccuccaucuaccggaagcccgacagccaggucuuccaguccaacgccgaccagacgcacuucugcuuaagcgacacccacugccuggagaacuacgagaccgugggggaggagaucaucgacgccaucaagaaguccaagugcugggagaccgaguucacggaguacauccaguucaagcagagcgacggugugagaagcugccggaugaaggacuccggagagugcaccgucaccaccaaccgcuggccgaucauccugugcgacaacgacaaguucuacuacagcgagcuccagaaggacuacgacaaggaucaggacaucggccacuucugccugagcccccggugcaacacgauacgccaucccaucaaccggaagcacaucagcaacugcaccuggcaggucucacacaacaacaucgacaagaucgaggugcacgaacuggaggaccucgagcaauacaagaaggccaucacccagaagcugcagaccagccugacccucuucaaguacuccaagaccaagaaccugccccacaucaaaccaauguacaaguacaucaccaucgaggggaccgagacggcggagggcaucgagagugccuacaucgaguccgagauccccgcccuagccgggaccagcaucggcuucaaaaucacauccaagagcggcaagcaccuccuggacgugaucggguacgugaaguccgcgucauacuccgccguguauaccaagcuguacacgaccggccccaccaucggggucaacaccaagcacgacgagcuaugcacgggcccgugccccgugaacgugccccacgggaccggcugguugaccuucgccaaggagcgcaccagcuccuggggcugcgaggaguucgggugccuggccaucagcgacggcugcgucuucggguccugccaggacaucaucaaggacgagaucacgguguaccggaaggagaccgaggagaccaccgacguggagcucugccugaccuucgccgacaagacguacugcaccaaccugaacgcaaucacccccaucaucaccgaccaguucgagguccaguucaagacgguggaggccuacagccugccgcgcaucaucgccguccggaaccacgaaaucauggucggccagaucaacgacaucggaguguacagcaagggcugcggcaacgugcagaaagucaacaacaccaacuacgggaacggcgugcccaaguucgauuaccugugccaccuggccucccgcaaggaggugaucguccggaagugcuucgacaacgauuaccaagccugcaaguuccuccagacccccgcgagcuaccggcuggaggaagagggcggcuccgugaccgugaucgacuacaagaagauccuggggacgaucaagaugaaggccauccucggcgacgucaaguacaagaccuucgccgacaacguggaccugaccguggagggcgucugcaccgggugcaucaacugcuucgagaacauccacugcgagcugacgauccacagcaccguggaggccuccugccccgugguuagcuccugcaccguguuccacgaccggauccuuaucaccccgaacgagcacaaguacgccaucaaggucaucugcaacgagaagcccggccccacgcugcccuucaagaucugcagcgcgaaaacagaugccgccaugacccuggccgacgcgaagccgauccucgagcuggcccccguggaccagaccacguacaucaaggagaaggacgagcgcugcaagaccuggaugugccgggugcgggacgagggguuucaggucaucuuugagcccuucaagaaccuguucggcuccuacaucgggaucuucuacaccuucaucaucagccucauggccaucuucaucgugaucuacaucgugcugcccaucugcuucaagcugcgcgacacccuccggcagcacgaggacgccuacaagcgcgagaugaagauccgguga

SEQ ID NO: 15921 - RNA, 4323 nt, Artificial Sequence; identical to SEQ ID NO: 12635
  derived and/or modified CDS sequence (opt11) from TAHV(89)__GQ386826.1__GP

SEQ ID NO: 15922 - RNA, 4323 nt, Artificial Sequence
  derived and/or modified CDS sequence (opt11) from TAHV(90)__GQ386827.1__GP
augauguucgugcuguucuuuaucgcccucagcgccgccucccccgucuaccagcgcuguuuccaggacggcgccaucguaaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguggccggcggccacaucaacgugaucgaggucggcgacgaccucacccugcacaccgaggccuacgugugcaaugcggacugcacgaucgggguggacaaagagaccgcccaggucagacugcagaccgacaccacgaaccacuucgaaaucgccggcaccaccgugaaguccggcugguuuaagagcaccacguacaucacacucgaccagaccugcgaacaccugaagguuuccugcgggcccaagagcauccaguuccacgccugcuucaaccagcacauguccugcguccgcuuccugcaccggaccauccuccccggcagcaucgccuccagcaucugccagaacguagagaucauaauacugacggugcugacccuccugaucuuuauccugcucuccauccugagcaagaccuauaucugcuacauccugaugccgaucuucaucccccucgcguacaucuacggggucaucuacaacaaguccugcaagaagugcaagcugugcggccugguguaccaccccuucaccgagugcgggacgcacugcgugugcggcgcccgcuacgagaccagcgaccggaugaagcuccaccgcgccuccggccugugccccggguacaagagccugcgggccgcccgcgucauguguaaguccaagggcccggcgaguauccucagcaucaucaccgccgugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccuggagcuucauccucugcgcccugcugaucgcccuccuguucaagaaguaccagcaccguuuccugaacuucuacgccauguacugccacgagugcgacauguaccacgaccgcuccggccuaaaguacaacggcgacuucacgaacaagugccggcagugcacgugcgggcaguacgaggacgccgcgggccugcugacccaucgcaagaccuacaacugccucgugcaguacaagaguaaguggcugaccaacuuccugaucggguacaucauccucaugcugaucaaggacuccgugcugaucguccacgccgacggcaccgacuucgagaagugcucgggggaggcagacaucaccuggaacugcaccggccccuuccucaaucugggcaacugcgagaagaagcagaagaaggaguccuacaacaacaucgccacgcagcugaaggggcucgacgcgaucagcguucuggacaucccgaugaucucgaagauccccgaggacauagccggcgcccugcgguucaucgaggagcagcgcagcuaccacgugcagcugaccgccgaguaugccaugcucacacgguacugcgacuacuacacccaguucaccgacaacuccggguacagccagacgaccuggcgcgucuaccugcggucccacgacuucgaggcgugcauccuguacccaaaccagcacuucugccgcugcgugaagcacggcgacaagugcagcuccagcaacugggacuucgccaacgagaugaaaaacuauuacuccgggaagcagagcaaguucgacaaggaccucaaccuggcccucaugucccuccaucacgccuuccgcgggaccagcagcuucuacaucgccaagcugcugaaggagaagaagaacgaggaccucgugaccuacgcagagaagaucaaggggaaguaucccgggaacgcccugcugaaggccaucaucgacuauaucaaguacaugaagggccucacggagaugaacaacuucaagcacgacgagaugugggacgacuucaucuucgaggucccgccgaccaagucccccagcguacggcgccuggaguccagcuacgacuucaagaccgacgugaacuccaaccccagccacaucugcaagaacaucaagaccgucgugugccugucccccaagagcgggguguccuacgacagcaucauagccugcggcgaaccgucccagcccucgaucuaccggaagcccgacucccaggucuuccagagcaacgccgaccagacgcacuucugccuauccgacacccacugccuggagaacuacgagacggugggggaggagaucaucgacgcgaucaagaaguccaagugcugggagaccgaguucacggaguacauccaguucaagcagagcgacggugugcgcagcugccggaugaaggacagcggcgagugcaccgucaccaccaaccgcuggccgaucauacugugcgacaacaacaaauucuacuacagugagcuccagaaggacuacgacaaggaccaggacaucgggcacuucugccugagcccccggugcaacacgauccgccaccccaucaaccggaagcacaucuccaacugcaccuggcaggucaaccacaacaacaucgacaagaucgaggugcacgagcuggaggaccucgagcaguacaagaaagccaucacccagaagcuacagaccagccugacccucuucaaguacuccaaaaccaaaaaccugccccacaucaagccgauguacaaguacaucaccaucgagggcaccgagacggccgaggggaucgagucugccuacauugaguccgagauccccgcucuggccggcaccagcaucggcuucaagaucaccuccaagagcgggaagcaccuccuggacgugaucggcuaugugaaguccgccagcuacuccgccguguacaccaagcuguacacgaccgggcccaccaucggcguuaacaccaagcacgacgagcucugcacggggccgugccccgugaacgugccacacggcaccggcuggcugaccuucgccaaggagcgcacuagcuccugggggugcgaggaguucggcugccuggcgaucagcgacgggugcgucuucggcucaugccaagacaucaucaaggacgagaucacgguguaccggaaggagaccgaggagaccaccgacguggaacugugccugaccuucgccgacaagacguacugcaccaaccugaacgccgucacccccaucaucaccgaccaguucgaggugcaguucaagacgguggaagccuacagccucccgcgcaucaucgccguccggaaccacgagaucaugguggggcagaucaacgacaucggcguguacuccaagggcugcgggaacguccagaaggugaacaacaccaacuacggcaacggggugcccaaguucgacuaccugugccaccuggcgagccgcaaggaggucaucgugcggaagugcuucgacaacgacuaccaggccugcaaguuccuccagacccccgccagcuaccgccuggaggaggagggcggguccgugaccgucaucgauuacaagaagauccugggcacgaucaagaugaaggccaucuugggcgacgugaaguacaagaccuucgcugacaacguggaccugaccgucgagggggugugcaccggcugcaucaacugcuucgagaacauccacugcgagcugacgauccauagcaccgucgaggcguccugccccgucgugagcuccugcaccgccuuccacgaccggauccucaucaccccgaacgagcacaaguaugccaucaaggugaucugcaacgagaagcccggccccacgcugccauuuaagaucugcagcgccaagaccgacgcggccaugacccuggccgacgccaagccgauccucgagcuggcccccguugaccagaccacguacaucaaggagaaggacgagcgcugcaagaccuggaugugccgggugcgcgacgagggcuuccaggucaucuucgagcccuucaagaaccuguucggguccuacaucggcaucuucuacaccuucaucaucagccucauggcgaucuucaucgugaucuacaucgugcugcccaucugcuucaagcugcgcgauacccuccggcagcacgaggacgccuacaagcgcgagaugaagauccgguga

SEQ ID NO: 15923 - RNA, 4323 nt, Artificial Sequence; identical to SEQ ID NO: 12637
  derived and/or modified CDS sequence (opt11) from TAHV(94)__GQ386828.1__GP

SEQ ID NO: 15924 - RNA, 4323 nt, Artificial Sequence; identical to SEQ ID NO: 12638
  derived and/or modified CDS sequence (opt11) from TAHV(XJ0625)__EU622819.2__GP

SEQ ID NO: 15925 - RNA, 4323 nt, Artificial Sequence; identical to SEQ ID NO: 12639
  derived and/or modified CDS sequence (opt11) from TAHV(XJ0708)__HM243138.1__GP

SEQ ID NO: 15926 - RNA, 4323 nt, Artificial Sequence; identical to SEQ ID NO: 12640
  derived and/or modified CDS sequence (opt11) from TAHV(XJ0710)__HM243141.1__GP

SEQ ID NO: 15927 - RNA, 4326 nt, Artificial Sequence; identical to SEQ ID NO: 12641
  derived and/or modified CDS sequence (opt11) from TVTV__AF123491.1__GP

SEQ ID NO: 15928 - RNA, 4335 nt, Artificial Sequence
  derived and/or modified CDS sequence (opt11) from TVTV(AR42)__KX891322.1__GP
augcggaacaugaucguguucgcccugcucaccaucgucgccgcgagcccgguguacaagcggugcuuccaggauggcgccaucgugcgccaggaguacuccaagaacgccgucaccgaggugugccugaaagacgacgugagcaugaucaagacggaggccgaguacuucaagaacuccaccggggucuucagcaagaacaucgccuaccggaagugguuaguauccgacuggaacgagugcagaccgcagaaguccgcgaacggccacaucaacgugaucgagguccagcccgaccucucccugcagaccaacagcuacguuugcgccgcgaccugcgugaucuccaucgacaaggagacggcccaagucaggcugcagaccgacaccaccaaccacuucgaaaucagcgggacgaccgugaaguccggcugguucaagagcaccaccuaccucacgcuggaccagaccugcgagcaccugaagaucucaugugggagcaagucugugcagcuccacgccugcuucaaccagcacaugagcugcguacgcuuccugcaccggaccauccugcccggaaauaucgccaacucaaucugccagaacaucgagaucaucauccucaccagccugucccuguucaucuuccucuuccugacgaucaucagcaagaccuacaucugcuacguucugauccccaucuucaucccgaucgccuacguguacggcuucaucuacaacaagagcugcaaaaagugcaagcucugcgggcuggucuaucaccccuucaccgagugcggcucccacugcgugugcggggccaaguacgacaccagcgaccgcaugaagaugcaccgguccagcggccugugccccggguacaagucccuccgcgccgcgcggagcaugugcaaguccaagggccccgccagcauccugucccuguuaagcgccgugcugauccugacguucgucaccccgaucaccgccaucucccucaaggacgaggagaaagagaccuacaagcugagcgagcugcccgacgacauggugaaccucgagaacaagaucgaccuguacuuccagaugugccugaucaauuacgccacgaccugggcgcucaucuucugcgcccugaucaccgccugccuguucaagaagcuccagcacaaguuccuggacuacuacgccguguacugccacgagugcgacauguaccacgagcgccguggccugaaguauaacggggacuucuccaacaaaugccgccagugcacgugcggccaguacgaggacgccacugggcuccugacccaccgcaagagcuacaacugccugguccaguacaaggcgaaguggaugcucaacuuccugaucaccuacgccauccuggugaucauaaaggauuccgucaugaucgugggcgcgagcgacaccgacguaaaggacugccucgaccaggaggagaucacguggaacugcaccggccccuuccugaauaugggguccugcacccggccccagaagaaggagaacuacggcaacauagccacccagcucaaggggcucgacguccugagcgcccuggacaugccggcgguuggcaagauccccgaggacaucgccggggcccuguccuacaucgagagcaagaagacguaccacgagcagcucacccuggaguucgccaugcugacccgguacugcgacuucuacaagcaguacgcggacaacagcggcuacucccagaccaccuggcgcgccuacaucaggagccacgacuucggcgugugcaucauguaccccaaccagcacuucugccgcugcgucaagaugggggagaagugcacguccagcaacugggacuuugccaaccagauggccaacuacuauaacggcaagcagaaccgguucaacaaggaccucaaccuggcccuguacaccaugcaccacgcguuccgcggguccaccagcuaccucaucuccaaggugcugcacgagaagaaguacgaccagcuuaccaaccuccugacgcagcugaagaccaaguaccccggcaacgcccuccugaaggccuuaaucgacuaccagaucuaccucaagagccuguccgagaugagcuccuucaccccggacgagcugugggacgaccuccaguacgugcccgcccccacauucaagcccaaccuggggcgcagcgaggacaacgaguauaaguucgacaagucccggaucgucgacccgcagacgaccugcaccagccugaagggcgugaacugccucagcccccgcagccgggccuccgugagcgacaucaucgcgugcggccaggccacccagcccgcccuguucuacguccccaacgacaagauccaccagagcaacacggaccagaaccaguacugcaucggggauucccacugccugaccaaguucaccccgaucaccgaggagcuccuggccgccgugaagaaguccaagugccaggcauucgaccuggacgacaucgugaaaacgucccccagcaccggcguccgcuccugccucgugaagaaguucggcaacugcaacaccaccaaccagguguggcccaucacgaucugcagcgacgaccaguacuacuacacggacaccaagcaguccuacgacucgaaccaggauaucggccacuucugccugagccccagaugcagcaccauccgcuauccggucaaccccaagcaccuauccgccuguacauggaccgaggaguacacccccguagacaagaucagcgugaccaacaucgaggagaucgagcaguacaagaaggcccugcugcagaagcugcagacugggcucaacaucuucaaguacaagaagaccuccaaccugccacacaucaagcccauguacaaguacaucaccguccagggcaccgagacggccgaggggguggagaacgcguacaucgagagcgagaugcccgcccuggccggguccagcucgggcuucaaggugcucagcaaagaggggaaccaccuguucgacgucguggccuacaucaaguccgccagcuacagcuccguguacaauaagcuguacagcaccggcccaacucucgggaucaacgucaagcacgacgagaagugcaccgggccgugcccggcgaacaucccccacaagacgggcuggcugaccuucgcccgggagaggaccuccaccugggggugcgaggaauacggcugccuggccaucagcgacgggugcguguucggcuccugccaggacaucauuaagcccgagaugaccguguaccggaagcagacggacgagaucgucaccguggaguuaugccugaccuucguggacaagaccuacugcacggaacucaacgccgucaccccgaucaucagcgaccucuucgaggugcaguucaaaaccguggaguccuacagccugcccaagaucgucgcgaucaagaaccaccagaucuucgugggccagaucaacgacaucgggaccuacuccaagggcugcgggaacgugcagguuuucaacggcacgaacuacgggagcggcacgccccgcuucgacuaccugugccaccucgcgucccggaaggaggugaucaugcgcaagugcuucgacaacgacuaccaggccugcaaguuccugcagcagccaagcuccuuccggcuggaggaggagggcgagaccgugaccaucaucgacuacaagaagauccucgggaccaucaagaugaaggccaucuucggcgaugucaaguacaagaccuucagcgagaagguagacaucaacgccgagggggugugcgccggcuguaucaacugcuucgaguccaucaacugcgaguucaccauccacagcacagucgagacguccugcccgcugguggccgacugccagcuguuccacgaccgccuccugaucacccccaacgagcacaaguacgccaucaaggccaucugcaaggacaagcccagcaacacccugcgguucuccaucuguaacaccaaggucgaggccacggucaccaucaucgacgcgaagcccauccucgaacuggccccgguggaccagaccgccuacaucaaggagaaggacgagcgcugcaagaccuggcugugccggguuaaggacgagggggucgccgugcuccuggagcccuucaagaaccuguucggcagcuacaucggcaucuuuuacgggaucauccucgucgugcuggccauccuggugugcaucuacaucguccuccccgugugcuucaagauccgcgacacgcugaagaagcacgaggacgcguacaagcgggagaugaagauccgcuga

SEQ ID NO: 15929 - RNA, 4335 nt, Artificial Sequence; identical to SEQ ID NO: 12643
  derived and/or modified CDS sequence (opt11) from TVTV(Eklund)__KR149248.1__GP

SEQ ID NO: 15930 - RNA, 4335 nt, Artificial Sequence; identical to SEQ ID NO: 12644
  derived and/or modified CDS sequence (opt11) from JCV(3324-04)__HM007357.1__GP

SEQ ID NO: 15931 - RNA, 4335 nt, Artificial Sequence
  derived and/or modified CDS sequence (opt11) from JCV(61V2235)__U88058.1__GP
auggaggugcuaaaccucaucuggcugcuggcccuaugcuccgccucccccgucuuccaacgcugcuuccaggacggcgcgaucgugaagcagaacccaagcaaggaagccgugaccgaggugugccugaaggacgacguuuccaugaucaaaaccgaggcuaaauacguaaagaacacgaccgguaccuucgccaacaacauagcuaugcggaaguggcuggucgcggauuggcacgacugccgcccccagaaguccuccggcgggcacaucaacgugaucgaggugggcgacgaccucagccugcacaccgaguccuacauaugcagcgccgauugugugaucacgguggacaaagagaccgcccaaauccggcugcagaccgacaacaccaaccacuucgagguggccgggacgaccgucaaguccggcugguucaagagcaccaccuacaucacgcucgaccagaccugcgaacaccugaagguguccugcggccccaagagcauccaguuccacgcgugcuucaaccagcacauguccugugugcgcuuccugcaccgcaccauccuccccgggagcaucgccaacuccaucugccagaacaucgagaucaucauucugguaacccugagccucgucaucuucaucuuucuguccaucgugagcaagacauacgucugcuaccugcucaugccgaucuucacccccaucgccuucaucuacggcuggguguacaacaaguccugcaagaagugcaagcugugcgggcuuguguaccaucccuucaccgagugcggcacccacugcgucugcggggcccgcuacgaaaacagugaccggaugaagcuccaccgcgccagcggucugugccccggcuacaagagccugcgggcagcccgcgugaugugcaagagcaaggggccggccuccauucucucuaucaugacggccauacucauccugaccuucgugacccccaucagcgccauggucaucggcgagagcuccgagcucuacacccuggacgaccugcccaacgacauggugcaaauggcggagcgggucaacaucuacuaccagaucacgaucaucaacuacggggucaccugggccuucuuuugccucggccugauacuggccuacuuuuucaagaaauaccaacacaaguuccucgacuucuacgccauguacugcgaggagugcgacauguaccacgagaaguccggccugacccacuggggcgacuucaccaacaagugccgccagugcacgugcgggcaguucgaggauguggccgggcugaugauccacaagaaguccuacaacugccucgucaaguacaaggcgaaguggauccgggacauacugauuaucuaccuggcuaugauccucaucaaggacagccugcuguucgugggcgccagcgggaccgacuucgccgccugcaucgacgagaagguggucaccuggaacugcaccggccccuuccugaaccucggacgcugcgacaaaagccagaagaaggcguccuacgccgggaucgccgaccaacugaagggccucggggugaucucugugcuggacaucccgaugaucaagaacaugccggacgagaucuccggcagccugaaguacaucgauucacucgagacguaccacgagcagcugaccgccgaguacgccuuccugacccgguacugcgacuacuacacccaguacacggacaagagcggguacucccagaccgucuggcgcaccuaccugcggagccacgauuucggggcaugcgugguguaccccaaccagcacuucugccgcugcguuaaguacggcgacaagugcaacagcgccaagugggauuucgccaacgagaugaagaccuucuacaccgggcagaaggugaaguucaacaaagaccucaaccuggcccuguuggugcugcacaaagcguucagaggcacggggaccgccuacgucgccgaggccauggcccgcgaagauaacggcuccauggcgcacuucgcccuggagauccggaagaaguuccccaccaacgcccuccuggccgcccugaucgauuacaucguguaccuccagagccugggggagaucgcgaccuucgagcuggacgaggacugggaggacuucaaguacaagccggagcccacggaguccacgccccaggugcgcagccaccguaacgaccaguacaacuucaagaacgccgaguccaacagcgacaccaaggucugcaagaacgugcagaaggugcucugcaucagcccccggagcaaggccaaauucgagaacaucaucgccugcggcgagcacgcgaacccguccgucuacaugaugcccaacgugagcaucuaccaauccaacagcgagcgcucccacuacugcaucgcuggcagccacugccuggagaaguacgagguggucgagaccgagcugcuuaacgcccuaaagaaguccaagugcugggccaaggagauggacgauaucauccugcauaagcagagugacgggcuccgguccugccgcaucaaagacaccggcaacugcaacguccaggagaacgacuggaccaucguucugugcgagaacgggaacuacuacuacagcgagguucacaaggacuacgacaaggaccaggacgugggccacuucugccugagcccccggugcaccaccauucgcuaccccauuagcaagcggcauaucaagaagugcgaguggcagaucagccacuccacgaucgacaagaucagcgugcaggagcucgcggacaucgagcaguacaagaaagcgaucucccagaagcugcagaccagccuguccaucuucaaguacgucagaaccaagaaccucccgcacaucaagcccgccuacaaguacaucaccguggagggcguggagacgaucgaggggaucgagaacgcauucauugaaagcgagauccccgcccuggcgggaacggcuauaggguucaagaucaacucccgggagggcaacuaccugauggacgucaucggguacgucaagagcgccuccuacuccgccguguacaccaagcucuacaccaccggccccaccaucggcaucaacaccaaacaugaugagaagugcaccgggccgugccccgccaucaucgaccacaaggacggcuggcugacguucuccaaggagcguaccagcaccugggguugcgaggaguucggcugccuugccgucuccgacgggugcguguucggcucgugccaggacauuaucaaggacgagcucgcggucuaccggaagaccacggaggagcugaccaccgucgagcugugccuaaccuucuccgacaagacguacugcaccaaccugaacgcaaucacccccaucaucacugauaaguucgaggugcaguucaagacgguggagagcuacacccugccgcgcguaaucgcaaucaagaaccacgagaucaaggugggccagaucaacgaccucgggguguacuccaagggcugcgggaacguccaaaagguuaacggcacgaacuacgggaacggcagcccucgguucgacuaccugugccaccuggcuagccguaaggaggugauccugcggaagugcuucgacaaugacuaccaggcguguaaguuccuccagucacccagcuccuaucgccuggaggagcaccagggcaccgucaccgugauugacuacaagaagauccucgguacaaucaagaugaaagccauccugggcgacgugaaguacaagaacuaccagaacaacaucgagauuuccgccgaggggaccugcgcaggcugcauagacugcuucgagaacauccacugcgaguucaccauccacaccacggucgaggccuccugccccaucaccacugagugcgugagcuuccacgaccggauccugauaaccccggacgagcacaaguacgcgcucaagauugucugccacgacaagcccaaggugucccugaaguucaagaucugcaacacgcacguggacgccgccaugaccauuguagacagcaagcccauccuggagcucgcccccguggaccagacgaccuacauccgcgagaaggacgagcggugcaagacguggaugugccgcgugcgcgacgagggcuuucaggucauccuggagccguucaagaaccuguucggcuccuauaucggcaucuucuacacugggauccucagcaucaucugccugcugauugucguauacaucauccuacccaucugcuucaagcugcgggacacccugcgccagcaugaggacgccuacaagaaagagaugaagauccgguga

SEQ ID NO: 15932 - RNA, 4335 nt, Artificial Sequence; identical to SEQ ID NO: 12646
  derived and/or modified CDS sequence (opt11) from JCV(61V2235)__HM007351.1__GP

SEQ ID NO: 15933 - RNA, 4335 nt, Artificial Sequence
  derived and/or modified CDS sequence (opt11) from JCV(61V2235)__KX817316.1__GP
auggaggugcugaaccucaucuggcugcuggcccucugcagcgccagccccgucuuccagcgcugcuuucaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcucggccgacugcgucaucacgguggacaaggagaccgcccagauccggcugcagaccgacaacaccaaccacuuugagguggccggcacgaccgucaaguccggcugguucaagagcaccaccuacaucacgcucgaccagaccugcgagcaccugaagguguccugcggccccaagagcauccaguuccacgcgugcuucaaucagcacaugagcugcgugcgcuuccugcaucggaccauucuccccgggagcaucgcuaacucuaucugccagaacauagagaucaucauccuggucacccugagccucgugaucuucaucuuccuguccaucgugagcaagacguacgucugcuaccuguugaugccaauuuucauccccaucgccuucaucuacgguuggguguacaacaaguccugcaagaagugcaaacugugcgggcugguguaccaccccuucaccgagugcggcacccacugcgucugcggggcccgcuacgagaccagcgaccggaugaagcuccaccgcgccagcgggcucugccccggcuacaagucccugcgggcggcccgcgucaugugcaagagcaaggggccggccuccauccucagcaucaugacggccauacugauccugaccuucgugacccccaucuccgcgauggucaucggcgagagcucggagguguacacccucgacgaccugccaaacgacaugguccagauggcggagcgggugaacaucuacuaccagaucaucaucaucaacuacggugugacgugggccuuccugcuccugggccugauccucgccuacuucuucaagaaguaccagcacaaguuccuggacuucuacgccauguacugcgaggagugcgacauguaccacgagaaauccgggcugacccacuggggcgacuucaccaacaagugccgccagugcacgugcgggcaguucgaggacgucgccggacucaugauccacaagaaguccuacaacugccuggugaaguacaaagcgaaguggauccgggacauccugaucaucuaccucgccaugauccugaucaaggacagccugcuguucguaggcgccagcgguaccgacuucgccgccugcaucgacgagaaggucgugaccuggaacugcaccggccccuuccugaaccugggccgcugcgacaaaagccacaagaaggcauccuaugccgggaucgccgaccagcucaagggccugggggugaucagcguccuggacaucccgaugaucaagaacaugcccgacgagaucuccggcagccucaaguacaucgacucccuggagaccuaccacgagcagcugacggccgaguaugcguuccugacacgguacugcgacuacuacacccaguacaccgacaacagcggguacucccagacgguguggcgcaccuaccuccggagccacgacuucggcgccugcguggucuaccccaaccagcacuucugucgcugcgugaaguacggcgacaagugcaacagcgccaagugggacuucgccaacgagaugaagaccuucuauaccgggcagaaggugaaguucaacaaggaucugaaccuggcccuccugguccugcacaaggcguuccggggcaccgggacggccuacguggccgaggccauggcucgcaaggacaacggcuccauggcgcacuucgcccucgagauccggaagaaguuccccaccaacgcccugcuggccgcccucaucgacuacauugucuaccugcagagccugggggagaucgcgaccuucgagcucgacgaggacugggagggcuucaaauacaagccggaacccaccgaguccacgccccagguccgcagccaccgcaacgaccaguacaacuucaagaacgccgaguccaacagcgacaccaaggugugcaagaacgugcagaagguccugugcaucagcccccggagcaaggccaaguucaagaacaucaucgccugcggcgagcacgcgaacccguccguguacaugaugcccaacgugagcaucuaccaguccaacagcgagcgcucccacuacugcaucgccgacagccacugccuggagaaguaugaggucguggagacggagcuccugaacgcccugaagaaguccaagugcugggccaaggagauggacgacaucauccuccacaagcagagcgacgggcugcgguccugcagaaucaaggacaccggcaacugcaacgugcaggagaacgacuggacgaucguccugugcgagaacgggaacuacuacuacagcgaggugcacaaggacuacgacaaggaccaggacgugggccacuucugccucagcccccggugcaccacuauccgcuaccccaucuccaagcggcacaucaagaagugcgaguggcagaucagccacuccacuaucgacaagaucuccguccaggagcuggccgacaucgagcaguacaagaaggcaaucucccagaagcugcagacgagccucuccaucuucaaguacgugcgcacgaaaaaccugccgcacaucaagcccgccuauaaguacaucaccguggagggcgucgagacuaucgaggggaucgagaaugccuucaucgagagcgagauccccgcccuggccggcacggcgaucggguucaagaucaacucccgggagggcaacuaccucauggacgugaucggguacgucaagagcgccuccuacagcgccguguacaccaagcuguacaccaccggccccacgaucggcaucaacaccaagcacgacgagaagugcaccgggccgugccccgccaucaucgaccacaaggacggcuggcugaccuucuccaaggagcgcacgagcaccugggggugcgaggaguucggcugccucgccguguccgacggcugcguguucggcagcugccaagacaucaucaaggacgagcuggcggucuaccggaagaccaccgaggagcugacgaccguggaacucugccugaccuucuccgacaagaccuacugcacgaaccugaacgccaucacccccaucaucaccgacaaguucgaggugcaguucaagaccgucgagagcuacacgcucccgcgcgugaucgccaucaaaaaccacgagaucaaggugggccagaucaacgaccuuggggucuacuccaagggcugcgggaacgugcagaaggugaacggcaccaacuacgggaacggcagcccccgguucgacuaccugugccaccucgccagccgcaaggaggucauccugcggaagugcuucgacaacgacuaccaggcgugcaaguuccuacagucccccagcuccuaccgccucgaggagcaccagggcaccgugaccgugaucgacuacaagaagauccuggggaccaucaagaugaaggccauccugggcgacgucaaguacaagaacuaccagaacaacaucgagaucaacgccgaagggacgugcgccggcugcaucgacugcuucgagaacauccacugugaguucaccauccacaccaccguggaggccagcugccccaucacgaccgagugcgucuccuuccacgaccggauccugaucaccccggacgagcacaaguacgcguugaagaucguuugccacgacaagcccaaggugagccugaaguucaagaucugcaacaccaacgucgacgccgccaugacgaucguagacuccaaacccauccuggagcuggcccccguggaccagaccaccuacauccgcgagaaggacgagcggugcaagaccuggaugugccgcguccgcgacgagggguuccaggugauccuggagccguucaaaaaccucuucggcagcuacaucggcaucuucuacacggggauccuguccaucaucugccugcucaucguggucuacaucauccugcccauaugcuucaagcugcgggacacccuccgccagcacgaggacgccuacaagaaggagaugaagauccgguga

SEQ ID NO: 15934 - RNA, 4335 nt, Artificial Sequence; identical to SEQ ID NO: 12648
  derived and/or modified CDS sequence (opt11) from JCV(3573-03)__HM007354.1__GP

SEQ ID NO: 15935 - RNA, 4335 nt, Artificial Sequence; identical to SEQ ID NO: 12649
  derived and/or modified CDS sequence (opt11) from KEYV(KEYV/Ochlerotatus atlanticus/USA/KEYVLK01/2005)__KT630289.1__GP

SEQ ID NO: 15936 - RNA, 4332 nt, Artificial Sequence; identical to SEQ ID NO: 12650
  derived and/or modified CDS sequence (opt11) from KEYV(KEYV/Ochlerotatus atlanticus/USA/KEYVLK01/2005)__KT630289.1__GP

SEQ ID NO: 15937 - RNA, 4332 nt, Artificial Sequence
  derived and/or modified CDS sequence (opt11) from KEYV(KEYV/Ochlerotatus atlanticus/USA/KEYVLK02/2005)__KT630292.1__GP
augaucuggauccugcucaccguggucaccgccacgaucgccaaccccguguaccagcgcugcuuccaggacggcgcgaucgugaagcagaacccgucaaaggaggccgucaccgagguuugccugaaggacgacguguccaugaucaagaccgaagccaaguacgugaaaaaccugaccgggacguucagcaacaacguggcaaugcggaaguggcucguggccgacuggcacgacugccgcccccagaagcgggcgggagggcacaucaacguaaucgaagugggcgacgaccugucccugcacaccgagucauacaucugcuccgcagacugcgugaucagcgucgacaaggagaccgcccagauccgccuccagaccgacacgaccaaccacuucgagguggccgggaccaccgugaaguccggcugguucaagagcacgaccuacaucacccuggaccagaccugcgagcaccugaaggucuccugcggccccaagagcauccaguuccacgcgugcuucaaccagcacauguccugcgugcgguucuuacaccgaacgauccugcccggaagcaucgccaacuccaucugccagaacaucgagaucauaauccuggugacccucacccugcugaucuucauccuccugagcauccuguccaagaccuacaucugcuacauccuuaugccgaucuucauccccaucgccuacaucuacggcugggucuacaacaagagcugcaagaagugcaagcugugcggacugguguaccaccccuucacggagugcggcacccacugcgugugcggggcccgguacgagacauccgaccgaaugaagcuccacagagccucaggccugugccccggcuacaagucccugcgcgcggcccgggucaugugcaagagcaaggggccggccagcauccuuucgauccugaccgccguucugauccucaccuucaucaccccaaugaacgccauggugcugggcagcuccgaggaggucuacaagcuggaggaccuccccgacgacaugcugaacauggcggagaagaucgacaucuacuaccugagcaucguacugaacuacuccaccaccugggggcugcugauccuccugcugaucgucagcugccucuucaagaaguaccagcacguguuccugaacuacuacgccauguacugccacgaaugcgauauguaccacgagaagaagaaccugguguacaacggcgacuucuccaacaagugccgccagugcacgugcggccaguacgaggacgccaccgggcucaucguccaccagaaguccuacaacugccugaucaaguacaaggccaagugguucaucaacaucuuaaucaucuacaccauccucguucugcugaaggacuccgugcucauggccgcggccgagggccccgacuucaacacgugcaucgaacagcggucuaucucccugaacugcaccgguccguucaucaaccugggcgggugcgagaaaccccagaagcgcgccagcuaccaguccaucgccgagcagcugaaggccaucaacgcgaucagcauccucgacaugcccaugaucuccaagauccccgacgacaucagcggcgcccugcggcacauagagaaccugaagaccuaccacgagcagcucaccgccgaguucgccaugcuuacccgcuacugcgacuacuacacgcaguucuccgacaacagcggcuacucucagaccagcuggcggaccuaccugcgcagccacgacuucgaggucugcaucgcguacccgaaccagcacuucugccggugcgugaagaacggggagaagugcaccuccgccaacugggacuucgcaaacgagaugaagaacuacuacaccggcaagcaaauccgcuucgacaaggaccucaaccuggcccuuacgacccuccacaccgccuuccgggggaccagcacguacuacauguccgacauccuggcggagaccaaggccaacagccugcgcgacuacgcucucgcccugaagaguaaguaccccggcaacgcccugcucaaggcgauccuggacuucaucauguaccugcagagccucaacgaggccaccaaguucaagcuguccagugacugggaggacuucaaguacaacuccgagcccgaggcccgcgcccugaugccccgagcccggagcuccggggacuacaacuucagcaacgcggaguccaccaacaaggccaagguaugcaagaacauccagcgggucaugugccucagcccgcgcuccaaggccacgguggaggacauuaucgccugcggcgagcacgagcaccccagcguguacaugguccccaacaccaccguguaccaguccaacaucgagcggagccacuacugcaucgcggacagccacugccuggaggaauacgagcuggugcagaacgagcuacugaccgcccugaagaaguccacgugcuggaccggcgagcucgagaacgucaucccccacaagcagucugacgggacccgcuccugccggaccaagaacacgggccgcugcaacgugaagggggaggacuggaccguuauccugugcgagaacgacaaguacuacuacagcgagcugaacaaggacuacgauaaggaccaggacaucggccacgucugccucucaccgcggugcaacagcauccgcuaccccauuagcccccggcacaucaccaacugcaagugggagaaccccgccgggaccaucagccgcaucgagacgcacucccuggccgacaucgagcaguacaagaaggccaucagccagaagcugcagaacucccucaccaucuucaaguacgagaagaccaagaaccugccgcauaucaagcccaucuacaaguauaucaccaucgagggcacggagacaguggagggcguggagaacgcguucaucgaggccgagauccccgcccuggccgggaccagcaucggcuucaaggucaacucccgggacggggaccaccucauggacaucaucgccuacaucaagguggcgagcuacuccagcaccuacacgaagcuguacaccaccggcccgaccaucggcaucaacacgaagcacgacgagaagugcaccgggaacugccccgcccgccuggagcacaaggugggcuggcucaccuucgccaaggagcggaccuccacguggggcugcgaggaguucggcugccuggccgucagcgacgggugcguguucggcuccugccaggacaucaucaaggaggagcugagcguguaccgcaaggacaccgaggaggucaccaacguggaacucugccugaccuuugccgacaagaccuacugcacgagccugaaugcgaucacccccaucaucaccgagaaguucgaggugcaguucaagaccgucgaguccuacagccucccacggaucgugggcauccgcaaccacgaaauccggaucgggcagaucaacgaccugggcuccuacagcaaggguugcggcaacgugcagcgcgucaacgacacgaacuacgguuccggccagccgaaguucgacuaccugugccaccucgccagccgcaaggaggugaucgugcggaagugcuucgacaacgacuaccaggccugcaaguuccugcagacccccucuagcuaccgccuggaggagcacgaaggcaccgucaccaucaucgacuacaagaagauccucgggacgaucaagaugaaggcaauccugggcgacgugcgguauaagaacuacgcguccgccaucgacaucaacgccgagggggugugcgccggcuguaucaacugcuucgagaacauccacugcgaguucaccauccacaccaccaucgaggccagcugccccaucgaguccgacugcgucagcuuccacgaccgcaugcuggugacgcccaacgagcacaaguacgcgcucaagcugaucugcgaggacaagccgggguccacccugaaauucaagaucugcaacaccaagaucgacgccgccaugacccucguggacgccaagccaauccuggagcuggcccccgucgaccagacggcguacauccgugagaaggacgagcgcugcaagaccuggaugugccgggugcgcgacgaaggcaucaaggugcuccuggagcccuucaaaaaccuguucggcagcuacaucgggaucgucuacuccaucauccucaucaucaucgccgccaucaucaucaucuacguaauccugccgaucugcuucaagcugcgggacacccucaagaagcacgaggacgcuuaccgcaaggagaugaagauccgguga

SEQ ID NO: 15938 - RNA, 4332 nt, Artificial Sequence; identical to SEQ ID NO: 12652
  derived and/or modified CDS sequence (opt11) from KEYV(C14031-33)__AF123489.1__GP

SEQ ID NO: 15939 - RNA, 4326 nt, Artificial Sequence; identical to SEQ ID NO: 12653
  derived and/or modified CDS sequence (opt11) from LACV(Human/78)__NC_004109.1__GP

SEQ ID NO: 15940 - RNA, 4326 nt, Artificial Sequence
  derived and/or modified CDS sequence (opt11) from LACV__KP271111.1__GP
augauccgcauccuggugcucaucgccgucaccgccgcgagccccguauaccagcggugcuuccaggacggcgccaucgugaaacagaacccguccaaggaagccgucaccgaggugugccugaaggacgacgugagcaugaucaagaccgaggccagguacguccggaacgccaccgggguguucucgaacaacguggcuauccgcaaguggcuggucagcgacuggcacgacugccggcccaagaagaucaucggcgggcacaucaacgugaucgaggugggcgacgaccucucccugcacacugaguccuacgucuguucggccgacugcagcaucgggguggacaaggagaccgcccaggugcgccugcagacggacaccaccaaccacuucgagaucgccggcaccacggucaaguccggcugguucaagagcaccaccuacaucacccucgaucagacgugcgagcaccugaaaguguccugcgggcccaagagcgugcaauuccacgcgugcuucaaccagcacauguccugcguccgguuccugcaccgcaccauccuccccggcagcaucgccaacuccaucugccaaaacaucgagaucaucauccuggugacccugacccuccugaucuucauccugcucagcauccuguccaagacguacaucuguuaccugcucaugccgaucuuuaucccaaucgccuacauguacgggaucaucuacaacaaaucgugcaagaagugcaaguugugcggccugguguaccaccccuucaccgagugcgggacccacugcgucugcggcgcccgguacgacaccuccgaccgcaugaagcuccaccgggccagcggccugugccccggguacaagagccugcgcgcggcccgggugaugugcaaguccaagggcccggccagcaucuuguccaucaucacggccgugcugguccugacuuucgugacccccaucaacagcaugguccucggggaguccaaggaaaccuucgagcuggaggagcugcccgacgacaugcucgagauggccagccgcaucaacuccuacuacuuuaccugcauccugaacuacgcggugagcuggggccuggugaucaucggccugcugacugggcuccuguucaagaaguaccagcaccgguuccugaaugucuacgccauguacugcgaggagugcgacauguaccacgacaaguccggcuugaagcgccacggggacuucaccaacaagugccggcaguguacgugcggccaguacgaggacgccgccgggcucauggcacaccgcaagaccuacaacugucuggugcaguacaaggcgaaguggaugaugaacuuccugaucaucuauaucuuccucauccugaucaaggacagcgccaucgugguccaggccgccggcaccgacuucacgaccugccuggagaccgaguccaucaacuggaacugcaccggccccuuccucaaccuggggaauugccagaagcagcagaagaaggagccguacaccaacaucgccacccaacugaaaggccucaaggcgaucagcgugcuggacauccccauaaucacggggauacccgacgacaucgccggagcucugcgguauaucgaggagcgcgaggacuuccacgugcagcugaccaucgaguacgccaugcucuccaaguacugcgacuacuacacucaguucagcgacaacuccggguacucucagaccaccuggcgggucuaccugcgcucccacgacuucgaggcgugcauccuguaccccaaccagcacuucugccgcugcgugaagaacggcgagaagugcagcuccagcaacugggacuucgccaacgagaugaaggacuacuacagcggcaagcagaccaaguucgacaaggaccucaaccuagcccugaccgcccuccaccacgccuuccgggggacuuccagcgcguauaucgccaccaugcuguccaagaaguccaacgacgaccugaucgccuacacgaacaaaauuaaggccaaguucccgggcaacgcccuccugaaggcgauaaucgacuacaucgccuacaugaagucccugcccgggauggccaacuucaaauacgacgaguucugggacgagcuccuguacaagcccaaccccgccaaggccagcaaucuggcgcgcggcaaggagagcagcuacaacuucaagcucgccaucuccagcaaguccaucaagaccugcaagaacgugaaggacgucgccugccugagcccccgguccggggccaucuacgcgagcaucaucgccugcggcgagcccaacggccccuccguguaccgcaagcccagcgggggcguguuccaguccagcaccgaucggagcaucuacugccugcucgacucccacugccuggaggaguucgaggccaucaaccaggaggagcuggacgccgucaagaaguccaagugcugggagaucgaguacagcgacgugaagccgcuccaggagggggacggcaccaaaagcugccgcaugaaggacuccggcaacugcaacguggccacgaaccgguggcccgucauccagugcgaaaacgacaaguucuacuacagcgagcugcagaaggacuacgacaagacccaagacaucggucacuacugccuguccccuggcuguaccaccgugcgcuaccccaucaacccaaagcacaucagcaacugcaacuggcaggucucccggagcuccaucgcgaagaucgacgugcacaacaucgaggacaucgagcaguacaagaaggccaucacgcaaaagcugcaaaccagccugucccuguucaaguacgccaagaccaagaaccuuccccacaucaagccaaucuacaaguacaucaccaucgaggguacggagaccgccgagggcaucgagagcgccuacaucgaguccgaggugccggcgcuagccgggaccagcaucggcuucaagaucaacuccaaggagggcaagcaccuccuggaugugaucgcuuacgucaagagcgcguccuacagcagcguguacgccaagcuguacuccaccgggcccacgagcggcauaaacaccaagcacgacgagcugugcaccgggcccugccccgcgaacaucaaccaccaggugggcuggcucaccuucgccaaggagcgcacguccagcugggggugcgaggaguucggcugccuggccgucuccgacggcugcguguucgggagcugccaggacaucaucaaggaggagcuguccguguaccggaaggagaccgaggaggucaccgacguggagcucugccugaccuucuccgacaagacguacugcaccaaccugaacccggugacccccaucaucaccgaccucuucgagguccaguucaagacgguggagaccuacucccugccccgcaucguggccguccagaaccacgagaucaagaucggccagauuaacgaccuggguguguacagcaagggcugcgggaacgugcagaagauuaacggcacggucuacggcaacggggugccccgguucgacuaccucugccaccuggcgucccgcaaggaggugaucgucaggaagugcuucgacaacgacuaccaggccugcaaguuccugcagagcccggccuccuaccgccucgaggaggacagcggcaccgugacgaucaucgacuacaagaagauccuggggaccaucaagaugaaggccauccugggcgacgugaaguacaagaccuucgccgacucuguugauaucaccgcggaggggagcugcaccggcugcaucaacugcuucgaaaacauccacugcgagcucacgcugcacaccaccaucgaggccuccugccccaucaagagcuccugcaccgucuuccacgaccggauccuggugacgcccaacgaacacaaguacgcccucaaaaugguuugcacugaaaagcccggcaacacccugaccaucaaggugugcaacacgaagaucgaggccagcauggcccugguggacgcgaagccgaucaucgagcuugcccccgucgaccagaccgccuacauacgcgagaaggacgagcgcugcaagaccuggaugugccgcgugcgcgacgaggggcugcaggucauccuggagcccuucaagaaccucuucggcagcuacaucgggaucuucuacaccuucaucaucuccaucguggcccugcuggugaucgucuacgugcuccugcccauuugcuucaagcugcgggacacgcuccgcaagcacgaggaugccuacaagcgggagaugaagauccgcuag

SEQ ID NO: 15941 - RNA, 4326 nt, Artificial Sequence
  derived and/or modified CDS sequence (opt11) from LACV__M87664.1__GP
augaucugcauccucgugcucaucaccgucgccaccgccagccccguccugcagcgcugcuuccaggacggggcgaucgugaagcagaauccauccaaggaggccuucacggaggucugccugaaggacgacgugagcaugaucaagaccgaggcccgguacgugcgcaacgccaccggggucuucuccaacaacguggccauccggaaguggcucgugagcgcguggcacgacugccgccccaagaagauugucggcgggcacaucaacgugaucgaggugggcgaugaccugucccugcacaccgagagcuacgucugcuccgccgacugcacgauugggguggacaaggagaccgcccaggugcggcuccagaccgacaccacgaaccacuucgagaucgccggcaccaccgucaagagcggcugguuccgcuccaccacguacaucacccuggaccagaccugcgagcaccugaaggugagcugcgggcccaaguccgugcaguuccacgcgugcuucaaccagcacaugagcugcguccgguuccuccaccgcaccauccugccccgcuccaucgcgaacuccaucugccagaacaucgagaucaucauccuagugacgcucacccugcugaucuucauccuacuguccauccugagcaagaccuacaucugcuaccuccugaugccaaucuucauccccaucgccuacaucuacggcaccaucuacaacaaguccugcaagaagugcaagcugugcgggcuagcccaccaccccuucacggagugcggcacccauugcgugugcggggcccgcuacgacaccagcgaccggaugaagcugcaccgcgcguccggccuaugccccggcuacaagagccuccgggccgcccgcgucaugugcaagagcaagggcccggccuccauccugagcaucaucaccgccgugcuggugcucacguucgucacccccaucaacucgauggugcugggcgagagcaaggagaccuucgagcuggaggaccuucccgacgacaugcuggagauggcguccaggaucaacucauacuacccgaccugcauccuuaacuacgccgucuccugggggcucgugaucaucggccugcugaucggccuccuguucaagaaguaccagcaccgcuuccugaacguguacgccauguacugcgaggagugcgacauguaccacgacaaguccggggucaagcggcacggcgacuucacgaacaagugccgccagugcacgugcgggcaauacgaggacgccgccggccucauggcgcaccggaagaccuacaacugccuggugcaguacaaggccaaguggaugaugaacuuccugaucaucuacaucuuccucauccugaucaaggacuccgccaucgugguccaggcggccgggaccgacuuuacgaccugccuggagaccgagagcaucaacuggaacugcaccggcccuuuccucaaccugggcaacugccagaagcagcagaagaaggagcccuacaccaacaucgcgacccagcugaaggggcucaaggccauauccgugcuggacauccccaucaucaccggcauccccgacgacaucgccggugcccugcgcuacaucgaggagaaggaggacuuccacgugcagcugaccaucgaguacgcgaugcucagcaaguacugcgacuacuacacccaguucuccgacaacagcggcuacucccagacgaccuggcgggucuaccugcguagccacgacuucgaggccugcauccuguacccgaaccagcacuucugccgcugcgugaagaauggggagaagugcuccucauccaaccgggacuucgccaacgagaugaaagacuacuacagcggcaagcagaccaaguucgacaaggaucucaaccuggcccugaccgcccuccacagccaggugaugcacugcuccagcgcguacaucgccacgaugcuguccaagaaguccaacgacgaccugaucgccuacaccaacaagaucaagaccaaguuccccggcaacgcccuccugaaggccaucaucgacuacaucgcguacaugaagucccugcccgggauggccaacuucaaguacgacgaguucugggacgagcuccuguacaagcccaacccggccaaagccagcaaccuggcccgcggcaaggagagcagcuacaacuucaagcucgcgaucuccagcaaguccaucaagaccugcaagaacgucaaggauguggcuugccugagcccccgguccggggccaucuaugccuccaucaucgcgugcggcgagcccaacgggcccuccguguaccgcaagccgagcggcggcgucuuccaguccagcacggaccggagcaucuacugccuguuagacucccacugccuggaggaguucgaggcuaucagccaggaggaacuggaugccgugaagaaguccaagugcugggagaucgaguaccccgacgugaagcucauccaagagggggacggaaccaagagcugccgcaugaaggacuccgggaacugcaacgucgcgaccaaccgguggccagugacccagugcgagaacgacaaguucuacuacagcgaccugcagaaggacuacgacaaaacgcaggacaucggccacuacugccugucccccggcugcaccaccgugcgcuacccgaucaaccccaagcacaucagcaacugcaacuggcaggucucccggagcuccaucgccgagaucgacgugcacaacaucgaagacaucgagcaguacaagaaggcgaucacccagaagcuccagacgagccugucccuguucaaguacgccaagaccaagaaccucccccacaucaagccgaucuacaaguacaucaccaugaaggggaccgagacggcagagggcaucgagagcgccuacaucgaguccgaggugcccgcccuggcggggaccagcaucggcuucaagaucaacuccaaggaagggaagcaccuccuggacgucaucgccuacgucaagagcgccuccuauagcaguguguacaccaagcuguacuccaccggccccacgagcggcaucaacaccaagcacgacgagcugugcaccgggcccugcccggccaacaucaaucaccaggugggcuggcucaccuucgcccgcgagcggacgucuagcugggggugcgaggaguucggcugccuggcggugucggacggcugcgucuucggcagcugccaggauaucaucaaggaggagcuguccgucuaccgcaaggagaccgaggaggugaccaacguggagcucugccugaccuucagcgacaagacguacugcaccaaccugaaccccgucacccccauuaucaccgaccucuucgaggugcaguucaagacgguggagaccuacucccugccccggaucgucgccgugcagaaccaugagauaaagauaggccagaucaacgaccuggggguguacagcaaaggcugcgggaacguccagaaggugaacggcaccaucuacgggaacggcgugccgcgcuucgauuaccucugccaccuggccucccggaaggaggucaucgugcguaagugcuuugacaacgacuaccaggccugcaaguuccugcagagccccgcguccuaccggcucgaggaagacagcggcaccgugaccaucaucgacuacaagaagauccuggggacgaucaagaugaaggccauccugggcgacgucaaguacaagaccuucgccgacuccguggacaucaccgccgaggggagcuguaccggcugcauuaacuguuucgagaacauccacugcgagcucacgcugcacacgaccaucgaggccuccugccccauaaagagcucuugcaccguguuccacgaccgcauccuggucacgcccaacgagcacaaguacgcccucaagauggugugcaccgagaagccggggaacacccugaccaucaagguguguaacacgaagaucgaggccagcauggcccuggucgaugccaagcccaucauagagcucgcccccguggaccagaccgcguacauccgggagaaggacgaacgcugcaagaccuggaugugccgcgucagagacgagggccuccaggugauccuggagcccuuuaagaaccuguucggcagcuacaucggaaucuucuacaccuucaucaucuccaucguggcccugcuggucaucaucuacgugcuccugccgauuugcuucaagcugcgcgacacgcuccggaagcacgaggaugcauacaagcgcgagaugaagauccgguga

SEQ ID NO: 15942 - RNA, 4326 nt, Artificial Sequence
  derived and/or modified CDS sequence (opt11) from LACV__KP271105.1__GP
augauucgcauccuggugcucaucgccgucaccgccgcgagccccguguaccagcggugcuuccaggacggcgccauugugaagcagaacccguccaaggaggccgucaccgaggugugccugaaggacgacgugagcaugaucaaaacggaggcccgcuacguccggaacgccaccgggguguucuccaacaacguggcgauacgcaaguggcuggucagcgacuggcacgacugccggccaaagaagaucaucggcgggcacaucaacgugaucgaggugggcgacgaccucucccuccacaccgagagcuacgucuguuccgccgacugcagcaucgggguggacaaggagaccgcccaggugcgccugcagacggacaccaccaaccacuuugagaucgccggcaccacggucaaguccggcugguucaagagcaccaccuacaucacccucgaccagacgugcgagcaccuuaagguuuccugcgggcccaagagcgugcaguuccacgcgugcuucaaccagcacauguccugcguccgguuccugcaccgcaccauccuccccggcagcaucgccaacucaaucugccagaacaucgagaucaucauccuggugacccugacccucuuaaucuucauccugcucagcauccuguccaaaacguacaucugcuaccugcucaugccgaucuucauccccaucgccuacauguacgggaucaucuacaacaaguccugcaagaaaugcaagcugugcggccugguguaccaccccuucaccgagugcgggacccacugcgucugcggcgcccgguacgacaccuccgaccgcaugaagcuccaccgggccagcggccugugccccggguacaagagccuccgcgcggcccgggugaugugcaaguccaagggcccggccagcauccucuccaucaucacggccgugcugguccugaccuucgugacccccaucaacagcaugguccugggggaguccaaggaaaccuucgagcuggaggagcugcccgacgacaugcucgagauggcaagccgcaucaauuccuacuacuucacgugcauccugaacuacgcggugagcuggggcuuggugaucaucggccuccugaccgggcuccuguucaagaaguaccagcaccgguuccugaacguuuacgccauguacugcgaggagugcgacauguaccacgacaaguccggccugaagcgccacggggacuucaccaacaagugccggcaaugcacgugcggccaguacgaggacgccgccgggcucauggcccaccgaaagaccuacaacugccuggugcaguacaaggcgaaguggaugaugaacuuccugaucaucuacaucuuccucauccugaucaaggacagcgccaucgugguccaggccgccggcaccgacuucacgaccugccuggagaccgaguccaucaacuggaacugcaccggccccuuccucaaccugggcaacugccagaagcagcagaagaaggagccauacaccaacaucgccacccagcugaagggccucaaggcgaucagcgugcuggacauccccaucaucacggggauccccgacgacaucgccggcgcccugcgguacaucgaggaacgcgaggauuuccacguacagcugaccaucgaguacgccaugcucuccaaguacugcgacuacuacacccaguucagcgacaacuccggguacagccagaccaccuggcgggucuaccugcgcucccacgacuucgaggcgugcauccuguaccccaaccagcacuuuugccgcugcgugaagaacggcgagaagugcagcuccagcaacugggacuucgcgaacgagaugaaggacuacuauagcggcaaacagacgaaguucgacaaggaccucaaccuggcccugaccgcccuccaucacgccuuccgggggaccuccagcgcguacaucgccaccaugcuguccaagaaguccaacgacgaccugaucgccuacacgaacaagaucaaggccaaguucccgggcaacgcccuccugaaggcgaucaucgacuacaucgccuacaugaagucccugcccgggauggccaacuucaaguacgacgaguucugggacgagcuccuguacaagcccaaccccgccaaggccagcaaccuugcgaggggcaaggagagcagcuacaauuucaagcucgccaucuccagcaaguccauuaagaccugcaaaaacgugaaggacgucgccugccugagcccgcgguccggggcaaucuacgcguccaucaucgccugcggcgagcccuccggccccagcguguaccgcaagcccucggguggcguguuccagagcucgaccgaccggucaaucuacugccugcucgacagccacugccuggaggaguucgaggccaucaaccaggaggagcuggacgccgucaagaaguccaagugcugggagaucgaguacagcgacgugaagccgcuccaggagggggacggcaccaaguccugcaagaugaaggacagcggcaacugcaacguggccacgaaccgcuggcccgucauccagugcgagaacgacaaguucuauuacuccgagcugcagaaggacuacgacaagacccaggacaucgggcacuauugccugagccccgggugcaccaccgugcgguaccccaucaacccgaagcacaucuccaacugcaacuggcaggucagccgcuccucuaucgcgaagaucgaugugcacaacauugaggacaucgagcaguacaagaaggccaucacgcagaagcuccagaccucccugagccuguucaaguacgccaaaaccaagaaccucccccacaucaagcccaucuacaaguacaucaccaucgaggggacggagaccgccgagggcaucgaguccgccuacaucgagagcgaggugccggcgcuggccgggaccuccaucggcuucaagaucaacagcaaggagggcaagcaccuccuggacgugaucgccuacgucaaguccgccagcuacagcuccguguacgccaagcuguacagcacugggcccacguccggcaucaacaccaagcacgacgagcugugcaccggccccugccccgcgaacaucaaccaccaggugggcugguugaccuucgccaaggagagaacgagcuccugggggugcgaggaguucggcugccuggccgucagcgacggcugcguguucggguccugccaagacaucauaaaagaggaguugagcguguaccgcaaggagaccgaggaggucaccgacguggagcucugccugaccuucuccgacaagacguacugcaccaaccugaacccggugacccccaucaucaccgaccucuucgagguccaguucaagacgguggagaccuacagccugccccggaucguggccguccaaaaccacgagaucaagaucggccagaucaaugaccuggggguguacuccaagggcugcgggaacgugcagaaggucaacggcaccguguacggcaacggggugccccgcuucgacuaccucugccaccuggcgagccggaaggaggucaucgugcgcaagugcuucgacaacgacuaccaagccugcaaguuccugcaguccccggccagcuaccggcucgaggaggacuccgggaccgugacgaucaucgacuacaagaagauacuggggaccaucaagaugaaggccauccugggcgaugucaaguacaagaccuucgccgacagcguggacaucaccgcggagggguccugcaccggcugcaucaacugcuucgagaacauccacugcgagcuaacgcugcacaccaccauugaggccagcugccccaucaaguccagcugcaccguguuccacgaccgcauccuggucacgcccaacgagcacaaguacgcccucaagauggugugcaccgagaagcccggcaacacccugacgaucaaggugugcaacacgaagaucgaggccaguauggcccuggucgacgcgaagccgaucaucgagcucgcccccguggaccagaccgccuacauccgggagaaggacgagcgcugcaagaccuggaugugccggguccgcgacgaaggguuacaggugauccucgagcccuucaagaaccuguucggcagcuacaucgggaucuucuacaccuucaucaucagcaucguggcccugcuggucauaguguacgugcuccugcccaucugcuucaagcugcgcgacacgcuccggaagcacgaggacgccuacaagcgugagaugaagauccgguga

SEQ ID NO: 15943 - RNA, 4326 nt, Artificial Sequence; identical to SEQ ID NO: 12657
  derived and/or modified CDS sequence (opt11) from LACV(74-32813)__D10370.1__GP

SEQ ID NO: 15944 - RNA, 4326 nt, Artificial Sequence; identical to SEQ ID NO: 12658
  derived and/or modified CDS sequence (opt11) from LACV(Craig County/VA/2009)__KP226848.1__GP

SEQ ID NO: 15945 - RNA, 4326 nt, Artificial Sequence
  derived and/or modified CDS sequence (opt11) from LACV(Dallas/TX/2009)__GU591165.1__GP
augauccgcauucuggugcucaucguugugaccgccgccagccccguguaccagcggugcuuccaggauggcgcgaucgucaagcagaacccguccaaggaggcggugaccgaggugugccugaaggacgacgucagcaugaucaaaacggaggcccgcuacgugaagaacgccaccgggguguucuccaacaacgucgcgauccggaaguggcuggugagcgacuggcaugacugccgcccuaagaagaucgugggcgggcacaucaacgucaucgaggugggggacgaccucucccugcacaccgagagcuacgugugcuccgcggacugcaccaucggagucgacaaggagacggcccaggugcggcugcaaaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgccugcuucaaccagcacaugagcugcgugcgcuuccugcaccgaaccauccugcccggcuccaucgcgaacagcaucugccagaacaucgagaucaucauccuggucacucugacgcuacugaucuucauccugcucuccauccugagcaagaccuacaucugcuaccugcucaugccgaucuucauccccauggccuacauguacggggugaucuacaacaaguccugcaagaagugcaagcugugcggccugguguaccaccccuucaccgagugcgggacccacugcgucugcggcgcccgcuacgacacgucugaccggaugaagcuccaccgcgccuccggccugugcccuggguacaagagccugcgggccgcgagggugaugugcaagagcaagggcccggccucuauccucagcaucauaaccgccguccuggugcugaccuucgugacccccauaaacuccaugguccucggggagagcaaggagacguucgagcuggaggagcugcccgacgacaugcucgagauggcccugcggauaaacuccuacuacuucacgugcaucuuaaacuacgccgugagcuggggccucaucaucgcgggccugcugguggggcuaaucuucaagaaguaccagcaccgcuuccugaauauuuacgccauguacugcgaggagugcgacauguaccacgacaaguccgggcuuaagcggcacggggacuucaccagcaagugccgccagugcacgugcggccaguacgaggacgccaccggccucaucacccaccggaagaccuacaacugccugguccaguacaaggccaaguggaugaugaacuuccugaucaucuacaucuuccucauccugaucaaggacuccgccaucguggugcaggcgaccggcacugacuucacgaccugccuggagaccgagagcaucaacuggaacugcaccggccccuuccucaaccuggggaacugccagaagcagcagaagaaggagccguacaccaacaucgccacccagcugaagggccucaaggccaucuccguccuggacauccccaucaucaccgggauccccgacgacaucgccggcgcccugcgcuacaucgaggagaaggaggacuuccacgugcagcugaccacagaguacgcgaugcucagcaaguacugcgacuacuacacccaguucuccgacaacagcggguauucccagaccaccuggcggguguaccugcgcagccacgacuucgaggccugcauccuguaccccaaccagcacuucugccggugcgucaagaacggcgagaagugcuccagcucgaacugggacuuugcaaacgagaugaagaacuacuacagcggcaagcaggccaaguucgacaaggaccucaaccuggcgcugacggcccuccaccacgccuuccgcgggaccagcuccgccuacaucgcaaccaugcugagcaagaaguccaacgacgaccuaguggcguacaccaacaagaucaaggccaaguucccggguaacgcccuccugaaggccaucaucgacuacaucgccuacaugaagggucuucccgacauggcgaacuucaaguacgacgaguucugggacgagcuccuuuacaagcccaaccccgccaaggccagcaaccuggcccgcggcaaggaguccagcuacaacuucaagcucgcaguguccagcaaguccauccggacgugcaagaacgucaaggacguggcgugccugaguccgcgcuccggggccaucuacagcuccaucaucgccugcggcgagcccaacggccccagcguguaccggaagcccuccgggggcgucuuucagagcuccaccgaccgcagcaucuacugccugcucgauagccacugccuggaggaguucgaggccaucucccaggaggagcucgacgcggugaagaaguccaagugcugggagaucgaguacccggacauccggccccuccaggagagcgacgggagcaaguccugccgcaugaaggacagcggcaacugcaacguugccaccaaccgguggcccgucaugcagugcgagaacgacaaguucuauuacuccgagcugcagaaggacuacgacaagacccaggacauaggccacuacugccugagccccgggugcacaaccauccgcuacccgaucaaccccaagcacaucuccaacugcaacuggcaggucagccgguccagcaucgcgaagaucgacguucacaacguagaggacaucgagcaguacaagaaagccaucacccagaagcuccagaccucccugagccuguucaaguacgccaagacgaagaaccucccccacaucaagccgauauacaaguacaucaccauagagggcaccgagaccgcggaggggauugaguccgccuacaucgagagcgaggugcccgcccuggccggcacguccaucggguucaagaucaacagcaaggagggcaagcaccuccuggaugugaucgccuacgucaaguccgcgagcuacagcucaguguacgccaagcuguacagcaccggccccaccuccgggaucaacaccaagcacgacgagcugugcacgggccccugcccggccaacaucaaccaccagguuggguggcucaccuucgcccgcgagcggaccagcuccuggggcugcgaggaguucgggugccuggccgucagcgacggcugcguguucggcuccugccaggacaucaucaaggaggagcugagcguguaccgcaaggacaccgaggaggucacgaacguggagcucugccugaccuucuccgacaagaccuacugcaccaaccugaaccccgugacccccaucaucaccgaccucuucgagguccaguucaagaccguggagaccuauagccugccccggaucguggcgguccagaaccacgagaucaaaaucgggcagaucaacgaccugggcguguacuccaaggggugcggcaacgugcagaaggucaacgggacgguguacggcaacggcgugccgcgcuucgacuaccucugccaccuggccagccggaaggaggucaucgugcgcaagugcuucgacaacgacuaccaggccugcaaguuccugcagucccccgccagcuaccgguuagaggaagacuccgggacggugaccaucaucgacuacaagaaaauccugggaaccaucaagaugaaagcgauccugggggaugucaaguacaagacuuuugccgacagcguggacaucacggccgagggcuccugcgccgggugcauaaacugcuucgagaacauccacugcgagcucacccugcacaccaccaucgaggccagcugccccaucaaauccagcugcacgguguuccacgaucgcauccuggucaccccgaacgagcacaaguacgcgcucaagauggugugcaccgagaagccgggcaacacccugacgaucaaggucugcaacacccggaucgaggugagcauggcacugguggacgccaagcccaucaucgagcucgcccccgucgaccagaccgccuacauccgcgagaaggacgaacgcugcaagaccuggaugugccgggugcgcgacgagggccuccaggugauccuggagcccuucaagaaccuguucggguccuacaucggcaucuucuacacguucaucaucagcaucaucgcgcugcuggucaucaucuacgugcuccugccgaucugcuucaagcugcgggacacccuccgcaaacacgacgaugccuacaagcgggagaugaagauccgcuag

SEQ ID NO: 15946 - RNA, 4326 nt, Artificial Sequence; identical to SEQ ID NO: 12660
  derived and/or modified CDS sequence (opt11) from LACV(Fort Bend County/TX/2009)__GU591168.1__GP

SEQ ID NO: 15947 - RNA, 4326 nt, Artificial Sequence; identical to SEQ ID NO: 12661
  derived and/or modified CDS sequence (opt11) from LACV(LAC22988-89)__U18980.1__GP

SEQ ID NO: 15948 - RNA, 4326 nt, Artificial Sequence; identical to SEQ ID NO: 12662
  derived and/or modified CDS sequence (opt11) from LACV(LAC30928-31)__U18979.1__GP

SEQ ID NO: 15949 - RNA, 4326 nt, Artificial Sequence; identical to SEQ ID NO: 12663
  derived and/or modified CDS sequence (opt11) from LACV(LAC76-40)__U70206.1__GP

SEQ ID NO: 15950 - RNA, 4326 nt, Artificial Sequence
  derived and/or modified CDS sequence (opt11) from LACV(LAC79-283)__U70207.1__GP
augauccgcauccuggugcucauagccguuaccgccgcgucuccuguguaccagcggugcuuccaggacggcgccaucgugaagcagaacccauccaaggaggcagucaccgaggugugccugaaggaugacgugagcaugaucaagacggaggcccgcuacauccggaacgccaccggggucuucuccaacaacguggcgauccgcaaguggcuggugagcgacuggcacgacugccggcccaagcgcaucaucggugggcacaucaacgucaucgaggugggcgacgaccucucccugcacaccgagucuuacgugugcuccgccgacugcacaaucggggucgauaaggagacggcccaggugcggcugcagaccgacacgaccaaccacuucgagaucgccggcacgaccgucaagagcggcugguucaaguccaccaccuacaucacccucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgaaaucauaauccuggucacccugacgcuccugauauucauccugcucuccaucuugagcaagaccuacaucugcuaccugcucaugccgaucuucauccccaucgccuacaucuacgggaucauuuacaacaaguccugcaagaagugcaagcugugcggccugguguaccaccccuucacagagugcgggacccacugcgugugcggcgcccgcuacgacacgagcgaccggaugaagcuccaccgcgccuccggccugugccccggguacaagagccugcgggcggcccgcgucaugugcaagagcaagggcccggccuccauccucagcaucaucaccgccgugcuggugcugaccuucgucacccccaucaacuccauggugcucggggaguccaaggagacguucgagcuggaggaacugcccgacgacaugcucggcauggcgucccggaucaacagcuacuacuucacguguauccugaacuacgcggucuccuggggccuugugaucaucggccuccugaccggguuacuguucaagaaauaccagcaccgcuuccugaacguauaugccauguacugcgaggagugcgacauguaccacgacaagagcgggcugaagcggcacggcgacuucaccaacaagugccgccagugcacgugcgggcaguacgaggacgccaccggccucauggcccaccggaagaccuacaacugccugguccaguacaaggccaaguggaugaugaacuuccuggugaucuacaucuuccucauccugaucaaggacuccgccaucgucguccaggccgccggcaccgacuucacgaccugccuggagaccgagagcaucaacuggaacugcacugggcccuuccucaaccugggcaacugccagaagcagcagaagaaggaaccguacaccaacaucgccacccagcugaaggggcucaaggccaucuccgugcuggacauccccaucaucaccggcauccccgacgacaucgcgggggcucugcgcuacaucgaggagcgggaggacuuccacgugcagcugaccaucgaguacgccaugcucagcaaguacugcgacuauuacacccaguucuccgacaauagcggcuacucccagacgaccuggcgaguauaccugcgcucucacgauuucgaggccugcauccuguaccccaaccagcacuucugccggugcgugaagaacggcgagaaguguucuucauccaacugggauuucgcgaacgagaugaaggacuucuacagcgggaagcagaccaaguucgacaaggaccucaaccuggcccugaccgcccuccaccacgccuuccgcggcacgagcuccgccuacaucgcgaccaugcugagcaagaaguccaacgacgaccugaucgccuacaccaacaagaucaagaccaaguucccagggaacgcccuccugaaagccaucaucgacuacaucgccuacaugaagucccugcccggcauggccaacuucaagcacgacgaguucugggacgaacuccuguacaagcccaaccccgccaaggccagcaaccuggcccgggggaaggagagcuccuacaacuucaagcucgccaucagcuccaagaguaucaagacgugcaagaacgugaaggacguugcgugccuguccccgcgcagcggcgccaucuacgccuccaucaucgccugcggcgagcccaacgggcccagcguguaccggaagcccuccggcgggguguuccagagcuccaccgaccgcagcaucuacugccugcucgacagccacugccuggaggaguucgaggcgaucucccaggaggagcuggacgccgucaagaaguccaagugcugggagaucgaauacccggacguaaagccccuccaggagggcgauggcaccaagagcugccggaugaaggacucugggaacugcaacguggccaccaaccgcuggcccgucauccagugcgagaacgacaaguucuacuacuccgagcugcagaaggacuacgacaagacgcaggacaucggccacuauugccugagccccgggugcaccacugugcgguacccgaucaaccccaagcacauauccaacugcaacuggcaggucagcagauccagcaucgccaagaucgacgugcacaacaucgaagacaucgagcaguacaagaaggccaucacccagaagcuccagacgucccugagccuguucaaguacgcgaagaccaagaacuuaccccacaucaagccgaucuacaaguacaucaccaucgagggcaccgagacggccgaggggaucgaguccgccuacaucgagagcgaggugcccgcccuggccggcaccuccaucggcuucaagaucaauagcaaggaggggaaacaccuccuggacgugaucgcguacgucaagucggccagcuacuccagcguguacgccaagcuguacagcaccggccccaccuccgggaucaacacgaagcacgacgagcugugcacuggccccugcccggccaacaucaaccaccaggugggguggcucaccuucgcccgggagcgcaccagcuccuggggcugcgaagaguucggcugccuggcggucagcgacggcugcguguucggcuccugccaggacaucaucaaggaggagcugagcguguaccggaaggagacggaggaggucaccgacguggagcucugccugaccuucuccgacaagaccuacugcacgaaccugaaccccgugacacccaucaucaccgaccucuucgaaguccaguucaacaccguggagacguacagccugccccgcaucguggccguccagaaccacgagaucaagaucgggcagaucaacgaccugggcguguacuccaaggggugcggcaaugugcagaaggucaacggcaccguguacgggaacggcgugccgcgguucgacuaccucugccacuuggccagccgcaaggaggucaucguucggaagugcuucgacaacgacuaccaggccugcaaguuccugcagucccccgccagcuaccgccucgaggaggacuccgggaccgugaccaucaucgacuacaagaagauccugggcaccauaaagaugaaggccauccugggggacgucaaguacaagacguucgccgacagcguggacaucacggccgagggcuccugcaccggcugcaucaacugcuucgagaacauccacugcgagcucacccugcacacgaccaucgaggccagcugccccaucaaguccagcugcaccguguuccacgaccggauccuggucacccccaacgagccgcaguacgcgcuaaagauggucugcaccgagcgccccggcaacacccugaccaucaaagugugcaacacuaagaucgaggccuccauggcccugguggacgccaagcccaucaucgaguuggcccccguggaccagacggcguacauccgcgagaaagacgagcggugcaaaacguggaugugccgcguccgugacgagggccuccaggugauccuggagccguucaagaaccuguucgggagcuauaucggcaucuucuacaccuucaucaucagcaugguggcccugcuggucaucaucuacgugcuccugcccaucugcuucaagcugcgcgacacccuccggaagcacgaggacgccuacaagcgcgagaugaagauccgguga

SEQ ID NO: 15951 - RNA, 4326 nt, Artificial Sequence
  derived and/or modified CDS sequence (opt11) from LACV(LAC81-4)__U70208.1__GP
augauccgcauccuggugcucaucgccgucaccgccgcgagccccguguaccagcggugcuuccaggacggcgccaucgugaagcaaaacccguccaaggaggccgucaccgaagugugccugaaggacgacgugagcaugaucaagacggaggcccgcuacauucggaacgccaccggagucuucuccaacaacguggcgaucaggaaguggcuggugagcgacuggcacgacugccggcccaagaagaucaucggcgggcacaucaaugucaucgaggugggcgacgaccucucccugcacaccgagagcuacguguguuccgccgacugcaccaucggggucgacaaggaaacggcccaggugcgccuacagaccgacaccaccaaccacuucgagaucgccggcaccaccgucaagagcggcugguucaagaguaccaccuacaucacgcucgaccagaccugcgagcaccugaaggugagcugcgggcccaaguccgugcaguuccacgcgugcuucaaccagcacaugagcugcgugagauuucugcaccggaccauucuccccggcuccaucgccaacagcauuugccagaacaucgagaucauaauccuggucacccugacgcuccugaucuucauccugcucuccauccuaagcaagaccuacaucugcuaccugcucaugccgaucuucauccccaucgccuacguguacgggaucaucuacaacaaguccugcaagaagugcaagcugugcggcuugguguaccaccccuucaccgagugcgggacccacugcgugugcggcgcccguuacgacacgagcgaucgcaugaagcuccaccgggccucuggccugugccccggguacaagagccugcgcgcggcccgggugauguguaagagcaagggcccggccucaauccucagcaucaucaccgccgugcucguccugaccuucgugacccccaucaacuccaugguccucggagagagcaaggagacguucgagcuggaggagcugcccgacgacaugcucggcauggccucccgcaucaacucuuacuacuucacgugcauccugaacuacgcgguguccuggggccuggugaucaucgggcuccugaccggccuccuguucaagaaguaccagcaccgguuccugaacgucuacgccauguacugcgaggagugcgacauguaccacgacaaaagcgggcugaagagacacggcgauuucaccaacaagugccggcagugcacgugcgggcaguacgaggacgcaaccggccucauggcucaccgcaagaccuacaacugccuggugcaguacaaggccaaguggaugaugaacuuccuggugaucuacaucuuccucauccugaucaaggacuccgcgaucguggugcaggccgccggcaccgacuucacgaccugccuggagaccgagagcaucaacuggaacugcaccgggcccuuccucaaccugggcaacugccagaagcagcagaagaaagagccguacaccaacaucgccacccagcugaaggggcucaaggccaucuccgugcuugacaucccuaucaucaccggcauccccgaugacaucgcgggggcccugcgguacaucgaggagcgcgaggacuuccacguccagcugaccaucgaguacgccaugcucagcaaguacugcgacuacuacacccaguucuccgacaacagcggcuacucccagacgaccuggcggguguaccugcgaagccacgacuucgaggccugcauccuguaccccaaccaacacuucugccgcugcgugaagaacggcgagaagugcuccagcuccaacugggacuucgcgaacgagaugaaggacuucuacagcgggaagcagaccaaguucgacaaggaccucaaccuggcccugaccgcccuccaccacgccuuccggggcacgagcuccgccuacaucgcgaccaugcugagcaagaaguccaacgacgaccugaucgccuacaccaacaagaucaagaccaaguucccggggaacgcccuccugaaggccaucaucgacuacaucgccuacaugaagucccugcccggaauggcgaacuucaagcacgacgaguucugggacgagcuccuguacaagcccaaccccgccaaggccagcaaccuggcccgcgggaaggagagcucauacaacuucaaacuugccaucagcuccaagagcaucaagacgugcaagaacgucaaggacguggcgugucuguccccgcggagcggcgccaucuacgccuccaucaucgccugcggcgagcccaacggccccagcguguaccgcaagcccagcggcggggucuuccagaguuccaccgaccggagcaucuacugccugcuugacagccacugccuggaagaguucgaagcgaucucccaagaggagcuggacgccgugaagaaguccaagugcugggagaucgaguacccggacgugaagccccuccaggagggcgacggcaccaagucuugccgcaugaaggacagcgggaacugcaacgucgccaccaaccgguggcccgugauccagugcgagaacgacaaguucuacuauuccgagcugcagaaagauuacgacaagacgcaggacaucggccacuacugccugagccccgggugcaccaccgugcgcuacccgauaaacccaaagcacaucuccaacugcaacuggcaggucagccgguccagcaucgccaagaucgacgugcacaacaucgaggacaucgagcaguacaagaaggccaucacccagaagcuccagacgucccugagccuguucaaguaugcgaagacgaaaaaccucccccacaucaagccgauuuacaaauacaucaccaucgagggcacggagaccgccgagggaaucgaguccgccuauaucgaaagcgaggugcccgcccuggcaggcacguccaucggcuucaagaucaacagcaaggaggggaagcaccuccuggacgucaucgcguaugugaaguccgccagcuacuccagcguguacgccaagcuguacagcaccggccccaccuccgggaucaauacgaagcacgacgagcuguguaccggccccugcccggccaacaucaaccaucaggucggauggcucaccuucgccagggagcggaccagcuccuggggcugcgaggaguucggcugccuggcggugagcgacggguguguguucggcuccugccaggacaucaucaaggaggagcugagcguauaccgcaaggagacggaggaggucaccgacguggagcucugccugaccuucuccgacaagaccuacugcacgaaccugaaccccgucacccccaucaucaccgaccucuucgaggugcaguucaagaccguggagacguacagccugccccggaucgucgccgugcagaaccacgagaucaagaucgggcagaucaacgaccugggcguguacuccaaggggugcggcaacguccagaaggugaacggcaccguguacgggaacggcgucccgcguuucgacuaccucugccaccuggccucgcggaaggaggugaucgugcgcaaaugcuucgacaacgacuaccaggccugcaaguuccugcagucccccgcgagcuaccggcucgaggaggacuccggaaccgucaccauuaucgacuacaagaagauccugggcaccaucaagaugaaggccauccugggggacgugaaguacaagacguucgccgacagcguggacaucaccgccgagggcuccugcaccggcugcaucaacugcuucgagaacauccacugcgagcucacccugcacacgaccauagaggccagcugccccaucaaguccuccugcaccgucuuccacgaccgcauccugguuacccccaacgagccgcaguacgcgcucaagauggugugcacggagcggccugggaacacccugaccauaaaggucugcaacaccaagaucgaggccuccauggcccugguggacgccaagcccaucaucgagcucgcccccgucgaccagaccgcguacauccgagagaaggacgagcgcugcaagaccuggaugugccgggugcgcgacgagggccuccaggugauccuggagccguucaagaaccuguucggaagcuacaucggcaucuucuacaccuucauuaucagcauggucgcccugcuggugauaaucuacgugcuccugcccaucugcuucaagcugcgggacacccuccgcaagcacgaggacgccuacaagcgggagaugaagauacgcuga

SEQ ID NO: 15952 - RNA, 4326 nt, Artificial Sequence
  derived and/or modified CDS sequence (opt11) from LACV(LACR56869)__U70205.1__GP
augaucugcauccuggugcucaucaccgucgccgccgcgagccccguguaccagcgcugcuuccaggacggcgccaucgugaagcagaacccuuccaaggaggccguuaccgaggugugccugaaggaugacgugagcaugaucaagacggaggcccgguacguccgcaacgccaccgggguguucuccaacaacguggcgauccggaaguggcuggucagcgacuggcacgauugccgccccaagaagaucgugggcgggcacaucaacgugaucgaggucggcgacgaccucucccugcacacugagagcuacgugugcuccgccgacugcaccaucgggguggacaaggagacggcccagguccggcugcagaccgacaccaccaaccacuucgagaucgccggcacgaccgucaagagcggcugguucaaauccaccaccuacaucacgcucgaccagaccugcgagcaccugaaggugagcugcgggcccaaguccgugcaguuccacgcgugcuucaaucagcacaugagcugcgugcgcuuccugcaccggaccauccuccccggcuccaucgccaacagcaucugccagaacaucgagaucaucaucuugguaacccugacgcuccugaucuucauccugcucuccauccuuagcaagaccuacaucugcuaccugcucaugccgaucuucauccccaucgccuacaucuacgggaucaucuacaacaaguccugcaaaaagugcaagcugugcggccuggucuaccaccccuucaccgagugcgggacccacugcgugugcggcgcccgcuacgacacgagcgaccggaugaaguuacaccgcgccuccggccuuugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucgcggaucaacagcuacuaccugaccugcauccugaacuacgccguguccuggggccucguaauaaucggccuucugaucgggcuccuguucaagaaguaccagcaccgcuuccugaacauuuacgccauguacugcgaggagugcgacauguaccacgacaagagcggccucaagcggcacggggacuucaccaacaagugccgccagugcacgugcggccaguacgaggacgccgccgggcugauggcccacaggaagacuuacaacugccuggugcaguacaaggcgaaguggaugaugaacuuccucauuaucuacaucuuccugauccugaucaaggacuccgccaucgugguccaggccgccggcaccgacuucacgaccugccucgagaccgagagcauaaacuggaacugcaccggccccuuccugaaucuggggaacugccagaaacagcagaagaaggagccguacaccaacaucgcgacccagcuaaagggccugaaggcgaucuccgugcuggacgugcccaucaucacggggauccccgacgacaucgccggugcccugcgcuacaucgaggaaaaggaggacuuccacguccagcugaccaucgaguacgccaugcugagcaaguacugcgacuacuacacccaguucuccgacaacuccggguacucccagaccaccuggcggguguaccugcgcagccacgacuucgaggcguguauccucuaucccaaccagcacuucugccggugcgugaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacauggccaccaugcuuucaaagaaguccaacgaugaccucaucgccuacacgaacaaaaucaagaccaaguucccgggcaacgcccugcugaaggccaucaucgacuacaucgcguacaugaagucucuccccgggauggccaacuucaaguacgacgaguucugggacgaacugcuguacaagcccaaccccgccaaggccagcaaccucgcccguggcaaggaaagcuccuacaacuucaagcuggcgaucagcuccaagucuaucaagaccugcaagaacgucaaggacguggccugccuguccccgcggagcggggccaucuacgccuccaucaucgcgugcggcgagcccaacggccccagcguguaccgcaagccuuccgggggcgucuuccagagcuccaccgaccggagcaucuacugccuccuggacucucacugccuggaggaguucgaggccaucgggcaggaggagcucgacgccgugaagaaguccaagugcugggagaucgaguacccggacgugaagcugauccaggagggcgacggcaccaagagcugccgcaugaaggacuccgguaacugcaacgucgccaccaaccgguggcccgugauccagugcgagaacgacaaguucuacuacucggagcuccagaaagacuacgacaagacccaggacaucggccacuacugcuuaucccccgggugcaccacggugcgcuaccccaucaacccgaagcacaucagcaacugcaacuggcaggucucccggagcuccaucgccaagauugacgugcacaacaucgaggauaucgagcaguacaagaaggcgaucacccagaagcugcagaccagccugagucucuucaaguacgccaagaccaagaaccugccccacaucaagcccaucuacaaguacaucacgaucgagggcaccgagaccgccgagggaaucgaaagcgccuacaucgaguccgaggugccggcccuggcgggcaccaguauaggcuucaaaaucaauuccaaggaggggaagcaccuccuggacgucaucgccuacgucaagagcgccuccuacagcuccguguacacgaaauuguauagcaccggccccaccuccgggaucaacaccaagcacgacgagcucugcacgggaccuugccccgccaacaucaaccaccaggacggguggcugaccuucgcccgcgagcggaccuccagcuggggcugcgaggaguucggcugccuggcgguuuccgaugggugcguguucggcagcugccaggacaucauuaaggaggagcucuccguguaccgcaaggagaccgaggaggucacggacguugagcugugccugaccuucagcgacaaaaccuauugcacaaaccucaacccggugacgcccaucaucaccgaccuguucgagguccaguucaagaccguggagaccuacucccugccccggaucguggccguccagaaccacgagaucaagaucgggcagaucaacgaccucggcguguacagcaaggggugcggcaaugugcagaaggucaacggcacgaucuacgggaacggcgugccccgcuucgacuaccugugccaccuggccucccggaaggaggugauaguccgcaagugcuucgacaacgacuaccaagccugcaaguuccuccagagcccggcguccuaccggcuggaggaggacagcgggaccgugaccaucaucgacuacaagaagauccugggcaccaucaagaugaaggccauccucggagaugugaaguacaagaccuucgccgacuccgucgacaucacggccgagggcagcugcaccgggugcaucaacugcuucgagaacauccacugcgagcugacccugcacaccacgaucgaggcauccugccccaucaagagcuccugcaccguguuccacgaccgcauccucgugacccccaacgagcacaaguacgcgcugaagauggucugcaccgagaagcccgggaacacgcugaccaucgaggucugcaacaccaagaucgaggccagcauggcccucguggacgccaagccgaucaucgagcuggcccccgucgaccaaaccacguauauccgggagaaggacgagcgcugcaagaccuggaugugcagaguacgcgacgagggucugcaggucauccucgagcccuucaagaaccuguucggguccuacaucgggaucuucuacacauucaucaucagcauaguggcgcugcucgugaucaucuacguccugcugcccaucugcuucaagcuccgagacacccugcggaagcacgaggacgccuacaagcgcgagaugaaaauccgguga

SEQ ID NO: 15953 - RNA, 4326 nt, Artificial Sequence; identical to SEQ ID NO: 12667
  derived and/or modified CDS sequence (opt11) from LACV(NAT_Crawford_WI_2007)__GU596383.1__GP

SEQ ID NO: 15954 - RNA, 4326 nt, Artificial Sequence; identical to SEQ ID NO: 12668
  derived and/or modified CDS sequence (opt11) from LACV(77)__DQ196119.1__GP

SEQ ID NO: 15955 - RNA, 4326 nt, Artificial Sequence
  derived and/or modified CDS sequence (opt11) from LACV(LACV/00/NC-M (NC00-283))__GU206112.1__GP
augauucgcauccuggugcucaucgccgugacagccgcgagccccguguaccagcggugcuuccaggacggcgccaucgugaaacagaacccguccaaggaggccgucaccgaggugugucugaaggacgacgugagcaugaucaagacggaagcccgcuacguccguaacgccaccgggguuuucuccaacaacguggcgauucgcaaguggcuagucagcgacuggcacgacugccgccccaagaagauaaucggcgggcacaucaacgucaucgagguuggcgacgaccucucccugcacacggagagcuacgucugcucggccgacuguaccaucgggguggacaaggaaacggcccaggugcgccugcagaccgacaccaccaaccacuuugagaucgccggcacgaccgucaagagcggcugguucaaguccaccaccuacaucacucucgaccagaccugcgagcacuuaaaggugagcugcgggcccaaguccgugcaguuccacgcgugcuucaaucagcacaugagcugcguacgguuccuccaccgcaccauucuccccggauccaucgccaacagcauaugccagaacaucgagaucauuauccuggugacccugacgcuccugaucuucaucuugcucuccauucugagcaagacuuacaucugcuacuuacucaugccgauuuucauacccaucgccuauauguacgggaucaucuacaacaaguccugcaagaagugcaagcugugcggacugguguaccaucccuucaccgagugcgggacccacugcguaugcggcgcccgguacgacacgagcgaucgcaugaagcuccaccgggccuccggacugugccccggguauaagagccugcgcgcggcgcgggugaugugcaagaguaagggaccggccuccauccucagcaucaucaccgccgugcugguccugaccuucguuacccccauuaacuccaugguccucggggagagcaaggagacuuucgagcuagaggagcugcccgacgacaugcucgagauggccuccaggaucaauucauauuacuucacguguauccugaacuacgcggucuccuggggccuggugaucaucgggcuccugacagggcuccuguucaagaaauaccagcaccgguucuuaaacguauacgccauguacugcgaggagugcgacauguaccaugacaagagcggccuaaagcgccacggggacuuuaccaacaaaugccgccagugcacgugcggccaguacgaggaugccgcgggccucauggcccaccgcaagaccuacaacugccugguacaguacaaagcaaaguggaugaugaacuuccugauuaucuauauauuccucauccugaucaaggacuccgccaucgugguccaggccgccggcaccgacuucacgaccugccuggagaccgagagcaucaacuggaacugcaccggccccuuccucaaccuggggaacugccagaagcagcagaagaaggagccguacaccaacaucgccacccagcugaagggacucaaggccaucagugugcuagacauccccaucaucacggggauccccgacgacaucgcaggcgcccugaaauacauugaggaacgggaggacuuccacgugcagcugaccaucgaguacgcaaugcucagcaaauacugcgacuacuacacccaguucuccgacaacagcggguacucccagaccaccuggcgcgucuaccugcggagccaugacuucgaggccugcauacuguaccccaaucagcacuuuugccgcugcgugaagaacggagagaaaugcaguagcuccaacugggacuucgcgaacgagaugaaggacuacuacagcggcaagcagaccaaguuugacaaagaccucaaccuagcccuaaccgcccuccaccacgccuuccgcgggaccagcuccgcguacaucgccacgaugcugagcaagaaguccaacgacgaccugaucgccuacaccaacaagauuaagaccaaguuuccgggcaaugcccuccuaaaagcuaucauugacuacauagcguacaugaagucccugcccgggaugacgaacuucaaguacgacaaauucugggacgagcuccuguacaagccuaacccugccaaagccagcaaccuggcccggggcaaggagagcuccuacaacuuuaagcucgccaucagcuccaagagcaucaagacgugcaaaaacgugaaagacgucgcaugccuguccccgcgcagcggggccaucuaugcaucaauaaucgccugcggagagcccaauggccccucuguguacagaaagccguccgggggcgucuuccagagcuccaccgaccgcagcaucuacugucugcucgacagccauugccuugaggaguucgaggcgaucaaccaggaggaacuggacgccgucaaaaagagcaagugcugggagaucgaguacagcgacgucaagccguuacaggagggggacggcacgaaguccugccggaugaaggacucgggcaacugcaacguggccaccaaccgcuggccagugauccagugugaaaacgacaaguucuacuauuccgagcugcagaaggacuacgacaagacgcaggacaucgggcacuacugccucagccccggcugcacaaccgugcgguaccccaucaacccgaagcacaucuccaacugcaacuggcagguuagccgcuccagcauagccaagauugacgugcacaauaucgaggacaucgagcaguacaagaaggcuaucacccagaagcuccagacgucccugagccuguucaaguacgcgaagaccaaaaacuuaccccacaucaagcccaucuacaaguacaucaccaucgaagggaccgagacggcggagggcaucgaguccgccuauaucgagagcgaggugccggcccuggccgggacguccaucggcuucaagauuaacagcaaggaggggaaacaccucuuagacgugaucgccuacgucaaguccgccagcuacuccucggucuacgcgaagcuguacucgacugggccuaccucgggcaucaacacgaagcacgacgagcugugcaccgggcccugccccgcuaacaucaaccaucaggugggcuggcucaccuucgccaaggagcgcaccagcuccuggggaugcgaggaguucggaugccuggcugucagcgacggcugcguguucggguccugccaggacaucaucaaggaggagcugagcguguaucgcaaagagacggaggaggucaccgacguggaacucugccugacauucuccgacaagaccuacuguacgaaccucaacccggugacccccaucaucaccgaccucuucgagguccaguucaagaccguggagacguacagccugccccggaucguggccguccagaaccacgagaucaaaauuggccagaucaacgaccucgggguguacuccaagggcugcgguaacguacagaaggucaacggcaccguauacggcaacggggugccccgcuucgacuaccuaugccaucuggcuagcagaaaggaggucaucguucgcaagugcuucgacaacgacuaccaggccugcaaguuccuccagucccccgcgagcuaccggcucgaggaggacuccggcacugugaccaucaucgacuacaagaagauccuggggaccauaaagaugaaggccauccuaggcgacgucaaguacaaaacguucgccgacaacguagauauaaccgccgagggcagcugcaccggcuguauuaacugcuucgagaacauccauugcgagcucacccugcacacgaccaucgaggccaguugccccauaaagucguccugcaccguauuccacgaccgcauucuggucacccccagcgagcacaaguacgcgcucaaaauggugugcacggagaagccagguaacacucuaaccaucaaggugugcaauaccaagauugaggccagcauggcccucgucgacgccaagccgaucaucgagcucgcccccguggaccagacugcguacauccgagagaaggacgagcgguguaagaccuggaugugucggguccgcgacgagggacuccagguaauccuggagccguucaagaaccuguucgguagcuacaucgggaucuucuacacuuuuaucaucagcaucauggcccuguuaguuauuaucuacguccugcugcccaucuguuucaaacuccgcgacacacuccgcaagcacgaggacgccuacaagcgcgagaugaaaauccgguga

SEQ ID NO: 15956 - RNA, 4326 nt, Artificial Sequence
  derived and/or modified CDS sequence (opt11) from LACV(LACV/00/WV-M (WV00-3178))__GU206148.1__GP
augauccgcaucuuagugcucaucgccaucaccgccgcgagccccgucuaccagcggugcuuccaggacggugccaucgugaagcagaacccguccaaggaggccgugaccgaggucugccugaaggacgacguuagcaugaucaagacggaagcccgcuacgugcggaacgccaccggagucuucuccaacaacguggcgauccgcaaguggcuggugagcgacuggcacgacugccggcccaagaagaucauaggcgggcauauaaacgucaucgaggugggcgacgaccucucccugcacaccgagagcuacgugugcuccagcgacugcaccauaggggucgacaaggagacggcccaggugcgccugcagaccgacaccaccaaccacuucgagaucgccggcacgaccguaaaguccggcugguucaagagcaccaccuacaucacgcucgaccaaaccugcgagcaccugaaggucuccugcgggcccaagagcgugcaguuccacgccugcuucaaccagcacauguccugcgugcgguuucuacaccgcaccauccugcccggcucgaucgccaauuccaucugccagaacaucgagaucaucauccuggucacccugacucuccugaucuucauccugcucagcauccuguccaagaccuacaucugcuaccugcucaugccgaucuucauccccaucgcguacaucuacgggaucaucuacaacaagagcugcaagaagugcaagcugugcggccugguguaccaccccuucaccgagugcgggacccacugcgugugcggcgcccgguacgacacguccgaccgaaugaagcuccaccgggccagcggccugugccccggguauaagagccugcgugccgcgcgggucaugugcaaguccaagggcccggccagcauccucuccaucaucacggccgugcuggugcugaccuucgugacccccauuaacagcaugguguuaggggagaguaaggagacguucgaguuagaggagcugcccgacgacaugcucgagauggccagccgcaucaacuccuacuaccugaccugcauccugaacuacgccgucagcuggggccucgugaucaucggccugcugaccgggcuccuguucaagaaguaccagcaccgcuuccugaacaccuacgcgauguacugcgaggagugcgacauguaccacgacaaguccggccucaagcgccacggggacuucacgaacaagugcaggcagugcacgugcggccaguacgaggacgccgccggucugaugacccaccgcaagaccuacaacugccuugugcaguacaaggccaaauggaugaugaacuuccucaucaucuacaucuuccugauccugaucaaagacagcgccaucaucguccaggcggccggcacggacuucacgaccugccucgagaccgagucuaucaacuggaacugcaccggccccuuccugaaccuggggaacugccagaaacagcagaagaaggagccguacaccaacaucgccacccaguuaaagggccugaaggccaucagcgugcuggacauccccaucaucaccgggauccccgacgacaucgccggugcgcugcgguacaucgaggagcgcgaggacuuccacgugcagcucaccacggaguacgccaugcugucccgguacugcgacuacuacacccaauuuagcgacaacucccgcuacagccagaccaccuggcgcgucuaccugcggucccacgacuucgaggccugcauccucuaccccaaccagcacuucugccgcugcgugaaaaacggggagaagugcagcuccagcaacugggacuucgccaacgagaugaaggacuacuacagcggcaagcagacgaaguuugacaaggaccugaaccuggcgcucaccgcccugcaccacgccuuccggggcaccuccagcgcauacaucgccaccaugcuguccaagaaguccaacgacgaccucaucacuuacaccaacaagauaaagaccaaguucccggggaacgcgcugcugaaggccaucauugauuacaucgccuacaugaagucccuccccggcauggccaacuucaaguacgacgaguucugggacgagcugcuguacaagcccaaccccgccaagaccagcaaccucgcgcgcgggaaggagagcacguacaacuucaagcuggccaucagcuccaagagcaucaagaccugcaagaacgugaaggacgucgccugccuguccccgcggagcggcgccaucuacgcguccaucaucgcgugcggggagcccaacggcccaagcguguaucgaaagcccuccggcgggguguuccagagcuccaccgaccggagcaucuacugcuugcuggacagccacugccuggaggaguuugaggccaucucccaggaggaacucgacgccgucaagaagucuaagugcugggagaccgaguauccggaggugaagccccugcaggagagcgacggcaccaagagcugccgcaugaaggacuccgggaacugcaauguggccaccaaccgguggcccgucauccagugcgagaacgacaaguucuacuacagcgagcugcagaaggacuacgacaagacccaggacaucggccacuacugccucucccccggcugcaccacggugcgcuacccgaucaaccccaagcacaucagcaacugcaacuggcaggucucccggagcuccauagcgaagaucgacgugcacaacaucgaggacaucgagcaguacaagaaggccaucacgcagaagcugcagaccagccugucccucuucaaguacgccaagaccaagaaccugccccacaucaagccgaucuacaaguauaucacgaucgaggggaccgagaccgccgaggguaucgagagcgccuacaucgaguccgaggugcccgcgcuggccgggaccagcaucggauucaagaucaacuccaaggaggggaagcaucucuuggacgugaucgccuacgucaagagcgccuccuacagcagcguguacgccaagcuguacuccacgggccccaccagcggcauuaacaccaagcacgacgagcucugcaccgggcccugcccggcgaacaucaaccaccaaaucggcuggcugacguucgccaaggagcgcaccuccaguugggggugcgaagaguucggcugccuggccguguccgaugggugcgucuucggcagcugccaggacaucaucaaagaggagcucucgguguaccggaaggagaccgaggaggugaccgacgucgagcugugccugacguucagcgacaagaccuacugcaccaaccucaaccccgugacccccaucaucaccgaccuguucgaggugcaguucaagacggucgagaccuacucccugccccgcaucguggccgugcagaaccacgaaaucaagaucggccagaucaacgaucucggggucuacagcaagggcugcggaaacgugcagaaggugaacggcacagucuacgggaacggcguuccgcgguucgacuaccugugccaccuggccucccgcaaagaggugaucguccggaagugcuucgacaacgacuaccaagcgugcaaguuccuccagagccccgccaguuaccgcuuggaggaagacagcgguaccgugacgaucaucgacuacaagaagauccuggggaccaucaagaugaaggccauccucggcgacguaaaauacaagacauucgccgaguccgucgacaucaccgcggaagggagcugcacgggcugcaucaacugcuucgagaacauccacugcgagcuaacccugcacaccaccaucgaggccuccugccccaucaagagcuccugcacgguguuccacgaccggauauuagugacccccaacgagcacaaguacgcccugaagauggucugcaccgagcgcccggggaacacccucacgaucaaggugugcaacaccaagaucgaggccagcaugacccucguggacgccaagcccaucaucgagcuggcucccgucgaccagaccgccuacauccgcgagaaggacgagcggugcaagacguggaugugccgcgugcgggacgagggccuccaggugauccuggagcccuucaagaaccuguucggcagcuacaucgggaucuucuacaccuucaucaucuccaucgucgcccugcucgugaucaucuacguccugcugccgaucugcuucaagcuccgcgacacccugcggaagcacgaggacgccuacaagcgcgagaugaagauccgauga

SEQ ID NO: 15957 - RNA, 4326 nt, Artificial Sequence
  derived and/or modified CDS sequence (opt11) from LACV(LACV/03/NY-M (41030016))__GU206130.1__GP
augaucuacauccugguucucaucgccgucaccgccgcgagccccguguaccagcgcugcuuccaggacggcgccaucgugaagcagaacccgagcaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucgucggcgggcacaucaacgugaucgaagugggcgacgaccucucccugcacaccgagagcuacgucugcuccgccgacugcaccaucgggguggacaaggagacggcgcagguucggcugcagaccgacaccaccaaccauuucgagaucgccggcacgaccgucaagagcggcugguucaagaguaccaccuacaucacgcucgaccagaccugcgagcaccugaaggugagcugcgggcccaaguccauccaguuccacgcgugcuucaaccagcacaugagcugcguacgcuuccugcacagaacaauccuccccggcagcaucgcaaacucuauuugccagaacaucgagaucaucauccuggucacccugacgcuccugaucuucauccugcucuccauacugagcaagaccuacaucugcuacuuacucaugccgguguucauccccaucgccuacguguacgggaucaucuacaacaagucgugcaagaaguguaagcugugcggccuugucuaccaccccuucaccgagugcggaacccacugcgugugcggcgcaagauacgacacgagcgacaggaugaagcuccaccgcgccuccggccuuugccccggguacaagagccugcgggcggcccgcgugaugugcaagagcaagggcccggccuccauccucagcaucaucaccgccguccugguccugaccuuugucacccccaucaacucaauggugcucggggagagcaaggagguguucgagcucgaggagcugcccgacgacaugcucgagauggcucugcggaucaacuucuacuacuucacgugcauccugaacuacgcggucuccuggagccucgugaucaucggccugcugaccggccuccuguucaagcgcuaccagcacaaguuccugaacaucuacgccauguacugcgaagagugcgacauguaccacgacaaguccgggcucaagcggcacggcgacuucaccaacaagugccgccagugcacgugcgggcaguacgaggacgcaaccggccugaugacccaccggaagaccuacaacugccuggugcaguacaaggccaaguggaucaugaacuuccucaucaucuacaucuuccugguccugaucaaggacagcgccaucaucgugcaggcggccgggaccgacuucuccagcugccucgagacggaguccauaaacuggaacuguaccggccccuucuugaaccucggcaacugccagaagcagcagaagaaggagcccuacaccaacaucgccgcccagcucaaggggcugcgcgccaucagcgugcuggacauccccaugaucaccgagauccccgacgacaucgcguccgcucugcgguacaucgaggagcgcgaggccuuccacguccagcucacggccgaguaugcgaugcugacccgguacugcgacuacuacacccaguucagcgacaacuccggcuacagccagaccaccuggcgcguguaccugcgcucccacgacuucgaggccugcaucauguaccccaaccagcacuucugccggugcgugaagaacggggagaaaugcagcuccagcaacugggacuucgccaacgagaugaaggacuacuacagcggcaagcaagccaaguucgacaaggaccucaaccuggcacugacggcgcuccaccacgccuuccgcgggaccuccagcgccuacaucgcugccaugcuguccaagaaguccaacgacgaccugaucaccuauaccaauaaaauuaagacgaaauucccgggcaacgcgcuccugaaggcuaucaucgacuacaucgccuacaugaagggccugcccgggauggccuccuucaagcacgacgaguucugggacgagcuccuuuacaagccuacccccaccaaggccccgaaccuggcgcgcggccgcgagucauccuacaacuucaagcucgccaucagcuccaagucuaucaagaccugcaagaacguaaaggacguggccugccugagcccccggagcggggccaucuacgcguccaucaucgccugcggcgagcccaacgggcccagcguguaccgcaagccgucgaacggcgucuuccagagcuccaccgaccagagcauguacugccugcucgacagccacugccuggaggaguucgaggccaucucccaggaggaacuggacgccgugaagaaguccaagugcugggagaucgaguacccggacaucaagccccuccaggagagcgacggcaccaagagcugccggaugaaggacuccggcaacugcaacguggccaccaaccgcuggcccgucauccagugcgagaacgacaaguuuuacuacagcgagcugcagaaggacuacgacaagacccaggacaucggccacuacugccuguccccggggugcacgaccgugcgguaccccaucaaccccaagcacaucagcaacugcaacuggcaggucucccgcagcuccaucgcuaagaucgacgugcacaacauagaggacaucgagcaguacaagaaggccaucacccagaagcuccagaccagccugucccuguucaaguacgccaagacgaagaaccucccacacaucaagcccaucuacaaguacaucaccauagagggcaccgagaccgcagagggcaucgagagcgccuacaucgaguccgaggugcccgcgcuggccgggacgagcaucggcuucaagaucaacuccaaggaggggaagcaccuccuggacgugaucgccuacgucaaaagcgccuccuacagcagcguguacaccaagcuguacuccaccggccccaccucagggaucaacacgaagcacgacgagcugugcaccggcccgugccccgccaacaucaaccaccaggugggcuggcucaccuucgcgaaggagcggaccuccagcugggggugcgaggaguucggcugccuggccgucuccgacgggugcguguucggcagcugccaggacaucaucaaggaggagcuguccguguaccgcaaggagacggaggaggucaccgacguggagcucugccugaccuucagcgacaagaccuacugcacgaaccugaaccccgugacccccaucaucaccgaccucuucgagguccaguucaagaccguggagacuuacucacugccgcguaucguggccguccagaaccacgagaucaagaucgggcagaucaacgaccugggcguguacagcaaggggugcgggaacgugcagaaagucaacggcaccguguacgggaacggcgucccccgcuucgacuaccucugccaccuggccucgcggaaggaggucaucgugcgcaagugcuucgacaacgacuaccaggcgugcaaguuccugcagagcccugcguccuacaggcucgaggaggacagcgggaccgugaccgucaucgacuacaagaagauccugggcaccaucaagaugaaggccauccugggcgacgugaaguacaagacguucgccgacaacguggacauuaccgccgagggguccugcaccggcugcaucaacugcuucgagaacauccacugcgagcucacccugcacacgaccaucgaggcgagcugccccaucaaguccagcugcaccgucuuccacgaccgcauccuggugaccccgaacgagcacaaguacgcccucaagguggucugcacggagaagcccgggaacacccugaccaucaaggugugcaacaccaagaucgaggcguccauggcccuggucgacgccaagcccaucaucgagcucgcgcccguggaccagacagccuacauccgggagaaggacgagcgcugcaagaccuggaugugccgcgugcgggaugagggccugcaagucauccuggagccguucaagaaccucuucgggagcuacaucggcaucuuuuacaccuuuaucaucagcaucguggccuuacuggugauuaucuacauucuccugcccaucugcuucaagcugcgcgacacccuccggaagcacgaggacgccuacaagcgcgagaugaagauccgguga

SEQ ID NO: 15958 - RNA, 4326 nt, Artificial Sequence; identical to SEQ ID NO: 12672
  derived and/or modified CDS sequence (opt11) from LACV(LACV/06/NY(1)-M (06MS2900303))__GU206118.1__GP

SEQ ID NO: 15959 - RNA, 4326 nt, Artificial Sequence; identical to SEQ ID NO: 12673
  derived and/or modified CDS sequence (opt11) from LACV(LACV/06/NY(2)-M (06MS350140))__GU206109.1__GP

SEQ ID NO: 15960 - RNA, 4326 nt, Artificial Sequence; identical to SEQ ID NO: 12674
  derived and/or modified CDS sequence (opt11) from LACV(LACV/06/NY(3)-M (06MS270036))__GU206121.1__GP

SEQ ID NO: 15961 - RNA, 4326 nt, Artificial Sequence; identical to SEQ ID NO: 12675
  derived and/or modified CDS sequence (opt11) from LACV(LACV/65/OH-M (W17258))__GU206124.1__GP

SEQ ID NO: 15962 - RNA, 4326 nt, Artificial Sequence; identical to SEQ ID NO: 12676
  derived and/or modified CDS sequence (opt11) from LACV(LACV/67/NY-M (67-8109))__GU206115.1__GP

SEQ ID NO: 15963 - RNA, 4326 nt, Artificial Sequence
  derived and/or modified CDS sequence (opt11) from LACV(LACV/74/NY-M (74-32813))__GU206142.1__GP
augauccgcaugcuggugcucaucgucgugaccgcagccagccccguguaccagcgaugcuuccaggacggcgcaaucgucaagcagaauccguccaaggaggccgugacggaggucugccugaaggacgacguaagcaugauaaagacggaggcccgcuacgugaagaacgccaccgggguguucuccaacaacgucgccauccggaaguggcuggucagcgacuggcacgacugcaggcccaagaagaucgugggcgggcacaucaacgucaucgaggugggcgacgaccucucccugcacaccgagagcuacgugugcuccgcggacugcaccaucgggguggacaaggagacggcccaggugcggcugcagaccgacaccaccaaccacuucgagaucgccggcacgaccgucaagagcggcugguucaaguccaccacuuacaucacgcucgaucagaccugcgagcaccugaaggugagcugugggcccaaguccgugcaguuccacgccugcuucaaccagcacaugagcugcgugcgcuuccugcaccggaccauccuccccggcuccauagcuaacuccaucugucagaacaucgagaucaucauccuggucacccugacgcuccugaucuucauccugcuauccauccugagcaagaccuacaucugcuaccuacucaugccgaucuucauccccaucgcguacauguacggggugaucuacaacaaguccugcaaaaagugcaagcugugcggccuaguguaccaccccuucaccgagugcgggacccauugcgucugcggcgcccgcuacgacacgagcgaccggaugaagcuccaccgcgccuccggccugugccccggguacaagagccugcgggccgcgcgcgugaugugcaagagcaagggcccggccuccauccucagcaucaucacggcuguccuggugcugaccuucgugacccccaucaacuccaugguccucggggagagcaaggagacguucgagcuggaggagcugcccgacgauaugcuagagauggcccugcggaucaacuccuacuacuucacgugcauacugaacuacgccgugagcuggggccucaucaucgcgggccugcugguggggcucaucuucaagaaguaccagcaucgcuuccugaacaucuacgccauguacugcgaggagugcaacauguaccacgacaaguccggccugaagcgacacggggacuucaccaacaagugccgccagugcacgugcggccaguacgaggacgccaccgggcucaucacccaccggaagaccuacaacugucugguccaguacaaggccaaguggaugaugaacuuccugaucaucuacaucuuccucauacugaucaaggacagcgccaucguugugcaggcgaccggcaccgacuucacgaccugccuggagacggaauccauuaacuggaauugcaccggccccuuccucaaucuggggaacugccagaagcagcagaagaaggagccguacaccaacaucgccacccagcugaagggcuuaaaggccaucagcguccuggacauccccauaaucaccuccauucccgaugacaucgccggggcauuacgcuacaucgaggagaaggaggacuuucaugugcagcugaccacggaguacgccaugcucagcaaguacugcgacuacuauacccaguucagcgacaacagcggcuacucccagacgaccuggcggguguaccugcgcagccacgacuucgaggcaugcauccuguaccccaaccagcacuucugcaagugcgucaagaauggggagaagugcuccagcagcaacugggauuuugccaacgagaugaagaacuacuacagcggcaaacaggccaaguucgacaaggaccucaaccuggcgcugacggcccuccaccacgccuuccgggguaccucguccgccuacaucgccgcgaugcugagcaagaaguccaacgacgaccugaucgccuacaccaacaagaucaaggccaaauuuccggggaacgcccuccugaaggccaucauagacuacauagcguacaugaagggccugccugagauggccaacuucaaguacgacgaguucugggacgagcuccuguacaagcccaaccccgccaaggccagcaaccuggcccgugggaaggaguccucguacaacuuuaagcucgcuaucuccagcaaauccaucaagaccugcaagaacgugaaggacguggcaugccugagcccccgcuccggcgccaucuacuccuccaucaucgccugcggggagcccaauggccccagcgucuaccggaaacccuccggcgggguguuccaaagcuccacggaccgcagcaucuacugccuacucgacucccacugccuggaggaguucgaggcgaucucccaggaggagcuggacgccgugaagaaguccaagugcugggagauagaauauccggacguccggccccuccaagagagcgacggcgccaagagcugccgcaugaaggacuccgggaauugcaacguggccaccaaccgguggcccgugaugcagugcgagaacgacaaguucuacuacagcgagcugcagaaggacuacgauaagacccaggacaucggccacuacugccugucccccggcugcaccacuauccgcuacccgaucaacccuaagcacaucagcaacugcaacuggcaggucagccggagcagcaucgcaaagauugacgugcacaacguggaggacaucgagcaguacaagaaggcgauuacccagaaacuccaaaccagccugucccuguucaaguacgccaagaccaagaaccugccccacaucaagccgaucuacaaguacaucacuaucgaggggaccgagaccgcugagggcaucgagagcgccuacaucgaguccgagguccccgcgcuagcggggacgagcgugggcuucaagauaaacuccaaggaggggaagcaccuccuggacgugaucgccuacgucaagagcgccuccuacagcagcguguacgccaagcuguacuccacgggccccaccagcggcaucaacaccaagcaugacgagcugugcacugggcccugcccggccaacaucaaccaccaggugggcuggcuuacguucgcgcgcgagcggaccuccagcugggggugcgaggaguucggcugccuggccgucuccgacgggugcguguucggcagcugccaggacauuaucaaagaggagcuguccguguaccguaaggagaccgaggaggucaccaacguagagcucugccugacguucagcgacaagacauacugcaccaaccugaaccccguaacccccaucaucacggaccucuucgagguccaguucaagaccguggagaccuacucccugccccggaucgucgccguccagaaucacgagaucaagaucggccaaaucaacgaccuggggguguacagcaagggcugcgggaacgugcagaaggucaacggcaccguguacgggaacggcgugccccgcuucgacuaccucugccaucuggccucccggaaggaagucauagugcgcaagugcuucgacaacgacuaccaggccugcaaguuccugcagagcccugccuccuaccggcucgaggaggacagcggcacggugaccaucaucgacuauaagaaaauccuggggacgaucaagaugaaggccauccugggcgacgucaaguacaagaccuuugcggacuccguggacaucaccgccgagggcagcugcgcuggcugcauaaacugcuucgagaacauccacugcgagcuaacgcuucacaccacuaucgaggcauccugccccaucaagucuuccugcaccguguuccacgaucgcauccuggucacgccgaacgagcacaaguacgcccucaagaugguuugcaccgagaagccggguaacacccugaccaucaaggucugcaacacgcggaucgaggccagcauggcccugguggacgcgaagcccaucaucgaacucgcccccguggaccagaccgccuacauccgcgagaaagacgagcgaugcaagacguggaugugccgcguccgcgacgagggcuugcaagugauccuggaacccuucaaaaacuuauucggcagcuacaucgggaucuucuacaccuuuaucauaagcaucaucgcccuguuagugaucaucuacguccuccugccgaucugcuucaagcugcgggacacgcuccgaaaacacgacgaugccuacaaacgggagaugaagauccgcuga

SEQ ID NO: 15964 - RNA, 4326 nt, Artificial Sequence
  derived and/or modified CDS sequence (opt11) from LACV(LACV/93/MO-H)__GU206139.1__GP
augaucugcauccuggugcucaucaccgucgccgccgcgagccccguguaccagcgcugcuuccaggacggcgccaucgugaagcagaacccuuccaaggaagccgugaccgaggugugccugaaggacgacguguccaugaucaagacggaggcccgguauguccgcaacgccaccgggguguucucaaacaauguggccauccggaaguggcucguuagcgacuggcacgacugccgccccaaaaagaucguaggcgggcacaucaacgugaucgaagucggcgacgaccucucccugcacacugagagcuacgugugcuccgccgauugcaccaucgggguggacaaggagacagcccagguccggcugcagaccgacaccaccaaucacuuugagaucgccggcacgaccgucaagagcggcugguucaagucuaccaccuacaucacucucgaccagacuugcgagcaccugaaggugagcugcgggcccaaguccguccaguuccacgcgugcuucaaccagcacaugagcugcgugcgcuuccugcaccggaccauccuccccggcuccauagccaacagcaucugccaaaacaucgagaucaucauccuggugaccuugacgcuccugaucuucauccuacucuccauccugagcaagaccuacaucugcuaccugcucaugccgaucuucauccccaucgccuacaucuaugggaucaucuacaacaaauccugcaagaagugcaagcugugcggccuggucuaccaccccuucaccgagugcgggacccacugcgugugcggcgcccgcuacgacacgagcgaccgaaugaagcuccaccgcgcguccggccuuugccccggguacaagagccuacgggcggcccgcgugaugugcaagagcaagggcccggccuccauccucagcaucaucaccgccguccuggugcugacguucguaacccccaucaacuccauggugcucggagagagcaaggagacguucgagcuagaggaccugcccgacgacaugcucgagauggccucccggaucaacagcuauuaccugaccugcauccugaacuacgcgguguccuggggcuuagucauaaucggguugcuaaucgggcucuuguucaagaaguaccagcaccgcuuccugaacaucuacgccauguacugcgaggagugcgacauguaccacgacaagagcggccucaagcggcacggagacuucaccaacaagugccgccaguguaccugcggccaguacgaggacgccgccgggcugauggcccaccggaagacguacaacugccuggugcaguacaaagcgaaguggaugaugaacuuccuaaucaucuacaucuuucugauccugaucaaggacuccgccaucgugguucaggccgccggcaccgacuucacgaccugccucgagaccgagagcaucaacuggaacugcaccggccccuuccugaaccuggggaacugccagaaacagcaaaagaaagagccguauaccaacaucgcaacccagcucaagggccuuaaggcaaucuccgugcuggacgugcccaucaucaccgggauccccgacgacaucgccggugcccugcgcuacauugaggagaaggaggacuuccacguccagcucaccaucgaguacgccaugcugagcaaguacugcgacuacuacacccaguucagcgacaacagcggguacucccagaccaccuggagaguguaccugcgcagccacgacuucgaggcgugcauucucuaucccaaccagcacuucugccggugcgugaagaacggcgagaagugcuccagcuccaacuggggcuucgccaaugaaaugaaggacuacuauagcgggaaacagacgaaguucgacaaggaccugaaccuggcccucaccgcccugcaccacgccuuccgcggcaccagcuccgcguacauggccaccaugcucagcaaaaaguccaacgacgaccucaucgccuacacgaacaagaucaagaccaaguucccggggaacgcccugcugaaggccaucaucgacuacaucgcguacaugaagucccuccccggcauggcaaacuucaaguacgacgaguucugggaugagcugcuguacaagcccaacccugccaaggccagcaacuuagcccgcgggaaggagagcuccuauaacuucaagcuggcaaucagcuccaagagcaucaaaaccugcaagaacguaaaggacguggccugccuguccccgcggagcggcgccaucuacgccuccaucaucgcgugcggcgagcccaacggucccagcguguauaggaagcccuccggcggaguuuuccagagcuccaccgaccggagcaucuacugccuccuggacagccacugccuggaggaguucgaggccaucggccaggaagaacuggaugccgugaagaaguccaagugcugggagaucgaguacccggacgugaagcugauccaggagggagaugggaccaagagcugccgcaugaaggacuccggaaacugcaacgucgccaccaaccgauggcccgugauccaaugcgacaacgacaaguucuacuacagugagcuucagaaggacuaugacaagacccaggacaucgggcacuacugccucucccccggcugcaccacggugcgcuaccccaucaaccccaagcacaucagcaauugcaacuggcaaguuucccggagcuccaucgccaagaucgacgugcacaacaucgaagacaucgagcaguacaagaaagcgaucacccagaagcugcagaccagccuaucccucuucaaauacgccaagaccaagaaucuuccucacauaaagccgaucuacaaguacaucacgaucgaggguaccgagacggccgaaggaaucgagagcgccuacaucgaguccgaggugccggcccuggcggggacaagcaucggguucaagaucaacuccaaggagggcaagcaccuccuugacgucaucgccuacgucaagagcgccuccuacagcuccguguacaccaagcucuacagcaccgggccaacgaguggcauaaacaccaagcacgacgaacucugcacggggcccugccccgccaacaucaaccaccaggacggauggcugaccuucgcccgcgagaggaccuccagcuggggcugcgaggaguucgggugccuggcgguguccgacggcuguguguucggaagcugccaggacaucaucaaggaggaacucuccgucuaccguaaggagaccgaggaggucacggacguggagcugugccugaccuucagcgacaaaaccuacugcaccaaccucaacccggugacucccaucaucacugaccuguucgagguccaguucaagaccguggagaccuacucccugccccggaucguggccguccagaaccacgagaucaagaucggccagaucaacgaccucgggguguacaguaagggcugcggcaacgugcagaaagucaacgggacgaucuacggcaacggggugccccgcuucgacuaccugugccaucuggccucccggaaggaaguaaucguccgcaagugcuucgacaacgacuaccaggccugcaaguuccuccagagccccgcgagcuaccggcuggaggaggacagcggcaccgugacuauaauugacuacaagaagauccuggggaccaucaagaugaaggccauccucggcgacgugaaguacaagaccuucgccgacucagucgacaucacggcagagggcagcugcaccgggugcaucaacugcuucgagaacauccacugcgagcugacccuccacaccacgaucgaggccuccugccccaucaaaagcuccugcaccguguuucacgaccgcauccucgugacccccaacgagcacaaauacgcgcugaagguugugugcacggagaagcccggcaacacucugaccaucgaggugugcaacaccaagaucgaggccagcauggcccuugucgacgccaaaccgaucaucgagcuggcccccguggaucagaccacguacauccgggagaaggacgagcgcugcaagacauggaugugccggguccgcgacgaggggcuccaggugauccuggagcccuucaagaaccuguucggcuccuacaucggcauuuucuacaccuucaucauaagcaucguggcgcuuuuaguaaucaucuaugugcuguuacccaucugcuucaagcuccgcgacacccugcggaagcacgaggaugccuacaagcgcgagaugaagauccgguga

SEQ ID NO: 15965 - RNA, 4326 nt, Artificial Sequence; identical to SEQ ID NO: 12679
  derived and/or modified CDS sequence (opt11) from LACV(LACV/95/OH-H (CCH-MB96))__GU206136.1__GP

SEQ ID NO: 15966 - RNA, 4326 nt, Artificial Sequence; identical to SEQ ID NO: 12680
  derived and/or modified CDS sequence (opt11) from LACV(LACV/95/WV-H)__GU206133.1__GP

SEQ ID NO: 15967 - RNA, 4326 nt, Artificial Sequence
  derived and/or modified CDS sequence (opt11) from LACV(LACV/96/WV-M (WV96-3955))__GU206145.1__GP
augaucuacauccuggugcucaucgccgucaccgccgcgucacccguguaccagcgcugcuuccaggacggcgccaucgugaagcagaacccgaguaaggaggccgucaccgaggugugccugaaggacgacgugagcaugaucaagacggaggcccgguacauccgcaacgccaccggggucuucuccaacaacguggcgauccggaagugguuagugagcgauuggcacgauugccgccccaagaagaucaccggcgggcacaucaaugucaucgaggugggcgacgaccucucccugcacaccgagagcuacgugugcagugccgacugcacgaucggggucgacaaggagaccgcccaagugcggcugcagaccgacaccacgaaccacuucgagaucgccggcaccacagucaagagcggcugguucaaguccaccacguacaucacccucgaccagaccugcgagcaccugaagguuagcugcgggcccaaguccgugcaguuccacgcaugcuucaaccagcacaugagcugcgugcgcuuccugcaccggacuauccuccccggcuccaucgccaacagcauuugccagaacaucgagaucaucauccuggucacgcugacccuccugaucuucauccugcuuuccauccugagcaagaccuacaucugcuaccugcucaugccgaucuucauccccaucgccuacguguacgggaucaucuacaacaaguccugcaagaagugcaagcugugcggccugguauaccaccccuucaccgagugcgggacgcacugcgucugcggcgcccgcuacgacacgagcgaccgaaugaagcuccaccgcgccuccggccugugccccggguacaagagccuucgggcggcccgcgugaugugcaagucgaagggcccggccuccauccucagcaucaucaccgccgugcugguccugaccuucgugacgcccaucaacuccaugguccucggggagagcaaggagguguucgagcuggaggagcugcccgacgacaugcucgagauggcccugcggaucaacuccuacuacuucacgugcauccugaacuacgcggugagcuggggccucaucaucaucggccugcugacagggcuccuguuuaagaaguaccagcaccgcuuccugaacaucuacgccauguacugcgaggagugcgacauguaccacgacaaguccggccucaagcggcacggggacuucaccaacaagugccgccagugcacgugcggccaguacgaggacgccgccgggcugaugacccaccgaaagaccuauaacugccuaguccaguacaaggccaaguggaucaugaauuuccucaucguauacaucuuccugauccugaucaaggacagcgcgaucaucgugcgcgccgccggcacagacuucuccagcugccucgagaccgagaucaucaacuggaacugcaccggccccuuccugaaccuggggaacugccagcgucagcagaaaaaggaacccuacgcaaacaucgccgcgcagcucaagggacugaaggccauaaguguccuggacauccccaugaucaccgagauccccgacgacaucgccagcgcacuucgcuacaucgaggagcgagaagcguuccacgugcagcucaccgccgaguacgccaugcuuucccgcuacugcgacuacuacacgcaguucagcgacaacuccggguacagccagaccaccuggcgcguguaccugcggucccacgacuucgaggccugcauccucuaccccaaccagcacuucugccgcugcgucaagaacggcgagaaguguagcuccgccaacugggacuucgcgaacgagaugaaggacuacuacagcgguaagcaggcgaaguucgacaaggaccugaaccuggcccucaccgccaugcaccacgccuuccggggaaccagcuccgcguacauggccgcaaugcuguccaagaaguccaacgacgaccugaucacguacaccaacaagcucaagaccaaguucccgggcaacgcccugcugaaggccaucaucgauuacaucgcguacaugaaggggcucccaggcauggccaacuucaagcacgacgaguucugggacgagcugcuguacaagcccacccccacgaaggccccgaaccucgcccgcgggcgggagagcuccuacaacuucgagcuggcgaucagcuccaagagcaucaagaccugcaagaacgugaaggacguggccugccugagcccccgcagcggcgccaucuacgccuccaucaucgccugcggggaacccaacggcccaagcgucuaccggaagccgucaggcgggguguuccagagcuccacugaucagagcauguacugccuccuggacucccacugccuugaggaguucgaggcgauaagccaggaggagcucgacgccgugaagaaguccaagugcugggagaucgaguaccccgacgucaagcuguuacaagagaacgacggcaccaaguccugccgcaugaaggacagcgggaacugcaacguggccacgaacagauggcccgugauccagugcgagaacgacaaguucuacuacuccgagcuucagaaggacuacgacaagacccaggacaucggccacuacugccugagccccggcugcgccaccauccgcuacccgaucaaccccaagcacaucuccaacugcaacuggcaggucucccgguccagcaucgccaagaucgacgugcacaacaucgaggacauugagcaguacaagaaggcgaucacccagaagcugcagacgucccucagccuguucaaguaugccaagaccaagaaccugccccacaucaagccgaucuacaaguacaucaccaucgaggggacagagaccgccgaaggcaucgagucggccuacaucgagagcgaggugcccgcccucgcggggaccuccaucggcuucaagauuaacagcaaggaggggaagcaccuccuggacgucaucgccuacgugaaauccgccagcuacuccagcguguacaccaagcuguacuccaccggccccaccagcggcgucaacaccaagcacgacgagcugugcaccgggcccugcccggccaacaucaaccaccaggugggcuggcugaccuucgcgcgcgaacggacgucauccugggggugcgaggaguucggcugccucgccgugagcgacgggugugucuucggcuccugccaggacaucaucaaggaggaacugagcguguaccgaaaggagaccgaggaggugaccgacgucgagcugugccucaccuucuccgacaagacguacugcaccaaccugaaccccgugaccccuaucaucaccgaccuguucgaggugcaguucaagacggucgagaccuacagucucccccggaucguggccgugcagaaccacgagaucaagaucggccagaucaacgaccugggggucuacuccaaaggcugcgggaacgugcagaaggugaacggcaccaucuacgggaacggcgucccgcgcuucgacuaccugugccaccucgccagccggaaggaggugaucgugcgcaagugcuucgacaacgacuaccaggccugcaaguuucugcagucccccgcgagcuaccggcuggaggaggacuccggcaccgucacgaucaucgacuacaagaagauccucggaaccaucaagaugaaggccauccugggcgacgugaaguacaagaccuucgccgacaacguagacaucaccgccgaggggagcugcaccggcugcaucaacugcuucgagaacauucacugcgagcugacgcuccacaccaccaucgaggcauccugccccaucaagagcuccugcaccgucuuccacgacaggauccuggugacgcccaacgagcacaaguacgcgcugaagguggucugcaccgagaagccugggaacacccucaccaucaaggugugcaacacgaagaucgaggccgccauggcccugguggacgccaagcccaucaucgagcuggcgcccgucgaccagaccgccuacauucgcgagaaggacgagcggugcaagaccuggaugugccgcgugcgggacgagggccuccaagucauccuggagcccuucaagaaccuguucggcagcuacaucgggaucuuuuacaccuucaucaucuccaucguggcccuccuggugaucaucuacauccugcucccgaucugcuucaagcugcgcgacacgcugcggaagcacgaggacgccuacaagcgcgagaugaagauccgguga

SEQ ID NO: 15968 - RNA, 4326 nt, Artificial Sequence; identical to SEQ ID NO: 12682
  derived and/or modified CDS sequence (opt11) from LACV(LACV/97/NC-M (NC97-7306))__GU206127.1__GP

SEQ ID NO: 15969 - RNA, 4326 nt, Artificial Sequence
  derived and/or modified CDS sequence (opt11) from LACV(LACV/human/1960)__EF485031.1__GP
augaucugcauccugguucugaucaccgucgccgccgcgagccccguguaccagcgcugcuuccaggacggcgccaucgugaagcaaaauccguccaaggaggccgucaccgaggugugccugaaagacgacgugagcaugaucaagacggaggcccgguacguacgcaacgcaaccggggucuucuccaacaacguggcgauccguaaauggcuugucagcgacuggcacgacugccgacccaaaaagaucgugggcggccacaucaacgucaucgaggucggcgacgaccucucccugcacaccgagagcuacgugugcagugccgacugcaccaucgggguggacaaagagacggcacaggugcggcugcagaccgacacaaccaaccacuucgagaucgccggcacgaccgucaagagcgguugguucaaguccaccaccuacaucacgcucgaccagacuugcgagcaccugaaggugagcugcgggcccaaguccguucaguuccacgcgugcuucaaucagcacaugagcugcgugcgcuuccugcaccggaccauccucccaggcuccaucgccaacagcaucugccagaacaucgagaucauaauccuggugacccugacgcuacugaucuucauccugcucuccauccugagcaagaccuacaucuguuaccugcugaugccgaucuucauccccaucgccuacaucuacgggaccaucuacaacaaguccugcaagaaaugcaagcugugcggccuggucuaccaccccuucaccgaaugcggcacgcacugcgugugcggcgcccgcuacgauaccagcgaucggaugaaacuucaccgcgccucuggccucugccccggguacaagagccuccgggcggcccgcgugaugugcaagagcaagggcccagccuccauccucagcaucaucaccgccguccuggugcugaccuuugucacgcccaucaacucaauggugcucggggagagcaaggagacuuucgaacuagaagaccugcccgacgacaugcuagaaauggccucccggauaaacagcuacuacuuaaccugcauacugaacuacgcgguguccuggggccucgucaucaucggccugcugaucgggcuccuguucaagaaguaccagcaccgcuuccugaacguauacgccauguacugcgaggagugcgacauguaccaugacaagagcggccugaaggggcacggcgacuucaccaacaagugccggcagugcacgugcgggcaguacgaggacgccgcuggccuaauggcccaccgcaagaccuauaacugccuggugcaguauaaggcgaaguggaugaugaacuuccucaucaucuacaucuuccugauccuaaucaaggacucagccaucgucgugcaggccgccggcaccgacuucaccacgugccucgagaccgagagcaucaacuggaacugcaccgggcccuuccugaaccugggcaacugucagaagcagcagaagaaagagcccuacaccaacaucgccacgcagcucaaggggcuuaaggcgaucuccgugcuggacguccccaucaucaccggcauccccgacgacaucgccggggcccugcgguacauugaggagaaggaggacuuccacgugcagcucaccaucgaguacgccaugcugagcaaguacugugacuacuacacccaguucuccgacaacagcggcuacucccagaccacguggcgcguguaccugcggagccacgacuucgaggcuugcaucuuauaccccaaucagcacuucugccgcugcgucaagaacggcgagaaaugcuccagcuccaacugggacuucgccaacgagaugaaggacuacuacuccggcaagcagaccaaguucgacaaggaucugaaccucgcacucaccgcccuccaucacgccuuccggggcacaagcuccgcguacaucgccacgaugcugagcaagaagucgaacgacgaccucaucgccuacaccaauaagaucaagaccaaguucccgggggaugcccugcugaaggccaucaucgacuacaucgcguacaugaagucccugcccggcauggcgaacuucaaguacgacgaguucugggacgagcugcucuacaaacccaacccggccaaggccagcaaccucgcccgcgggaaagagagcuccuacaacuucaagcuggcgaucagcuccaagagcaucaagaccugcaagaacgugaaggacguggccugccuguccccgcgcagcggcgccaucuacgccuccaucaucgcgugcggugagccgaacgggcccagcgucuaucggaaacccuccggcgggguguuccagagcuccacggaccagagcaucuacugucuccuggacagccacugccuggaggaguucgaggccaucggccaggaggagcuugacgccguuaagaagucuaagugcugggagaucgaguacccggacgugaagcugauccaggagggcgacgggaccaagagcugccgcaugaaggacuccggcaacugcaauguggccacgaaccgguggcccgugauccagugcgagaacgacaaguucuacuauagcgagcugcagaaggauuacgacaagacccaggauaucgggcacuacugccucucccccggcuguacgaccguccgcuaccccaucaacccgaagcacaucagcaacuguaacuggcaggucucccggucgaguaucgccaagaucgacgugcacaacaucgaggacaucgagcaguacaaaaaggccauuacccagaagcugcagaccagccucucccucuucaaguacgccaagacgaagaaccuaccacacaucaagcccaucuacaaguauaucaccaucgaggggaccgagacagccgagggcaucgagagcgccuauaucgaguccgaggugccggcccuggcggguacaagcaucggguucaagauaaacucuaaggagggcaagcaccuccuggacgugauagccuacgucaagagcgccuccuacagcuccguguacaccaagcuguacagcaccgggcccaccagcggcauuaacacgaagcacgacgagcucugcacugggcccugccccgccaauaucaaccaccaggugggcuggcugaccuucgcccgcgaacgaaccuccagcuggggcugcgaggaauuugggugccuagcgguauccgacgguugcgucuucgggagcugccaggacaucaucaaggaggagcuaaguguauaccgcaaggagacggaggaggugaccgacgucgagcugugccugaccuucagcgacaagaccuacugcaccaaccucaaccccgugacccccaucaucaccgaccuguucgaggugcaguucaagaccgucgagacguacucucugccccggaucguggccgugcagaaccaugaaaucaagaucggccagaucaacgaccucgggguuuacagcaagggcuguggcaacgugcagaaggugaacgggaccaucuauggcaacggggucccccgcuucgacuaccugugccaucuagccucccggaaagaggugaucgugcgcaagugcuucgacaacgacuaccaggccugcaaguuccuccagagcccggcguccuaccggcuggaggaggauagcggcaccgucaccaucaucgacuacaagaagauccuggggacaaucaagaugaaggccauccucggcgacgugaaguacaagaccuucgccgacuccguggacaucaccgcagagggcagcugcaccgggugcauuaacugcuucgagaacauccacugugagcugacguuacacacgaccauugaggccucgugccccaucaaguccuccugcaccgucuuccacgacaggauccucgugacccccaacgagcacaaguacgcgcugaagauggugugcacagagaagcccggcaacacccuuaccaucaaagucugcaacacgaagaucgaggcgagcauggcccucgucgacgccaagccgauaaucgagcuggcccccguagaucagacggcguacauccgggagaaagacgagcgcugcaagaccuggaugugccgggugcgcgacgaggggcuccagguuauccucgagcccuucaagaaccuguucggcuccuacaucggcaucuucuacaccuucaucaucucaaucgucgccuuacucgugaucaucuacgugcugcugcccauuugcuucaagcuccgggacacucuacguaagcacgaggacgccuacaagcgcgaaaugaagauccgguga

SEQ ID NO: 15970 - RNA, 4326 nt, Artificial Sequence; identical to SEQ ID NO: 12684
  derived and/or modified CDS sequence (opt11) from LACV(LACV/mosquito/1978)__EF485037.1__GP

SEQ ID NO: 15971 - RNA, 4326 nt, Artificial Sequence
  derived and/or modified CDS sequence (opt11) from LACV__KP271111.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcagcaucgggguggacaaggagaccgcccaggugcgccugcagacggacaccaccaaccacuucgagaucgccggcaccacggucaaguccggcugguucaagagcaccaccuacaucacccucgaccagacgugcgagcaccugaagguguccugcgggcccaagagcgugcaguuccacgcgugcuucaaccagcacauguccugcguccgguuccugcaccgcaccauccuccccggcagcaucgccaacuccaucugccagaacaucgagaucaucauccuggugacccugacccuccugaucuucauccugcucagcauccuguccaagacguacaucugcuaccugcucaugccgaucuucauccccaucgccuacauguacgggaucaucuacaacaagagcugcaagaagugcaagcugugcggccugguguaccaccccuucaccgagugcgggacccacugcgucugcggcgcccgguacgacaccuccgaccgcaugaagcuccaccgggccagcggccugugccccggguacaagagccugcgcgcggcccgggugaugugcaaguccaagggcccggccagcauccucuccaucaucacggccgugcugguccugaccuucgugacccccaucaacagcaugguccucggggaguccaaggagaccuucgagcuggaggagcugcccgacgacaugcucgagauggccagccgcaucaacuccuacuacuucacgugcauccugaacuacgcggugagcuggggccuggugaucaucggccuccugaccgggcuccuguucaagaaguaccagcaccgguuccugaacgucuacgccauguacugcgaggagugcgacauguaccacgacaaguccggccugaagcgccacggggacuucaccaacaagugccggcagugcacgugcggccaguacgaggacgccgccgggcucauggcccaccgcaagaccuacaacugccuggugcaguacaaggcgaaguggaugaugaacuuccugaucaucuacaucuuccucauccugaucaaggacagcgccaucgugguccaggccgccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggcgaucagcgugcuggacauccccaucaucacggggauccccgacgacaucgccggcgcccugcgguacaucgaggagcgcgaggacuuccacgugcagcugaccaucgaguacgccaugcucuccaaguacugcgacuacuacacccaguucagcgacaacuccggguacagccagaccaccuggcgggucuaccugcgcucccacgacuucgaggcgugcauccuguaccccaaccagcacuucugccgcugcgugaagaacggcgagaagugcagcuccagcaacugggacuucgccaacgagaugaaggacuacuacagcggcaagcagacgaaguucgacaaggaccucaaccuggcccugaccgcccuccaccacgccuuccgggggaccuccagcgcguacaucgccaccaugcuguccaagaaguccaacgacgaccugaucgccuacacgaacaagaucaaggccaaguucccgggcaacgcccuccugaaggcgaucaucgacuacaucgccuacaugaagucccugcccgggauggccaacuucaaguacgacgaguucugggacgagcuccuguacaagcccaaccccgccaaggccagcaaccuggcgcgcggcaaggagagcagcuacaacuucaagcucgccaucuccagcaaguccaucaagaccugcaagaacgugaaggacgucgccugccugagcccgcgguccggggccaucuacgcgagcaucaucgccugcggcgagcccaacggccccuccguguaccgcaagcccagcgggggcguguuccaguccagcaccgaccggagcaucuacugccugcucgacucccacugccuggaggaguucgaggccaucaaccaggaggagcuggacgccgucaagaaguccaagugcugggagaucgaguacagcgacgugaagccgcuccaggagggggacggcaccaagagcugccgcaugaaggacuccggcaacugcaacguggccacgaaccgguggcccgucauccagugcgagaacgacaaguucuacuacagcgagcugcagaaggacuacgacaagacccaggacaucgggcacuacugccugucccccggcugcaccaccgugcgcuaccccaucaacccgaagcacaucagcaacugcaacuggcaggucucccggagcuccaucgcgaagaucgacgugcacaacaucgaggacaucgagcaguacaagaaggccaucacgcagaagcuccagaccagccugucccuguucaaguacgccaagaccaagaaccucccccacaucaagcccaucuacaaguacaucaccaucgaggggacggagaccgccgagggcaucgagagcgccuacaucgaguccgaggugccggcgcuggccgggaccagcaucggcuucaagaucaacuccaaggagggcaagcaccuccuggacgugaucgccuacgucaagagcgccuccuacagcagcguguacgccaagcuguacuccaccgggcccacgagcggcaucaacaccaagcacgacgagcugugcaccgggcccugccccgcgaacaucaaccaccaggugggcuggcucaccuucgccaaggagcgcacguccagcugggggugcgaggaguucggcugccuggccgucuccgacggcugcguguucgggagcugccaggacaucaucaaggaggagcuguccguguaccggaaggagaccgaggaggucaccgacguggagcucugccugaccuucagcgacaagacguacugcaccaaccugaacccggugacccccaucaucaccgaccucuucgagguccaguucaagacgguggagaccuacucccugccccgcaucguggccguccagaaccacgagaucaagaucggccagaucaacgaccuggggguguacagcaagggcugcgggaacgugcagaagaucaacggcaccgucuacggcaacggggugccccgguucgacuaccucugccaccuggcgucccgcaaggaggugaucguccggaagugcuucgacaacgacuaccaggccugcaaguuccugcagagcccggccuccuaccgccucgaggaggacagcggcaccgugacgaucaucgacuacaagaagauccuggggaccaucaagaugaaggccauccugggcgacgugaaguacaagaccuucgccgacuccgucgacaucaccgcggaggggagcugcaccggcugcaucaacugcuucgagaacauccacugcgagcucacgcugcacaccaccaucgaggccuccugccccaucaagagcuccugcaccguguuccacgaccggauccuggugacgcccaacgagcacaaguacgcccucaagauggucugcaccgagaagcccggcaacacccugaccaucaaggugugcaacacgaagaucgaggccagcauggcccugguggacgcgaagccgaucaucgagcucgcccccgucgaccagaccgccuacauccgcgagaaggacgagcggugcaagaccuggaugugccgcgugcgcgacgaggggcugcaggucauccuggagcccuucaagaaccucuucggcagcuacaucgggaucuucuacaccuucaucaucuccaucguggcccugcuggugaucgucuacgugcuccugcccaucugcuucaagcugcgggacacgcuccgcaagcacgaggacgccuacaagcgggagaugaagauccgcuag

SEQ ID NO: 15972 - RNA, 4263 nt, Artificial Sequence; identical to SEQ ID NO: 12686
  derived and/or modified CDS sequence (opt11) from OROV(BeAn19992)__NC_005775.1__GP

SEQ ID NO: 15973 - RNA, 4263 nt, Artificial Sequence; identical to SEQ ID NO: 12687
  derived and/or modified CDS sequence (opt11) from OROV(BeH759021)__KP691607.1__GP

SEQ ID NO: 15974 - RNA, 4263 nt, Artificial Sequence; identical to SEQ ID NO: 12688
  derived and/or modified CDS sequence (opt11) from OROV(BeH759022)__KP691610.1__GP

SEQ ID NO: 15975 - RNA, 4263 nt, Artificial Sequence; identical to SEQ ID NO: 12689
  derived and/or modified CDS sequence (opt11) from OROV(BeH759040)__KP691616.1__GP

SEQ ID NO: 15976 - RNA, 4263 nt, Artificial Sequence; identical to SEQ ID NO: 12690
  derived and/or modified CDS sequence (opt11) from OROV(BeH759146)__KP691631.1__GP

SEQ ID NO: 15977 - RNA, 4263 nt, Artificial Sequence; identical to SEQ ID NO: 12691
  derived and/or modified CDS sequence (opt11) from OROV(BeH759620)__KP691622.1__GP

SEQ ID NO: 15978 - RNA, 4263 nt, Artificial Sequence; identical to SEQ ID NO: 12692
  derived and/or modified CDS sequence (opt11) from OROV(BeAn19991)__KP052851.1__GP

SEQ ID NO: 15979 - RNA, 4263 nt, Artificial Sequence
  derived and/or modified CDS sequence (opt11) from OROV(Tr9760)__AF312381.2__GP
auggccaacuuaaucaucaucagcauggugcucuccaucgccuacggccacccccugagcaccucccagaucggggaccgcugcuucgcuggcgggaaccuguucaaggagaugaaccucagcgucggccugggggagaucugcgugaaggacgacaucuccaucgugaaguccaccacggucuucuccaagaacaagcuggcccucgaggccaccaccaaguuuuaccgcagcuucaucgugaaggacugguccgagugcaacccggugcuggacaaguucgggaacuucaugguccugagcguggacgauaacggccacaccauccccaagauguacacgugccgcgcugccugcgacauccggcucaacaaggacaacgcggagaucauccuguccagcaccaagcucaaccacuucgagaucguggggaccaccuccacgagcggcugguucaagaacaccaucaccaacaaucucgagcacacgugcgagcacgucacggugaacugcgggcagaaguccgugaaguuccacgccugcuuccgccagcaccggggaugcguccgcuucuucaaggggaccuauaugccccacagcaugaucgaggccaugugcgugaacaucgagcugaucauccugacccucuacaucuucgccgccaucaucuucgcccucaucauaaccaaguccuacguggcuuaccuccucuuaccccuguucuacccggccacgugguucuacggcaaggucuacaagaagaucaauagcugccccaacugccuccuggccucccaccccuucaccagcugccccaagaucugcaucugcggcagccgguucuccugcaccgaggcgcugaaagugcaccgcauggggaaggacugccucggcuacaagagccuguccaaggcccggcagaugugcaaaagcaaguccuggagcuucaccgccgccauccugacggggcucauccugauggaguucaucuccccgaucgccggcgagcgcauguacaagcuggaggagcucgcggacgaguucaucaagcugaccgagcaggucaacauucuggagcgggagauggaggugcucaagcaaagcaucauugugauguucgccaucauccuggugcugcuucuguucgagaacaugaucuucaaccgccuguuccggaucuucuaccgcuccugcagcaugugcggccucauccacuaccggcccgggcugaagaucgaccugaccaagaccaaccgcugcggcuccugcaucugcggguucgacgagcagcagagcuccggcuucgaguacgagaucuuccucacggacaugcacguccagaaggagagcugcaaguuuagcccccgggugaaccacuuccgcaacaccaaagcccugcuguucgcccucgugaucugcgccaccaucuacaccgucuacgcggacgaggacugccugaguaaggacaucaagaucacguaccaggagcugcauaacugcaucggccccaagaucaugggcgacacgugcguuuccaagagcgagcucuacuccgaccuguucagcaagaaccuggucaccgaguaugacaagaaguacuucgagccggacaccgugaacgaccaguucaacaagaucgaguucgcccaggacgcccaccggaugauccugcucgagcgcauccuguacaagaccgagugcgagaugcugagccucaagaagaacuccggccccuacaacguggccuggcggacccacuugaagaaccacaacaucgaccugugcagccgccacaacuacaagaugaucugccagugcaucaacgcacacuccaugugcaagaacaccgacaucgacuacaacaaggagaucgagaccuacuacaagagcaacgcggccgccuaccgcgccgggcucaacacgaucauggacacccugaagaccgcguucagaggccugaccaagguccucaucgagaacuacaucgagaaggacgacuccgacgcccugaaggcccuguucagcaacaucaccgacuccguucaggacaacuaccagaugaucgggauccucaaguucgccagcaagcugcuggacaucaaccucgggcgcuccacgcggagcgcccaccacuccaucaugaccaacgagauccccaagagcaaccccuucaccgacuacagcuacagcaacgugaacaucaaagagugcauguccccggagagccugaagugcuucaagaaacgcgacuccacgccccauaccaaccaccuccugugcaagaucgacaacaaguacaaggcguucgacuggcccgagaucgagaccauccagaaggggcagaagcugugccugggcgacagccacugcaaccucgaguucaccgccaucaccgccgaccggaucaugagccugacgaacugcuacaaggagucguucaccgcucaacccgccgacaugcaggcgggcaucaagaagugcagcgccgacgagaucggggagugcaccacccuggaggacaagacguggcccaucgucuucugcuccggcaaguacuacuacagcgacuccaaggagcacgccaaggacgggagcaucaacaacuacugucucacaaacaagugcuccgagcagcgcuuccccauccacgagaacugguucaagaagugcaacugggacaagacccacaaggaguuccggcccuacgaaaccaacaacuacaacgacaucacgagcuaccgcaaggccaucgaguccgagaucggcaccgaucucaugacccaccacuacaagcccaccaagaaccugccacacguggugccccgguaccacagcaucgacguccaggggacggaguccaccgagggcaucaucaacggcuucauccagaacaccauccccgccaucagugggcucgacgugggcuaccaccugaacuucaagggcaaccaacucuucgacaucgugaucuucgucaagaaggcgguguacaaggcucaguaccagaaggccuacaccacgggccccuccaucagcaucaauaucgagcacaacgagcgcugcacaggccacuguccggagaagauccccgcuaaggagggauggcucaccuucuccaaggagcacaccagcuccuggggcugcgaggaguacgggugccuggcgaucgacacgggcugccuguacgggagcugccaggacgucauccggcccgagcucgacgucuacaagaagaucggcuccgaggccagccugaucgagaucugcaucacacugccucacgagaccuacugcaacgacauggacauccucgagcccaucaucggcgacaagcugagcgccuccuuccagaacacccagacgaaccagcugcccacccucaucgccuacaagaaggggaagaucuacaccggccagaucaacgacaucgggaacaccgcccugcagugcggcagcauccaggugaucaacggguccacgaucggcaccggcagccccaaguucgacuacaucugccacgcuaugcgccggaaggacgugaucguccgcaagugcuucaacgacaacuaccaguccugcacccggcuggagaaacgcaacgaccucaucccguaccggaagggggacgugaucgaggugagcaagaccggcuccaacauggggcagaugaccuucaagaucgagcugggcgacaucaacuacaagaucuucaccaagagcguugaccuccagauguccgggaucugcgccggcugcaucgacugcgccgagggcauuagcugcuccaucaacgccgaaguucccgccgagacagugugccauugcaagaccaacugcgaggacuucaucaacaacaucgucuucagcccccagaucaagaacuacaacaucaaggugcacugcaaguccaagguggagaagauaaccgcgcacaucugcgggcgcgacaucgaccuccagcugacggucaagcccuacaaccagaagaucgaccugagccagcucgacgaguccaacuacauccgggaggaggaccugcagugcggcaccuggcugugcaaggugcagaaggaggggauugacaucauguucaagggucucuucagcgggcugggccgcuacuggaccauccugaucuacuccaucaucgggguggucaucaucgugauccucguguacauccugcugccgaucgggcgccuccugaaggccuuccugauccggcacgagaucgaguacgccauggagcagaagaucaaguga

SEQ ID NO: 15980 - RNA, 4263 nt, Artificial Sequence; identical to SEQ ID NO: 12694
  derived and/or modified CDS sequence (opt11) from OROV(TRVL-9760)__KC759123.1__GP

SEQ ID NO: 15981 - RNA, 4263 nt, Artificial Sequence; identical to SEQ ID NO: 12695
  derived and/or modified CDS sequence (opt11) from OROV(TVP-19244/DEI-216)__KP795073.1__GP

SEQ ID NO: 15982 - RNA, 4263 nt, Artificial Sequence
  derived and/or modified CDS sequence (opt11) from OROV(TVP-19249/GML-444672)__KP795076.1__GP
auggccaaucugaucaucuucagcaucauccucggcaucgccuacgggcacccccuguccaccucgcagaucggcgaccgcugcuucgccgggggcucccuguucaaggagaugaaccucagcgugggucuaggagagaucugcgucaaggacgacaucuccaucgucaagagcaccacggcguucuccaaaaacacccuggcccucgaggccaccaccaaguucuaccggagcuucauagugaaggacugguccgagugcaacccggugcuggacaagcugggcaacuucauggugcucaacguggacgacaacgggcaccuggucccccgcauguacacgugccgggccgcgugugacauccgcuuaaacaaggacaacgccgagaucauccucagcuccaccaagcugaaccacuucgagaucgugggcaccaccagcacguccggaugguuuaagaacaccaucaccaacaacuuggagcacacgugcgagcacgugacggucaacugcggccagaaguccgugaaguuccacgccugcuuccggcagcaccgcgggugcauccgauucuucaagggcaccuacaugccuuacuccaugaucgaggccaugugcaucaacaucgagcucaucauccugacccuguacaucuucgcggccaucaucuucgcccucaucaucacaaagagcuacaucgccuaccugcugcucccccuguucuacccggugacguggcuguacggcaaggucuacaaacgcaucaacuccuguagcaacugccuccuggccucccacccuuucaccagcugccccaagaucugcaucugcgggagccgauucuccugcaccgaagcgcugaagguccaccgaaugggcaaggacugccucggguacaagagccuguccaaggcccggcagaugugcaagagcaaguccuggagcuucaccgccgccauccugacgggccucauccugauggaguucgugucccccaucgccggcgagcgcauguacaagcuggaggagcucgccgacgacuacaucgagauggccgagcgggucgggaugcuggagaaggagaucaaggugcuuaaacaguucaccaucgugaugcucgucauuauccucauccuguugcuguucgagaacacgaucuucaacuacuuguucaacacccucuaccgcagcugcuccaugugcggccugauccacuaccggccggggcugaagguggaccucacgaagacaaacaagugcggcagcuguaucugcggguucgacgagcagcaguccagcggcuucgaguacgagguguuccugaaggacaugcacauccagcgcgaguccugcaaguuuggcccccgggucaaccacuuccgcaacaccaagauccugcuguucaccaucgcaaucugcacgagcuucuacaccguguacgcagacgaggacugccuguccaagaacaucaagaucaccuaccaggagcugcacaacugcaucgggcccuacaucaugggcgacacgugcgugagcaaguccgagcuguacagcgaccuccuguccaagaaccuuaucaccgaguacgacaaaaaguacuucgagcccgacaccgucaacgaccaguucaacaagaucgaguucgcccaggacgcgcaccgcaugauccuccuggagcgcauccuguacaagacagagugcgagaugcucagccugaagaagaacagcgggccguacaacguggccuggagaaccuaccugaagaaccacaacaucgaccucugcagucgacacaacuacaagaugaucugccagugcaucaacaugcacagcaugugcaagaacacggacaucgacuucaacaacgagaucgagaccuacuacaaggccaacgcagccgcguaccgcuccgacuucuacaccaucaucgacacccugaagaccgccuuccggggccugacgaagguccucaucgagaacuacaucgagaaggacgacagcgacgcccugaaggcccuguucuccaacaucaccaacagcgugcaggacaacuaccagaugguugggguccuuaaguucgcguccaagcuguugaacaucagccuaggccguuccacccggagcgcccagcacucaaucaugaccaacgagauccccaagagcaaccccuucacggacuacuccuacagcuccgugaacaucaaggagugcaugagccccgaaucccugaagugcuucaagaagcgcgacagcgugccgcacaccaaccaccuccucugcaaaauggacaacaaguacaaggccuucgacuggcccgagaucgagaccguccagaaaggccagaagcugugucugggggacagccacugcaaccucgaguucacugccauuacggccgauaagaucaugucccugaccaacugcuauaaggagagcuucacugcgcagcccgccgacaugcagaccggcaucaagaagugcuccgccgacgagaucggggagugcaucacgcuggaggacaaggccuggcccaucguggugugcggcgacaaguacuacuacagcgacgggaaagagcacgccaaggacggguccaucaacaacuacugccucgcgaacaagugcagcgaacagcgguucccgauccacaagaacugguucaagaagugcaacugggacaagacccacaaggaguucaccaccaugcgccagaucaacuacaacgacaucacguccuaccggaaggccaucgagagcgagauaggcaccgaccugaugacacaccacuacaagcccaccaagaaccugccccacgucgugccccgcuaccacuccaucgacgugcaggggacggagagcaccgagggcaucaucaacggguucauccagaacaccaucccggccaucuccggcuuaggcgucgguuaccaccuggguuuccgggggaaccagcuguucgacaucgugaucuucgugaagaaggccgucuacaaggcccaguaccagaagguguacaccacgggccccagcaucuccauaaacaucgagcacaacgagaaaugcaccgggcacugccccgagaagauccccgcgaaggagggcuggcucaccuucagcaaggagcacaccuccagcuggggcugcgaggaguacgggugccuggccaucgacacgggcugccuguacggcuccugccaggacgugauccgcccggagcucgacaucuacaagaagaucggcagcgaggccucccugaucgagaucugcaucacccugccccacgagaccuacugcaacgacauggauauccucgagcccaucaucggggacaagcugagcgcgagcuuccagaacacccagacgaaccagcugccgguccucauggcguacaagaagggcaagguguacaccggccagaucaacgacguggggaacaccgcccugcagugcggcuccauccaggucgugaacggcagcacaaucggcuccgggaaccccaaguucgacuacaucugccacgccaugcggcgcaaggacgugaucguccggaagugcuucaacgacaacuaccagagcuguacgcgccuggacgcucggaacgaccucauccccuaucgcaagggcgacaucaucgagaucuccaagaccggcagcaacauggggcagaugaccuucaagaucgagcuaggcgacaucaacuacaagaucuucaccaaauccguggaccugcagaugagcgggaucugcgccggcugcaucgacugcgcggaggggaucuccugcagcaucaacgccgacguguccgccgagaccgucugccacugcaagacaaacugcgaggacuucaucuccaacaucgugaucagcccccagaucaagaccuacaacaucaaggugcacugcaagucaaaggucgagaagaucaccgccaacaucugcggccggaacaucgaccuccagcugaccgugaagccguauaaccagaagaucgaccugucccagcucgacgagagcaacuacaucaaggaggaggaccugcagugcggcacguggcugugcaaggugcagaaggaggggaucgacaucgucuucaagggccucuucuccggucugggcaaguacuggaccauccugaucuauagcaucaucggcaucaucgugaucgugcuccugaucuacguccugcuucccaucgggcgccugcugaaggccuuccucaucaagaacgagaucgaguacaccauggagcagaagaucaaguga

SEQ ID NO: 15983 - RNA, 4263 nt, Artificial Sequence; identical to SEQ ID NO: 12697
  derived and/or modified CDS sequence (opt11) from OROV(TVP-19254/GML-480914)__KP795082.1__GP

SEQ ID NO: 15984 - RNA, 4263 nt, Artificial Sequence; identical to SEQ ID NO: 12698
  derived and/or modified CDS sequence (opt11) from OROV(TVP-19256/IQE-7894)__KP795085.1__GP

SEQ ID NO: 15985 - RNA, 4263 nt, Artificial Sequence; identical to SEQ ID NO: 12699
  derived and/or modified CDS sequence (opt11) from OROV(TVP-19257/IQT-1690)__KP795088.1__GP

SEQ ID NO: 15986 - RNA, 4263 nt, Artificial Sequence; identical to SEQ ID NO: 12700
  derived and/or modified CDS sequence (opt11) from OROV(TVP-19258/IQT-4083)__KP795091.1__GP

SEQ ID NO: 15987 - RNA, 4263 nt, Artificial Sequence; identical to SEQ ID NO: 12701
  derived and/or modified CDS sequence (opt11) from OROV(TVP-19259/IQT-7085)__KP795094.1__GP

SEQ ID NO: 15988 - RNA, 4263 nt, Artificial Sequence; identical to SEQ ID NO: 12702
  derived and/or modified CDS sequence (opt11) from OROV(TVP-19262/OBS-9478)__KP795100.1__GP

SEQ ID NO: 15989 - RNA, 4299 nt, Artificial Sequence; identical to SEQ ID NO: 12703
  derived and/or modified CDS sequence (opt11) from OROV/FPV(Aus Ch 16129)__KF697137.1__GP

SEQ ID NO: 15990 - RNA, 4257 nt, Artificial Sequence; identical to SEQ ID NO: 12704
  derived and/or modified CDS sequence (opt11) from OROV/IQTV(IQT9924)__KF697143.1__GP

SEQ ID NO: 15991 - RNA, 4257 nt, Artificial Sequence; identical to SEQ ID NO: 12705
  derived and/or modified CDS sequence (opt11) from OROV/IQTV(MIS-0397)__KJ866387.1__GP

SEQ ID NO: 15992 - RNA, 4257 nt, Artificial Sequence; identical to SEQ ID NO: 12706
  derived and/or modified CDS sequence (opt11) from OROV/MDDV(FMD 1303)__KF697145.1__GP

SEQ ID NO: 15993 - RNA, 4257 nt, Artificial Sequence; identical to SEQ ID NO: 12707
  derived and/or modified CDS sequence (opt11) from OROV/MDDV(INHRR 17a-10)__KJ866390.1__GP

SEQ ID NO: 15994 - RNA, 4257 nt, Artificial Sequence; identical to SEQ ID NO: 12708
  derived and/or modified CDS sequence (opt11) from OROV/Perdoes virus(BeAn789726)__KP691625.1__GP

SEQ ID NO: 15995 - RNA, 4257 nt, Artificial Sequence; identical to SEQ ID NO: 12709
  derived and/or modified CDS sequence (opt11) from OROV/Perdoes virus(BeAn790177)__KP691628.1__GP

SEQ ID NO: 15996 - RNA, 4284 nt, Artificial Sequence; identical to SEQ ID NO: 12710
  derived and/or modified CDS sequence (opt11) from OROV/UTIV(BeAn84785)__KF697155.1__GP

SEQ ID NO: 15997 - RNA, 3231 nt, Artificial Sequence
  derived and/or modified CDS sequence (opt11) from HRTV(TN)__KJ740147.1__GP
augaucgucccaauuguacucuuccugacccuguguccguccgaacugagugccuggggcagcccuggcgacccaauaguaugcggaguacggaccgaaaccaacaaauccauccaaaucgaauggaaggaaggccgcagcgaaaaacucugccagauagaccgacuugggcacgucacuucauggcugagaaaccacagcaguuuccagggccucguaggacaagucaaaggaagaccuagcgucucuuacuuccccgaaggugcgucauaucccagguggucaggacuccucagccccugugaugcggaauggcuaggcaugaucgccgugagcaaagccggggacacagacaugauagucccggggccaaccuacaaggggaaaaucuucgucgagcgccccacauacaacggguacaaaggcuggggcugcgccgacggaaagaguuugagccacagcggaaccuacugcgaaacagauucuucaguauccagcggccucauacagggcgacagaguccucugggugggagaaguagugugccaacgcgguacgccaguaccugaagacgucuucagcgagcuaguguccuuaagccaaagugaguucccggacgugugcaaaaucgacggcgucgcacuaaaccagugcgagcaagagucgauaccccagccgcucgacgucgcauggauagacgucgggcgcucacacaagguccucaugagagaacacaaaaccaaguggguccaggaauccuccgcaaaagacuucguaugcuucaaaguaggccagggcccaugcucaaaacaagaagaagacgacugcaugagcaaaggcaacugccauggagacgaaguguuuugccgcauggccgggugcucagccaggaugcaagacaaccaagaaggcugccggugcgagcuacuacagaagccaggagaaaucauaguaaacuacgggggcgucagcgugcgcccaaccugcuacggguucucaagaaugauggcaacccuagaagugcacaaacccgaucgagaauuaacggggugcacaggaugccaccucgaaugcaucgaaggaggagucaaaaucguaacacucacgagcgaacuccgaagcgcgaccgugugcgcuagccauuucugcgcgucagcuaaaggcgguagcaaaaccaccgauauccucuuccacacaggagcucuaguaggacccaauuccauaagaauaacaggacagcucuuagacggauccaaauucagcuucgauggucacugcaucuucccggacggaugcauggcacuugacugcacauucugcaaggaguuccuaagaaacccacaauguuacccggucaagaaauggcuuuuucuaguaguuguaaucaugugcuguuacugcgcccuaaugcugcugacaaacauacuacgagcaaucggcguguggggaacaugggucuuugcaccaauaaaacuagcucuagcgcuaggccuaagacucgcaaaacugucgaagaaaggacucguggcgguggucacccgagggcaaaugaucguaaacgacgaacugcaccaaauccgagucgaacgaggugaacagaacgagggccgacaaggcuacgguccgaggggcccaauacgacacuggcucuacagcccggcacucauccucauccugaccaccagcauaugcuccgggugcgacgagcuaguacacgcagaaucaaaauccaucaccuguaaaucagccagcgguaacgaaaaagaaugcuccgucacaggccgggccuuacucccagccguaaacccaggccaggaggcaugccuccacuucaguaugcccggauccccggacucaaaaugccucaaaauaaaaguuaaaagcauaaaccuacgaugcaaacaagcgucgaguuacuacguaccagaagcaaaagcgcggugcaccagcguacgcagaugccgaugggcaggggauugccaguccgguugcccgacauauuucucaagcaauagcuucucggacgacugggccaaccgcauggacagagcugggcucggaaugucgggaugcagcgauggcugcggaggagccgccugcggaugcuucaacgcggccccgaguugcaucuucuggcggaaaugggucgaaaacccgagcaaucgggucuggaagguuucaccgugcgcgucguggguccuagccgccacaauagaacucaccuuaccaagcggagaaguaaaaacccuugagccagucaccggacaggcaacacagauguucaaaggggucgcuauaaccuaccuaggcagcagcauagaaaucguagggaugacacggcugugcgagaugaaggaaaugggaacaggcaucauggcacuagcacccugcaaugacccaggacacgccauaaugggcaacgucggagaaauccaauguagcucgauugaaagcgcaaaacauauacguagcgacggcugcaucuggaaugcggaccuagucgggauugaacuccggguggacgaugcaguaugcuucucgaagcuaacguccgucgaagcggucgccaacuucucgaaaauacccgccacaaucuccggggucagguucgaucaagggaaccacggagaaagccgaauauacggcucgccacuagacaucacgcgugucucaggagaguucagcgucaguuuccguggcaugagacugaaacucagugaaaucagcgcaucuugcacaggcgaaauaacgaacgugagcgggugcuacagcugcaugacgggcgccagcgucagcauaaaacuccacucaucaaagaacaccacgggacaccugaaaugcgacucagacgaaaccgcauucucggucauggaaggcacucacaccuaccgcccgcacaugagcuuugacaaggccgucaucgacgaagaaugcguacucaacugcgguggccacucuucaaaauuacuacucaagggcagccuaguguucauggacguacccagauucgucgacggcuccuacguacagacauaccacagcaaaguacccgcuggcggcagaguacccaacccaguagacuggcuaaacgcgcuuuucggagacggaauaaccagauggauacucgggauaaucggagugcuccucgcaugcguaaugcuauucgucgucgucguggcaauaacccgccgccuaauaaagggacuaacgcaacgggcaaaaguagcauga

SEQ ID NO: 15998 - RNA, 3231 nt, Artificial Sequence
  derived and/or modified CDS sequence (opt11) from HRTV(Patient2)__JX005844.1__GP
augauagucccaaucguacuauuucugaccuuaugcccauccgaacuauccgcauggggaucccccggcgacccaaucguaugcggaguccgaaccgaaacaaacaaaagcauacaaauagaauggaaagaaggacgaagcgaaaagcucugccaaauagaccgauuaggacacguaaccagcuggcuacgaaaccauuccuccuuccaaggacucaucgggcaaguaaagggccgccccagcgucagcuacuuccccgaaggcgcaagcuacccccgauggagcggccuacucaguccgugcgacgcagaguggcuaggauuaauagcaguaagcaaagccggugacacagauaugaucgucccaggccccacauacaaaggaaagaucuucguugagagaccgaccuacaacggguauaaaggauggggaugcgcggacggcaaaagccuaucccauagcggaacauacugcgaaaccgacuccagcguaagcuccggguuaauccaaggcgacagagugcuauggguaggagaagucgucugccagcgaggcacacccgugcccgaggacgucuucucagaacucguaagccuaucacaaagcgaauuuccagacguaugcaaaauagacgggguggcgcuaaaccaaugcgaacaagaaaguaucccgcagccgcuagaugucgccuggaucgacguaggaagaagccacaaaguacuaaugcgagagcacaaaacuaagugggugcaggagucauccgccaaagacuucguuuguuucaaagugggucaaggcccauguuccaagcaagaagaagacgacugcaugaguaaaggcaacugccacggcgacgaagucuucugcagaauggcagggugcagugcacgaaugcaagacaaccaagaaggcugccgaugcgaacuccuacagaaaccgggcgaaauaaucgucaacuacgguggaguaucaguacgaccuacgugcuacggcuuuucccguaugauggcaacacucgaaguccacaaaccugaucgcgaacucacaggaugcacgggaugccaccuagaguguauagagggcggagugaagaucgucacacuaacaucagaacuccgcagcgcaacagugugcgcgucacacuucugugcaucggccaagggcggaagcaaaacaacggauauacuauuccacacaggcgcccuaguuggaccaaacagcauccgcaucacggggcaacuccucgacggcuccaaauucagcuucgacgggcacugcaucuucccggacgggugcauggcacucgauuguaccuucugcaaggaguuccuaagaaacccgcaauguuaccccgucaagaaauggcuauuccucguggucguaauaaugugcugcuacugcgcacuaaugcuccucaccaacauacugcgagcgaucggaguauggggaaccugggucuucgccccaauaaaacuggcacuagcccuaggacugcgacuggccaaacucaguaagaaaggacugguggcagucguaacaagaggacaaaugaucguaaacgacgaacuacaccagguccgagucgaacgcggggagcagaacgaaggacggcagggcuacggcccaaggggaccgauccgccacuggcuguacucaccggcacuaauucugaucuuaacaacgagcaucugcucgggaugcgacgaacucguucacgcggaaagcaaaagcauaacaugcaaauccgccagcgggaacgagaaagaaugcagcgugacagguagagcccuacuaccagccguaaacccagggcaagaagccugccuacacuucucaguacccgggagccccgacucaaaaugccucaaaauaaaagucaaaagcauaaaccucagauguaaacaggccagcucuuacuacguacccgaagcaaaagccagauguacgucagucagacgaugccgcugggcaggagauugccaaucagggugcccaaccuacuucucgagcaacucuuucagcgaugacugggcaaaucgaauggacagggccggccucggcaugagcggcuguucggauggcugcggcggggccgcaugcgguugcuucaacgcagccccaagcugcaucuucuggcggaagugggucgagaaccccagcaacagaguauggaaggucucaccuugcgcauccuggguccuugcagccacaauagaacugacacuacccucaggugaagucaaaacccucgaaccugugacaggccaagcgacccaaauguucaaaggcguagccauaaccuacuugggcagcuccauagaaaucgucggcaugacaagacugugcgaaaugaaagagaugggaacgggaaucauggcccucgcuccuugcaacgacccaggacacgcaauaauggguaacguuggagaaauacaaugcuccagcaucgaaagcgcgaagcacauacgcucagacggaugcauauggaacgccgaccuagucggcauagaacuacgagucgacgacgcagucugcuucagcaaauugacaucagucgaagcgguggccaacuuuucaaaaaucccagcgacaaucuccggaguccgcuucgaccaaggaaaucacggcgaaagccguauauacggcagcccauuggacaucacaaggguaagcggcgaguucucggugagcuucagaggaaugcgguugaaacucagcgaaauauccgccucaugcaccggcgaaaucacaaacgucagcgguugcuacuccugcaugacgggcgcaagcguaucaaucaaauuacacagcucuaagaacacaacgggacaccuaaaaugcgacucagacgaaaccgcuuucuccguaauggaagggacccacacauaucgcccccacaugagcuuugacaaggccgucaucgacgaagaaugcguacucaacugcggaggacacucgagcaaacuccuccugaagggcagccucguuuucauggacgucccacgcuucgucgacggcagcuacgugcagacauaccacagcaaggugccagcgggcggcagaguaccgaacccugucgacuggcuaaacgcccucuucggggacggaaucacacgauggauccuagggauuauaggcguacuacuggcgugcgugauguuauucguggucguaguagccauaaccagaagacuaaucaaaggccuaacucaacgcgcgaaaguagccuaa

SEQ ID NO: 15999 - RNA, 3231 nt, Artificial Sequence
  derived and/or modified CDS sequence (opt11) from HRTV(Patient1)__JX005845.1__GP
augauagcacccguugugcuguuuuucacccugugcccaucucaacuaucagccuggggcucccccggggacccaaucguguguggcgucagaaccgagaccaauaaguccauacaaauagaauggaaagaaggacgcucggaaaaacucugccaaauagacagacucggacaugucaccucguggcugcggaaccacuccuccuuccagggccucauaggacagguaaaaggccgacccucagucucguauuuccccgaaggagcguccuaccccagguggagcggcuugcucucccccugcgacgcggaauggcucggccuaauagcaguaagcaaggccggcgacacagacaugaucgugccaggcccaacauacaaaggaaagaucuucgucgaacgucccacauacaacggcuacaagggauggggaugcgcggacgggaaaagccuaucacacagcggcacauacugugaaaccgacagcucggucucaagcggccucauccaaggagacaggguacuaugggucggagaaguaguaugccaaagaggaaccccggucccggaagauguguucagcgaacucauaagccugagccaaagcgaguucccagacguaugcaaggucgauggagucgcccuaaaccagugcgaacaagaaaguauaccgcaaccauuagacgucgcauggauugacguaggaagaagucacaaaguacucaugcgagaacauaaaacaaaauggguacaagagucaagugcaaaggacuucgugugcuucaaaguaggccaaggaccaugcagcaaacaagaagaagacgacugcaugagcaaaggaaacugccacggagacgaaguguucugccgcauggcaggaugcucagccagaaugcaagacaaccaagaaggcugccgcugcgaacuauuacaaaaacccggagaaaucauagucaacuacggaggagucaguguacgcccaaccugcuacggauucucaagaaugauggccacccuagaagugcacaaacccgaucgcgagcucacugggugcaccggcugccaccucgagugcauugaaggcgguguaaaaauagucacccugaccagcgaacuaagaagcgccacagucugcgcuagccacuucugugcaucagcaaaagguggcagcaaaacaaccgacauacucuuucacacgggcgcacucguaggucccaaaucaauacgcauaacgggccaacuguuagacggcuccaaauucucauucgacggccacugcauauucccagacggaugcauggcgcucgacugcaccuuuugcaaagaguuucuuagaaacccacaaugcuacccagucaaaaaguggcuauuccucguaguaguaguaaugugcugcuacugcgcacucaugcugcuaacgaacauccugagagcaauaggcguauggggcacguggguauuugcucccaucaagcuaguacuggcgcucggccuuagauuggcaaaacucagcaagaaaggacuugucgccguggucacccgagggcaaaugaucgugaaugacgagcuacaccaaauacgcgucgaacgaggggaacagaaugaagggagacucgggcacgggccaaggggcccgguaagacacuggcuguauucgccagcccucauacuaauacugacgacgagcauaugcagcggcugcgacgaacucguacacgcagaaucgaaaaguauaacgugcaagagcgccagcggaaacgaaaaagaaugcagcgucacuggcagagcccuccuuccagccgugaacccgggacaagaggcuugccuacacuucagcaugccaggauccccggacagcaaaugccucaaaaucaaggucaaaagcauaaaccuacguugcaaacaagccucaagcuacuacgugccagaagcaaaagcaagaugcaccagcgugcgaagauguagaugggccggcgacugccaaagcggcugcccaaccuacuucuccuccaacagcuucuccgacgacugggccaaucggauggaccgagcaggcuuaggaaugucgggcuguagugacgggugcggcggcgcagcaugcggcugcuucaacgcagcccccucauguaucuuuuggagaaaauggguagaaaaccccagcaaccgcguauggaaaguaagcccaugcgcaagcuggguacuagcagcaaucauagaacucacucuaccuagcggggaaguaaaaacccucgaacccgugaccggccaagcaacccaaauguuuaagggcgucgccaucacguaccuaggaagcagcauagagauagucgguaugacgagacucugcgaaaugaaggaaaugggcacaggaauaauggcgcucgccccaugcaacgaccccggacacgccaucaugggaaacgugggcgaaauacaaugcagcucaauugaguccgccaaacacauuagaucggacgggugcauauggaacgcggauuuagugggaaucgaacuaagaguggacgacgcgguaugcuucucgaaacuaacgucaguagaagcaguggcuaacuucuccaagauacccgcaaucauaagcgggguaagguucgaccaaggcaaucacggcgaaucgaggaucuacgggaguccgcucgauaucacgaaagugaguggagaguucagcguaaguuuccgagggaugcgacugaagcugucagaaauaagcgcguccugcacgggagaaaucacgaacguaagcgggugcuacagcugcaugacaggggcaagugugagcaucaaacuccacucaaguaaaaacacgaccggacauuuaaaaugcgacagugacgaaacagcauucucagucauggaaggcacacacaccuacagaccacacaugagcuucgacaaggcgguaguugacgaagaaugcguccugaacugcgggggccacagcucaaaacuucuauuaaaagggagccuaguauucauggacguaccucgcuucguagacggaucauauguccaaacauaucauaguaaggucccagccggcggaagggucccaaacccggucgacuggcuaaacgcacucuucggagacggaaucacaagguggauacucggaaucaucggaguccuauuggccugcguacuccuguucgucgucguaguagcaauaacgcgccgacuuaucaaaggccucacacaacgagcaaaaguagccuag

SEQ ID NO: 16000 - RNA, 3942 nt, Artificial Sequence
  derived and/or modified CDS sequence (opt11) from PTV(PAN472868)__NC_027201.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagaagcaugauuauaagaagcaggagucccagcgcugccgggugggggacagcgauaagaagaugaucacgaaugucaccaucaucucccugaucagcgagauccaaaaguccaucagcgagcucucccugagcugcggcaacgacgacaacuccaccggccaggugcugaccuucaacgggcucgaggacacgauccagggggacuacaucguggacugcgucaccggccuguaccagagcgacaucggcgugggggugggccuggggaagacccaccacgaccaccagcaggucaagaacaaagccguggucaucgacgagaaggagcgcaugaucaguuuccucgaaacccagcagagcgagaacgacaucaagaugcagguccugauguccgagaucgagcagcugaagaaccagcucagcaagaagcggaacgagcgcggccaggagaagcgggacgcggagaaggugaugagcgaccugauggcccguaacuccgaccugcggaagcacaacgacauccucacggccgagaucagccagauggagaacaauaacaccauccagcgcaacaagaacgugauguccaccaccgucgugccggccauccugagcguggcccugcucuccucuuccaucgcgcccaucauggccgccagccccgacucccccaugaucaacccguggccccacgccaagaaccgggucgggacgggcauguacaaguacgacgagaacgacgacagcggcugccgccccauccgguacggaguguccugcaucggcuucgacuucaugcugaagauggacaaguaccccuucuucaacgcguucaucgggcacaaaaccccacuggagagcuucgccgacaagaucaucgaaaaggaggaggaaaccugcgagaucggcaccaacaaggaguucaagugcuucgaggagcgcgccuacaucaaggguacgugccccaccaacaucaacgccgugcacuacaucgacaacaaggggaagcuccgguacgucaaguguaaggagaaccuggagaugaccgaggacugcgccuuuugccgcaagaucaagaagaaggcgggccaguccauccaggugcagaaaaccagcgugccccugcaggacgccaucugccaggagaacuccgacacguacagcgggcccaagaucccguucaagggcgucugcaagauagggcucaucaaguacaaggagugcaaguucaagaccaguagcuacgagaccguguccuucaucacccugaaggagaagggcaagaucuauauugagcaccugaugcucaagaacaucgaggucgugacgaacgugagcuucgucugcuacgagcacgccggccaggacgagcaggagguggagcaccgggcccugaagcgcgugagcgucaacgacugcaagaucguggacaacuccaagcagaagaucugcaccggggaccacaucuucugcgagaaguacgacugcagcaccuccuaccccgacgugaccugcauccaugcccccggcagcgggccccuguacaucaaccucaugggcuccuggaucaagccgcagugcgucggguacgagcgggugcugguggaccgcgaggucaagcagccccugcucgcgcccgagcagaacugcgacacgugcgugagcgagugccuggacgagggcgugcacauuaaguccaccggcuucgagaucaccagcgccgucgccugcucccacgggucgugcaucuccgcccaccaggaggccagcacauccgugaucguccccuacccgggccugcucgcgagcgucgggggccggaucgggauacaccugucccacacgagcgacuccgccagcgugcacaugguggucgugugcccgccccgcgacagcugcgccgcccauaauugccugcucugcuaccacggcauacugaacuaccagugccacuccacgcugagcgccauccucaccuccuuccugcugauccucuucaucuacaccguguucagcgucaccacgaacaugcuguacguacugcgccugauccccaagcagcucaagagucccgugggcuggcuacggcuguucaucaauuggcuccugaccgcgcugcgcaucaagacccgcaacgucauggggcgcaucaaccagcggaucggcuggguggaccaccacgacguggagcgcccccggcacagagagcccaugcggcgcuucaagaccacgcuccugcuuacccucaucaugaugaccgggggcaacgccugcagcaacaccgucguagccaauuccaagcagacgcggugcgugcaggagggcagcuccaccaaguguagcaucacggccaccaucacgcugcgcgcgggggucaucggcgccgaguccugcuucaucaucaaggggcccauggagaaccagcagaagaccaucucgaucaagaccaucagcagcgagaccgugugucgggagggcuccagcuucuggacgucccuguacauuccgagcugccucucgagccgccggugucaccuggucggagacugcgucggcaacaagugccagagcuggcgcgacgaccagcugucccgggaguucagcggcgugaaggacaaccacaucaugaacgagaacaagugcuucgaacagugcggggccaucggcugcgggugcuucaacaucaacccauccugccucuacgugcacgccuaccugaagucggcccgcaacgaggcgguccggguguucuccugcagcgacugggugcaccgcgucuccuucgaagugaagggccccgacggggagaccgagcuggugaccuuaggcagccugggcaccaaguuccugaacugggggacgcucucacugagccuggacgccgagggcaucuccgggaccaacagcaucuccuuccucgagagcuccaagggcggguucgcccuguacgacgagggcuacagcgagaucccgagagaggguuuccuuggggagauccggugcuccagcgaguccgccgccaucagcgcgcacaagagcugcauccgcgcccccggacucaucaaguacaagcccaugaccgaucagaucgaaugcacagccucccuagucgaccccuucgccaucuuccugaaggggagccucccgcagacgcggaacggccagaccuucacguccaccaaggacaagaagacggugcaagccuucaccaacggggcgaucaaggcccugcugagcaucaaccucgacgaccacgagaucguguucaucaacaagguccgcuccugugacgccaccuuccugaacgugagcggcugcuacuccugcgacuacggcgcccacgugugcgucaaagucaagagcagugagagcgcggacuucuucgccgaguccgaggacaagaccacggugcugagcuuccccauccagagugggacccacgacuauugccaggugcuacacuuccagaagccccugguggacgagcggcugagcuacuccugcgguagcgagcccaagcucaucgucaucaaggggacacugguguacaugggcguguacgacuuccgcaauaagacaggcggguccagcacggucgugaacccguccgagggcgcuuggagcaucagcaacugguucuccgggcugcucgacuggcugggcgggcccaugaaggccauccugaagauccucggcuucaucgccaucggcaucguguguuucauccuguucaugauccugauccggaucgcggucaauagcauaaacaucaagaagaagaacuag

SEQ ID NO: 16001 - RNA, 3942 nt, Artificial Sequence
  derived and/or modified CDS sequence (opt11) from PTV(Adames)__KR912209.1__GP
augaucuucaccauccugaacgugcucacccgcgcgaugcuggucaugagcauguacucccugacgaccugggacucauccagccggaacgacaucugcuucuccaacgacaguccccucgagggccugguguacuacugggagacccacuccaagaagcacgacuacaagaagcaggggagccagaagugccgcgugggcgacuccgacaagaagaugauaagcaacgucaccaucaucucccugaucagcgagauccagaaguccaucagcgagcucucccugagcugcgggaacaacgacaacuccacaggccaggugcugaccuucaacgggcucgaggacaccauccggggcgacuacaucguggacugcgucaccggccuguaccagagcgacaucggggugggcguggggcugggccgcauaaaccacgaccaccagcagguuaagaacaaggccgucgugauugacgagaaggagaaaaugaucucccuccuggagacgcagcagagcgagaacgacaucaagacccagguccugaugagcgagaucgagcagcucaaaaaccagcuguccaagcggcgcaacgagcgggggcaggagaaacgcgacgcggagaagcugaugagcgaccucauggcccggaacuccgaccugcgcaaccacaacgugauccugaccgacgagaucucccagaucaagaacaacaucaccauccaccggaaccgcaacaugaugagcacgaccguggucccggccauccucagcguggcccugcuguccagcuccgugggccccaucacugccgcgccgcccgacagcaccaugaucaaccccuggccccacgccaagaaccgggucggcacagggauguacaaguacgacgagaacgacgaguccggcugccgccccauccgguacggggugagcugcaucggcuucgacuucaugcucaagauggacaaguaccccuucuucaacgcuuucaucggccacaagaccccgcuugaguccuucgccgauaagaucaucgagaaggaggaggaaaccugcgagaucgggaccaacaaggaguucaagugcuucgaggagcgcgcguacaucaagggcacgugccccaccaacaucaacgccgugcacuacaucgacaacaaggggaagcugagauacgucaagugcaaggagaaccucgagaugaccgaggacugcgccuuuugccgcaagaucaagaagaaggccggccagagcguccaggugcagaagaccuccgugccccugcaggacgccaucugccaggagaacagcgacaucuacuccgggcccaagauuccguucaagggcgugugcaagaucggccugaucaaguacaaggaaugcaaguucaagacgagcuccuacgagaccaucucguucaucacccucaaggggaagggcaagaucuacaucgagcaccugaugcuaaagaacaucgagguuguuaccaacgugagcuucgucugcuacgagcacgcggggcaggacgagcaggagguggagcaccgggcccucaagcgcguguccgucaacgacugcaagaucgucgacaacagcaagcagaagaucugcacgggcgaccacaucuucugcgagaaguacgacugcuccaccagcuaccccgacgugaccugcauccacacccccggguccggcccccuguacaucaaccugaugggcagcuggaucaagccgcagugcgucggguaugagcgggugcucguggaccgcgaggucaagcagccccugcuggugcccgagcagaacugcgacacgugcguguccgagugccucgacgagggcguccacaucaagagcaccggguucgaaaucaccuccgccguggccugcagccacggcuccugcaucagcgcccaccaggaagcgucaacaagcgugaucauccccuacccggggcugcuggccuccgucggcggccgaaucgggauccaccucagccacacguccgacagcgccagcgugcacaugguggucgugugcccgccccgggacucuugcgcagcccacaacugccugcugugcuaccacggcauccucaacuaccagugccacagcaccuuguccgcgauccugaccagcuuccuccugauccuguucaucuacaccgccuucuccgugaccacgaacguccuguacgugcuccgccugauccccaagcagcuuaagagccccgugggguggcugaagcuguuugucaacuggcugcucaccgcccugcggaucaagaccaggcgggugaugggccgcaucaaccagcggaucggaugggucgaccaccacgacgucgagcgcccucggcaccgcgagcccaugcggcgcuucaagaccacgcugcuccugacccugaucauggugaccgggggcaacgccugcuccaacaccguggucgccaacagcaagcagacgcggugcgugcaggaggguuccaacaccaagugcagcaucaccgcgaccaucacgcuccgcgccggcgucaucggggccgaguccugcuucaucauaaagggccccauggagaaccagcagaagaccaucagcaucaagaccaucuccagcgagaccgucugccgugagggcuccagcuucuggacgucccuguacaucccgagcugccuguccagccgucggugccaccucgugggggacugcgugggcaacaagugccagagcuggcgcgacgaccagcugucccgggaguucagcggggucaaggacaaccauaucaugaaugagaacaagugcuucgagcagugcggcgccaucgggugcggcugcuucaacaucaaccccuccugccuguacgugcacgcguaccucaagagcgcccgcaacgaggccgugcgcgucuucuccugcagcgacugggugcaccggguguccuucgaggucaagggccccgacggggaaauggagcuggugacccugggcagccuggggaccaaguuccugaacuggggcacccugucccucagccuggacgccgaggggaucuccggcacgaacagcaucuccuuccuggagagcuccaagggcggguucgcccucuacgacgagggcuacagcgagaucccgcgcgaaggguuccuaggcgagauccggugcuccucugaguccgcggccaucagcgcccacaagagcugcauccgcgccccggggcugaucaaguacaagcccaugaccgaccagaucgagugcaccgccucccucguggaccccuucgcgaucuuccugaaggguagccugccgcagacccggaacggccagacguucaccuccaccaaggacaagaagaccguccaggccuucacgaacggagccaucaaggcccuucugagcaucaaccuggacgaccacgagaucaucuucaucaauaaggugaaguccugcgacgccaccuuccucaacgugucuggcugcuacuccugcgacuacggggcgcacgucugcgucaaagucaaaagcuccgagagcgccgacuucuuugccgaguccgaggacaagacgaccgugcugagcuuccccauccaguccggcacccgcgacuacugccaggugcugcacuuccagaagccccucgucgacgagcggcugagcuacuccugcggcagcgagcccaagcugaucgugaucaagggcacccugguguacaugggcgucuacgacuuccgcgacaagaccgggggcuccagcaccgugaucaacccguccgaggggacguggucaaucucuaacugguucuccggccugcuggacuggcucggcgggcccaugaaggccauccuuaagauccugggcuucaucgcgaucggcaucgugugcuucauccucuucaugauccugauccggaucgccgucaacagcaucaacaucaagaagaagaacuga

SEQ ID NO: 16002 - RNA, 3942 nt, Artificial Sequence
  derived and/or modified CDS sequence (opt11) from PTV(Balliet)__KR912213.1__GP
augaucuucaccauccuuaacguucucaccagggccaugcucguuaugagcauguacucccugacgaccugggacagcaccucccggaacgacaugugcuucaguaacgacucgccccucgagggccugguuuacuacugggagacccacagcaagaagcaugacuacaagaagcaggagucccagcgcugccgggugggggacagcgacaagaagaugaucacgaacgucaccaucaucucccugauuagcgagauccagaaguccaucagcgagcucucccugagcugcggcaacgacgacaacuccaccggccagguguugaccuucaacgggcucgaggacacuaucaggggcgacuauaucguggacugcgucacgggcuuguaccaguccgauauuggugugggggugggccugggccguacccaccacggccaucaacagaugaagaacaaggccgucgugaucgacgagaaggagcgaaugaucucccuccuggaaacccagcagucugaaaacgacaucaagaugcagguacugaugucagaaaucgaacagcucaagaaccagcugagcaagaagagaaacgaacgcggucaggagaagcgggacgcggagaagguuaugagcgaucugauggcacgcaacagcgaccuccguaagcacaacgacauacugacggcagagaucucucagaugaagaacaagaacaccauccagcgcaacaagaacaccguguccaccaccguagucccggccauccugagcguggcccugcuguccagcuccguggcgccaaucauagccgccccgcccgacagccccaugaucaaccccuggccccacgccaaaaaccgugucggcacuggcauguauaaguacgacgagaacgacgacuccgggugucgccccauccgguacggcgugagcugcaucggguuugacuucaugcugaaaauggacaaguacccguucuucaacgcguucaucggccacaagacgcccuuggaguccuucgccgauaaaaucaucgagaaggaggaggagaccugcgagaucggcaccaacaaggaguucaagugcuucgaggagcgcgccuacaucaaggggaccugccccaccaauaucaaugccgugcacuauaucgacaacaagggcaagcugcgguacgucaagugcaaggagaaccuggagaugaccgaggauugcgccuucugccgcaagaucaagaagaaggcggggcagagcguccaggugcagaagacguccgugccccuccaggacgccauuugucaggagaacagcgacaccuacucgggcccgaagauccccuucaagggggugugcaagaucggccugaucaaauacaaggagugcaaguucaagaccagcuccuaugagaccgucagcuucaucacgcuaaaggagaagggcaagaucuacaucgagcaccucaugcugaagaauaucgagguggugaccaacgucuccuuugugugcuacgagcacgucgggcaggacgaacaggaggucgagcaccgggcccugaaacgcguaagcgugaacgacugcaagaucgucgauaacagcaaacagaagaucugcaccggggaccauguguucugcgagaaguacgacugcaguaccagcuaccccgacgugacgugcauccacgcgcccggguccggcccgcucuacaucaaccugauggggagcuggaucaagccccagugcgucgguuacgaacgggugcugguggaccgcgaggucaagcagccauugcuggcccccgaacagaacugcgauaccugcguauccgagugccuggacgagggcgugcacaucaagucaacaggguucgagaucaccuccgcggucgccugcagccacggaucaugcaucagcgcccaccaggagccgucgaccagcguaaucgugcccuaccccgggcuucuggccuccguaggcgggcgcaucgguauacaccugagccacaccuccgacagcgcuagcgugcacaugguggucgugugcccgccccgggacagcugcgcggcccacaauugccuccugugcuaccacggcauccugaacuaccagugccacagcacccucagugccauccugaccagcuucuuauuaauccuguucauuuacaccguguucagugucacgaccaacauccuguacgugcugaggcucauucccaagcagcuuaagucacccgugggauggcugaagcuguucaucaacuggcugcugaccgcccuccggauaaagacccgcaacgucaugcggcgcaucaaucagcguaucgggugggucgaccaccacgacguggaacgcccccggcaccgagagccaaugagacgcuucaagacgacccugcugcucaccuuaaucaugaugacagggggcaacgccugcuccaacacggucguggccaacagcaagcagacccggugcgugcaggagggcagcaacaccaagugcagcaucaccgccacgaucacccugcgcgccggggucauuggcgccgaguccugcuucaucauaaaggggcccauggagaaccaacagaagaccaucucaaucaagaccaucucuagcgaaacagugugccgcgagggcuccagcuucuggaccucccucuacauccccagcugccuguccucccgccggugccaccuggugggggacugcgucggcaacaagugucaguccuggcgcgacgaccagcucucgcgagaguucagcggugugaaggacaaucacauuaugaaugagaacaagugcuucgaacagugcggggccaucggaugugggugcuucaacaucaacccguccugccuguacgugcaugccuaccucaaguccgcccgcaacgaggccguccgcguguucuccugcagcgacuggguccaccgggucuccuucgaggugaagggccccgacggggagacagaacucgugacccuagguucucugggcacgaaguuccucaacugggggacgcuguccuugagccuugacgccgagggcaucuccggcaccaacagcaucuccuuccuggagagcucuaaggguggguucgcgcuguacgacgagggcuacaacgagauacccagagagggcuuccuaggagagauccggugcagcuccgagucagcggccaucuccgcccacaagagcugcauccgcgcccccggccugaucaaguacaagcccaugacagaccagaucgaguguacggcgucccuggucgaucccuucgccaucuuccuuaaggggagccugccgcagacccguaacggacagaccuucaccagcacgaaggacaagaagaccguccaggcguucaccaacggagccaucaaggcacugcuuuccaucaaccuggacgaucaugagaucguguucaucaacaaggucaagaacugugacgcgaccuuccugaacgugagcgguugcuacuccugcgacuacggcgcccacgucugcgugaagguuaagagcuccgagucagccgacuucuucgccgaguccgaggacaagacgacgguccucuccuuccccauccaaucuggaacccacgacuacugccaggugcuucacuuccagaaaccgcugguggacgagcgccucagcuacuccugcggcagcgagcccaaacuuaucgucaucaaggggacccugguguauaugggcguauacgauuuucggaacaagacgggcggcucgagcaccgucgugaaucccucagagggagccuggagcaucaguaacugguucagcgggcuccuggauuggcugggcgggcccaugaaggccauccucaagauccuaggcuucaucgccauuggcaucgugugcuucgugcuuuucaugauacucaucaggaucgccguaaacuccauaaacaucaagaagaagaacuga

SEQ ID NO: 16003 - RNA, 3942 nt, Artificial Sequence; identical to SEQ ID NO: 12717
  derived and/or modified CDS sequence (opt11) from PTV(PaAR2381)__KP272005.1__GP

SEQ ID NO: 16004 - RNA, 3942 nt, Artificial Sequence; identical to SEQ ID NO: 12718
  derived and/or modified CDS sequence (opt11) from PTV(PAN483391)__KP272008.1__GP

SEQ ID NO: 16005 - RNA, 3942 nt, Artificial Sequence
  derived and/or modified CDS sequence (opt11) from PTV(GML902876)__KP272011.1__GP
augauauuuaccauccugaacgugcucacccgcgccaugcugguuaugagcauguacucccugacgaccugggauagcaccucccggaacgacaugugcuucucuaacgacagcccccucgagggccugguguauuacugggagacccacagcaagaagcacgacuacaaaaagcaggagucccagaagugccgcgucggggacagcgacaagaaaaugaucuccaacgucacgaucaucagccugauuuccgagauucagaaguccaucuccgagcucagccugucuugcggcaacgacgacaacagcaccggccaggugcugaccuucaacggccucgaggauaccauccgcggggacuacaucguggacugcguuacaggcuuguaccaguccgacaucggcguaggggugggccuggggcggacucaccacgaccaccaccaggucaagaacaaggccguggucaucgaugagaaggaacggaugaucagccuucuggagacccaacaguccgaaaaugacauuaagaugcagguccugaugagcgagaucgaacaacucaagaaccagcugagccgcaagcggaacgagcgcggccaggagaagcgggacgcggagaaagugauguccgaccugauggcccgcaacagcgaccuccggaaacacaacgacauccugaccgcggaaaucucccagauggagaacaacaauacuauccagcgcaacaagaacgugaugagcaccaccgucgugccggccauccuguccguggcccuccugagcuccagcaucgcgcccaucauggccgccucccccgacagucccaugauuaaccccuggccccacgccaagaacagggucggcaccggcauguacaaguacgacgagaacgacgacuccggaugccgccccauccgguacgggguuagcugcaucggcuucgacuucaugcugaagauggacaaauaccccuucuucaacgcguucaucgggcacaagacgccgcucgaguccuucgccgacaagaucaucgagaaggaggaggagaccugcgagaucggcaccaacaaggaguucaagugcuucgaggagcgcgccuacaucaaggggaccugccccacgaacaucaacgccgugcacuacaucgacaacaaggggaagcugcgguacgucaagugcaaagagaaccuggaaaugacagaggacugcgcauucugccgcaagaucaagaagaaggcgggccagagcauccaggugcagaagaccuccgugccccuccaggacgccaucugccaggagaacucggacaccuacagcgggcccaagaucccguucaagggcgucugcaaaaucgggcugaucaaguacaaggagugcaaauucaagacgagcuccuacgaaacugugagcuucaucacccugaaggagaagggcaagaucuacaucgagcaccucauguugaagaacaucgaggucguuaccaacgugagcuucgucugcuacgagcacgccggccaggaugagcaggagguggagcaccgggcccugaagcgcguguccgucaacgacugcaagaucgucgauaacagcaagcagaagaucugcacgggcgaccacaucuucugcgagaaguaugacugcuccacuagcuaccccgacgugaccugcauccacgcccccggcuccgggccccucuacaucaaccugaugggcagcuggaucaaaccacagugcgucggguacgagcgggugcugguggaccgugaaguuaagcagccccuccuagcgcccgagcagaacugcgacacgugcguauccgaaugccuggacgagggcgugcacaucaagagcacaggcuucgagaucaccuccgccgucgccugcagccacggguccuguaucagcgcccaccaggaggccuccaccagcgugaucgugcccuacccgggccuccuggcguccgucgggggccgcaucgggauccaucugagccacacguccgacagcgcuagcguccacauggucgucgucuguccgccccgggacuccugcgccgcccacaacugccucuuguguuaccauggcauucugaacuaccagugccacagcacgcucuccgccauccugaccagcuuucugcucauucuguucaucuacaccguguucuccgucacgaccaacaugcuguacgugcugagacucauucccaaacagcucaaaagcccggugggcuggcuucggcuguucaucaacuggcugcugacggcgcuccgcaucaagacccguaacgucauggggcgcaucaaccagcggaucggcuggguggaccaccacgacguggagcgcccccggcaccgcgaacccaugcggcgcuucaagaccacccuucuucuaacgcugaucaugaugaccgggggcaacgcuugcagcaacaccgucguggcuaacagcaagcagacccggugcgugcaggagggcuccagcacgaagugcuccaucaccgccaccaucacccugcgcgcgggggugaucggcgccgagucuuguuucaucaucaaggggcccauggagaaccagcagaagacgauuuccaucaagaccaucagcucugagacagugugccgggaggggagcaguuucuggacgucgcucuauaucccguccugccugagcagccgccggugccaccuggugggcgacugcgucggcaacaagugccagagcuggcgcgacgaccagcugagccgggaguucuccggcgugaaggacaaccacaucaugaacgagaacaagugcuucgagcagugcggggccaucggcugcgggugcuucaacaucaaccccagcugccuguauguacaugccuaccugaaguccgcccgcaacgaggcgguccgcguguucagcugcuccgacugggugcaccggguuagcuucgaggugaagggccccgacggcgaaacggagcucguggcacugggcucccugggcaccaaguuccucaacugggggacccugucucugucgcucgacgccgagggcaucucggggacgaacuccaucagcuuccuggaguccucaaagggcggguucgcccuuuacgacgagggcuacuccgagaucccucgcgagggcuuccucggggagauccggugcagcuccgagagcgccgcgaucagcgcccacaaguccuguauucgcgcccccggccugaucaaguacaagcccaugacggaccagaucgagugcaccgccucccugguagaucccuucgcuaucuuccucaagggguccuuaccgcagaccaggaacggccagaccuucacgagcaccaaggacaaaaagaccgugcaggcguucaccaacggggccaucaaggcgcugcucuccaucaaccuggacgaccacgaaaucguguucaucaacaaggucaagagcugcgacgccacguuccucaacguguccggcugcuacagcugcgacuacggcgcgcacgugugugucaaggugaaguccagcgaauccgccgacuucuuugccgagagcgaggacaagaccaccguccuuuccuuccccauccagagcgguacccacgacuacugccaggugcugcacuuccagaagccccugguggaugagcgccucuccuauagcugcggcuccgagcccaagcugauagucaucaaggggacgcugguguacaugggcguguacgacuuccggaacaagaccggcgggagcuccaccgucgugaacccgagcgagggcgccuggagcaucuccaacugguucagugggcuccuggacuggcugggcgggccaaugaaggccauccucaagauccugggcuucaucgcgaucggcaucgugugcuucauccuguucaugaucaugauccgcaucgccgucaacuccaucaacaucaagaagaagaacuga

SEQ ID NO: 16006 - RNA, 3942 nt, Artificial Sequence; identical to SEQ ID NO: 12720
  derived and/or modified CDS sequence (opt11) from PTV(PAN479603)__KP272014.1__GP

SEQ ID NO: 16007 - RNA, 3942 nt, Artificial Sequence
  derived and/or modified CDS sequence (opt11) from PTV(PAN478718)__KP272017.1__GP
augaucuucaccauccugaacgugcucacccgcgccaugcuggucaugagcauguacucccugacgaccugggauagcuccagccggaacgacaugugcuuuuccaacgacagcccccucgagggccugguguauuacugggagacccauuccaagaagcacgacuacaagaagcaggagagccagcgcugccgggugggggacuccgacaagaagaugaucacaaacguuacgaucaucagccugaucagcgagauccagaagucaaucagcgagcucagccuguccugcggcaacgacgacaacagcaccggccaagugcugaccuucaacggccucgaggacaccauccgcggggacuacaucguggacugcgucacggggcuguaccaguccgacaucggcgugggggucggccuggggcggacccaccacgaccaccaacaggugaagaacaaggccguggugaucgacgagaaggagcgcaugaucagccuccuggagacccagcaguccgagaacgacaucaagaugcagguucugaugagcgaaaucgagcagcucaagaaccagcugagcaagaagcggaacgaacgcggccaggagaagcgggacgcggagaaggugauguccgaccugauggcccgcaacagcgaucuccggaagcacaacgacauacugaccgccgagauaucccagaugaaguacaacaacacgauccagcgcaacaagaacaucaugagcaccaccguggucccggccauccuguccguggcccugcugagcuccagcguggcacccaucauggccgccccgcccgacucccccaugaucaaccccuggccccacgccaagaaccgggucgggaccggcauguacaaguacgacgacaacgacgacagcggcugccgccccauucgguacgggguguccugcauaggcuucgacuucaugcugaagauggacaaguacccguucuuuaacgcguucaucgggcacaagacgccccucgagagcuucgccgacaagaucaucgagaaggaggaggagaccugcgagauuggcaccaacaaggaguucaagugcuucgaggagcgcgccuacaucaaggggaccugccccacgaacauuaacgccguccacuacaucgacaacaaggggaagcugcgguacgucaagugcaaggagaaccuggagaugaccgaggacugcgccuucugccgcaagaucaagaagaaggcgggccaguccguccaggugcagaagaccagcgugccccuccaggacgccaucugccaggagaacuccgacaccuacagcgggccgaagauccccuucaagggcgugugcaagaucgggcugaucaaguacaaagagugcaaguucaagacguccagcuaugagaccgucuccuucaucacccugaaagagaagggcaagaucuacaucgagcaccucaugcugaagaacaucgagguggugaccaacgucagcuucgugugcuacgagcacgccggccaggacgagcaggagguggagcaccgggcccugaagcgcgucagcgugaacgacugcaagaucguggauuccagcaagcagaagaucugcacgggggaccacgucuucugcgagaaguacgacugcuccaccagcuaccccgaugugaccugcauccacgcacccggcuccgggccgcucuacaucaaccugaugggcagcuggaucaagccccagugcguuggguacgagcggguccugguggaccgcgaggugaagcagccccucuuagcgcccgagcagaacugcgacacgugcgucuccgagugccuggacgagggcgugcacaucaagagcaccggcuucgagaucaccuccgccguggccugcagccacggguccugcaucagcgcccaccaggaggccuccaccagcgucaucgugccguaccccggccuccuggcguccgucgggggccgcaucgggauacaccugagccacaccuccgacagcgccagcgugcacauggugguggugugcccgccccgggacuccugcgccgcccacaacugccuccugugcuaccacggcauccugaacuaccagugccacagcacgcucuccgccauccucaccagcuuccugcucauacuguucaucuacaccguguucuccgugaccaccaacauguuguacguccugcgccugauccccaagcagcucaagagcccggugggcuggcugaagcuguucaucaacuggcugcugacggcgcuccggaucaaaacccgcaacgugauggggcggaucaaucagcgcaucggcugggucgaccaccacgacguggagcggccccgccaccgggagcccaugcgccgguucaagaccacccugcuacucacgcugaucaugaugaccgggggcaacgccugcuccaacaccguggucgccaacagcaagcagacccgcugcgugcaggagggauccaacacgaagugcagcaucaccgccaccaucacccugcgggcgggcgugaucggcgcggaguccugcuucauugucaaggggccgauggagaaccagcagaagacgaucaguaucaagaccaucuccagcgagaccgugugccgcgagggcagcagcuucuggaccucccucuacauccccagcugccuguccagccggcgcugccaccuggugggggacugcguuggcaacaagugccagagcuggcgggacgaccagcucucccgcgaguucagcggcgugaaggacaaccacaucaugaacgagaacaaaugcuucgagcagugcggggccaucggcugcgggugcuucaacaucaaccccuccugccuguaugugcacgccuaccucaagucagcccggaacgaggcgguccgaguguuuuccugcagcgacugggugcaucgcgucuccuucgaggugaagggcccggacggggagacggagcuggugacccugggcagccuggguaccaaguucuuaaacugggggacccugucccugagccucgacgccgaaggaaucuccgggacgaacagcaucuccuuccuggagagcuccaaaggcggguucgcucuguacgacgagggcuacagcgagaucccccgggagggcuuccucggggagauccgcugcuccagcgaguccgccgccaucagcgcgcacaagagcugcauccgggcccccggccugaucaaguacaagcccaugaccgaccagaucgagugcaccgccucccuggucgauccguucgccaucuuccucaaggggagcuugccccagacccgcaacggccagacguucacuuccaccaaggacaagaagaccgugcaggccuucacgaacggggcgauuaaggcccugcucagcaucaaccuggacgaccacgagaucguguuuaucaacaaggucauuuccugcgacgccaccuuccugaacgugagcggcugcuacuccugcgacuacggcgcccaugucugcgugaaggucaagagcuccgagucugcggacuucuucgccgaauccgaggacaagaccaccgugcucagcuuccccauccaguccgggacgcacgacuacugccaggugcugcacuuccagaagccccugguagacgagcggcucagcuacuccugcggcagcgagccgaagcugaucgucaucaaggggacccugguguacaugggcguguacgauuuccgcaacaagaccggcggguccagcaccgucguaaaccccuccgaaggcgccuggagcaucagcaacugguucuccgggcuccuggacuggcugggcgggccuaugaaggccauccuaaagauccugggcuucaucgccaucggcaucgugugcuucauccuguucaugauccucauccggaucgcggucaacagcaucaacaucaagaagaagaacuga

SEQ ID NO: 16008 - RNA, 3942 nt, Artificial Sequence
  derived and/or modified CDS sequence (opt11) from PTV(Balliet)__KP272023.1__GP
augaucuucaccauccugaacgugcucacccgcgccaugcucgucaugagcauguacucccugacgaccugggacagcaccucacggaacgacaugugcuucucgaacgauagcccccucgagggccuuguguacuacugggaaacccacuccaagaaacacgacuacaagaaacagaaaucccagcgcugccgggugggggacagcgacaagaagaugaucacgaacgugaccauuaucucgcucauuagcgagauccagaagucaaucagcgagcucucccugaguugcggcaacgaugacaacagcaccggccaggugcucaccuucaacgggcuugaagacacgauccgaggggacuacaucguggacugcgucaccggccuauaccagucggacaucggcguggggguuggccuggggcgcacccaccacggccaccaacagaugaagaacaaggccguugugaucgacgagaaggagcgaaugauccuccugcucgagacccagcagucugagaacgacaucaagaugcagguccucauguccgagaucgagcaacugaagaaccagcuguccaagaagcggaacgagcgcgggcaggagaagcgcgacgcggagaaggugaugagcgaccucauggcccgcaacucagaccugcggaagcauaaugacauccuaacggccgagaucucacagaugaagaacaagaauaccauccagcgcaacaaaaacacggugagcaccacgguggucccggccauccucuccguggcguuacugagcuccagcguggcgcccaucaucgccgccccgcccgacucccccaugaucaaccccuggccccaugccaagaaccgagucggcaccggcauguacaaguacgacgagaacgacgacagcgggugccgcccgauccgguacggcguguccuguaucggguucgacuucaugcucaagauggacaaguaccccuucuucaacgcguucaucggccacaagacgccccuggagagcuucgcagacaagaucaucgaaaaggaggaggagaccugcgagaucggcaccaacaaggaguucaaauguuucgaggagcgcgccuacaucaaggggaccugccccacuaacaucaacgccgugcauuacaucgacaauaagggcaagcugcgguacgucaaauguaaagagaaccucgagaugaccgaggacugcgccuuuugccgcaaaaucaagaagaaggccgggcaaagcguccaggugcagaagacgagcgugccccugcaggacgccaucugucaagaaaauuccgacaccuacagcggcccgaagauccccuucaagggagugugcaagaucggcuuaaucaaguacaaagagugcaaguuuaagaccuccucuuacgagaccgucuccuuuaucacgcugaaggagaaaggcaaaauauacaucgaacaccugauguuaaagaacaucgagguggugaccaacgucagcuucgugugcuaugagcacgccgggcaggacgagcaggagguugagcacaaggcccucaagcgagucuccgugaacgacugcaagaucguugauaacagcaagcagaagaucugcaccggcgaccacgucuucugcgagaaauacgacugcagcaccuccuaccccgacgugacgugcauucacgcgcccgggagcggcccgcuauacaucaaccugaugggguccuggaucaagccccagugcgugggcuacgaacgcguccucguggaccgggaggugaagcagccccugcuggcgcccgagcagaacugcgacacgugcgucagugagugccucgacgagggggugcacaucaagaguaccggguucgagaucaccagugccguggcaugcucccacgguucaugcaucuccgcccaccaggagccgucaaccuccgucaucgugcccuaccccggacugcuggccucggugggugggcgcaucggcauccaccuaucucacaccucagacucggcgagcgugcacauggugguggucugcccuccccgcgacuccugcgccgcgcacaacugccugcugugcuaccacggcauccucaacuaccaaugccacagcacccugagcgcuauccugaccucauuccuccugauucuguucaucuacaccguguucucggugacgacaaacauccuguacguccuccggcugauccccaaacagcugaagucccccgugggguggcucaaguuauucauaaacuggcugcucaccgcucugcgcaucaagacccggaaugugaugggccgcaucaaccagcggaucggguggguggaccaccaugacguggagcgcccccggcaccgcgagccuaugcggcgcuucaagacuacccugcuacugacgcugaucaugaugaccggcggcaaugcgugcagcaacacggugguggcuaacuccaagcagacccggugcgugcaagaggggagcaacaccaagugcucgaucaccgccacuaucacccuccgcgcgggcgugauaggggcggagagcugcuucaucauaaaggggcccauggagaaccagcagaagacuaucuccauaaagaccaucagcuccgagacgguuugccgggaggggagcuccuucuggaccagccuguacauccccucaugccugagcucccgccggugccaccucguaggcgacuguguuggaaacaagugccaaaguuggcgcgacgaccagcugucccgggaguucaguggggucaaggacaaucacaucaugaacgaaaacaagugcuucgagcagugcggcgccaucggguguggcugcuucaacaucaacccguccugccuguacguacaugccuaccucaaguccgcacgcaacgaggcagugagaguguucagcugcuccgacugggugcaccgcgugagcuuugaggucaaggggcccgacggcgagacagagcuggugacucuggguucccucgggacgaaguuccugaauuggggcacccugagccucucccuggacgcggaggggaucagcggcaccaacuccaucagcuucuuggaguccagcaagggcggguucgccuuauacgacgaaggcuacaacgagaucccccgcgagggguuccugggcgaaauccggugcuccagcgaguccgccgccaucagcgcccacaagagcugcauccgcgcgccaggucugaucaaauacaaaccgaugaccgaccagaucgagugcacggcuagccucguggacccauucgccaucuuccugaagggcucccugccccagacccguaacgggcagaccuucaccagcacgaaggacaagaaaacuguccaggccuucaccaacggcgccaucaaggcgcuccugagcauaaaccuggacgaccacgagaucguguucaucaauaaggucaagaacugugacgccaccuuccucaacgucuccggcugcuacagcugcgacuacggggcccacgugugcgucaaagugaaauccucagaguccgcugacuucuucgcggagagcgaggacaagacgaccguacugagcuuccccauccagagcggcacccacgacuauugccaaguccugcacuuccagaagccgcucguggaugagcggcuguccuacagcugcggguccgagcccaaacugaucgugauuaagggcaccuugguuuacaugggcguguaugacuuccgcaacaagaccgggggcagcuccaccgucgugaaucccagcgagggcgccuggucgauuuccaacugguucuccggccuguuggacuggcucgggggccccaugaaggccauccugaaaauccugggcuucaucgccaucgggaucgugugcuucguccuguucaugauccugauccgaaucgccgugaacucgaucaacauuaagaaaaagaacuga

SEQ ID NO: 16009 - RNA, 3942 nt, Artificial Sequence
  derived and/or modified CDS sequence (opt11) from PTV(Adames)__KP272029.1__GP
augaucuucacaauacugaacgugcucacccgcgccaugcuggucaugagcauguacucccugacgaccugggacagcuccagccggaacgacaucugcuucuccaacgacagcccccucgagggccugguguacuacugggagacccacuccaaaaagcacgacuacaagaagcaggggagccagaagugccgcgugggcgacuccgacaagaagaugaucagcaacgucaccaucaucucccugaucagcgagauccaaaaguccaucagcgaacucucccugagcugcgggaacaacgacaacuccacgggccaggugcugaccuucaacgggcucgaagacacuauacggggcgacuacaucguggacugcgucaccggccuguaccagagcgacaucgggguuggcguggggcugggccgcaucaaccacgaccaccaacaggucaagaacaaggccguggugaucgacgagaaggagaagaugaucucccuccuggagacccagcagagcgagaacgacaucaagacccagguccugaugagcgagaucgagcaacucaagaaccagcuguccaaacggcgcaacgagcgggggcaggagaagagggacgcggagaagcugaugucagaccucauggcccggaacuccgaccugcgcaaccacaacgugauccugaccgacgagaucagccagaucaagaacaacaucaccauccaccggaaccgcaacaugauguccacgaccguggucccggccauccucagcguggcccugcuguccagcuccguaggccccaucaccgccgcgccgcccgacagcaccaugaucaaccccuggccccacgccaagaaccgggucggcacggggauguacaaguacgacgagaacgacgaguccggcugccgccccauccgguacggggugagcugcaucggcuucgacuucaugcucaagauggacaaguaccccuucuucaacgccuucauuggccacaagaccccgcuggaguccuucgccgacaagaucaucgagaaggaggaggagaccugcgagaucgggaccaacaaggaauuuaagugcuucgaggagcgcgcguacaucaagggcacgugccccaccaacaucaacgccgugcacuacaucgacaacaaagggaagcugcgguacgucaagugcaaggagaaccucgagaugaccgaggacugcgccuucugcaggaagaucaagaaaaaggccggccagucgguccaggugcagaagaccuccgugccccugcaggacgccaucugccaggagaacagcgacaucuacucagggcccaagaucccguucaagggcgugugcaagaucggccugaucaaguacaaagagugcaaguucaaaacguccuccuacgagaccaucuccuucaucacccucaaggggaagggcaagaucuacaucgagcaccugaugcugaagaacaucgaggucgugaccaacgugagcuucgucugcuacgagcacgcggggcaggacgagcaggagguggagcaucgggcccucaagcgcguguccgucaacgacugcaagaucguggacaacagcaagcagaagaucugcacgggcgaccacaucuucugcgagaaguacgacugcuccaccagcuaucccgacgugaccugcauccacacccccggguccggcccccuguacaucaaccugaugggcagcuggaucaagccgcagugcgucggguacgagcgggugcucguggaccgcgaggucaagcagccccugcuggugcccgagcagaacugcgacacaugcguguccgagugccucgacgagggcguccacaucaagagcaccggguucgagaucaccuccgccguggccugcagccacggcuccugcaucagcgcccaccaggaagcguccaccagcgugaucauccccuacccggggcugcuggccuccgucggcggacgcaucgggauccaccucucgcacacguccgauagcgccagcgugcacaugguggucgugugcccgccccgggacuccugcgccgcccacaauugccugcugugcuaccacggcauccucaacuaccagugccacagcacccugagugcgauccugaccagcuuccuccugauccuuuucaucuacacagccuucuccgugaccacgaacguccuguacgugcuccgccugaucccaaagcaguuaaagagccccgugggcuggcugaaguuguucgucaacuggcugcucaccgcccugcggauaaagacccgcagggugaugggccgcaucaaccagcggaucggcuggguggaccaucacgacgucgagcgcccccggcaccgcgagcccaugcggcgcuucaagaccacgcugcuccugacccugauaauggugaccggcggcaacgccugcuccaacaccguggucgccaacagcaagcagacgcggugcgugcaggagggguccaacaccaagugcagcauuaccgcgaccaucacgcuccgugcgggcgugaucggggccgaguccugcuucaucaucaagggccccauggagaaccagcagaagaccaucagcaucaagaccaucuccagcgagaccgucugccgggagggcuccagcuucuggacgucccucuacaucccuagcugccuguccagccgccguugccaccucgugggggacugcgugggcaauaagugccagagcuggcgggacgaccagcugucccgggaguucagcggggucaaggacaaccacaucaugaacgagaacaagugcuucgagcagugcggcgccaucgggugcggcugcuucaacaucaaccccuccugccuguacgugcacgcguaccucaagagcgcccgcaacgaggccgugcgcgucuucuccugcagcgacugggugcaccggguguccuuugaggugaaggggcccgacggggagauggagcuggugacccuuggcagccucgggaccaaguuccugaacuggggcaccuuaucccucagccuggacgccgaggggaucuccggcacgaacagcaucuccuuccuggagagcuccaagggcggguucgcccucuacgacgagggcuacagcgagaucccgcgcgagggguuucugggcgagauucggugcuccagcgaguccgcggccaucagcgcucacaagagcugcauccgcgcccccgggcugaucaaguacaagcccaugaccgaccagaucgagugcaccgccucccucguggaccccuucgcgaucuuccugaagggcagccugccgcagacccggaacggccagacguucaccuccaccaaggacaagaagaccguccaggccuucacgaacggggccaucaaggcccuccugagcaucaaccuggacgaccacgagaucaucuucaucaacaaggugaagucuugcgacgccaccuuccucaacgugagcggcugcuacuccugcgacuacggggcgcacgucugcgugaaggucaagagcucggagagcgccgacuucuucgccgaguccgaggacaagaccaccgugcugagcuuccccauccaguccggcacgcgcgacuacugccaggugcugcauuuccagaagccucucguugacgagcggcugagcuacucuugcggcagcgagcccaagcugaucgugaucaaggggacccucguguacaugggcgucuacgacuuccgcaacaagaccgggggcuccagcaccgugaucaacccguccgaggggacguggagcaucaguaacugguucuccggccugcuggacuggcugggcgggcccaugaaggccauccugaagauccugggcuuuaucgcgaucgggaucgugugcuucauccucuucaugauccugauccggaucgccgucaacagcaucaacaucaagaaaaagaacuga

SEQ ID NO: 16010 - RNA, 3942 nt, Artificial Sequence; identical to SEQ ID NO: 12724
  derived and/or modified CDS sequence (opt11) from PTV(GML488831)__KP272032.1__GP

SEQ ID NO: 16011 - RNA, 3942 nt, Artificial Sequence
  derived and/or modified CDS sequence (opt11) from PTV(GML488778)__KP272038.1__GP
augaucuucaccauccugaacguccucauacgcgccaugcuggucaugagcauguacucccuuaccacgugggacaguaccucccggaacgacaugugcuucaguaacgacagcccccucgagggccugguguauuacugggagacccacuccaagaagcacgacuacaagaagcaggagucccagcgcugccgggugggggacagcgacaagaaaaugauuaccaacgucacgaucaucagucugaucucggagauccagaaguccaucagcgagcucucccugagcugcgguaacgacgacaauuccaccggccaggugcugacguucaacgggcucgaggacaccauccgcggugacuacaucguggacugcgucacgggccuguaccagagcgacauaggcgugggggugggccuggggcggacccaucacgaccaccagcaggucaagaacaaggccguggucauugacgagaaggagaggaugauuucccuccuggagacccagcaaagcgagaacgacaucaagaugcaagugcugaugucggagaucgagcagcucaagaaccagcugagcaagaagcggaacgagcgcggccaggagaagcgggacgcggagaaggugaugagcgaccugauggcccgcaacuccgaccuccggaagcacaacgggauccucaccgccgagaucagucagaugaaguacaacaacacgguucagcgcuccaagaacgucaugagcaccaccguggugccggccauccuguccgucgcccuccugagcuccagcguggcgcccaucauggccgccccgcccgacucccccaugaucaaccccuggccccaugccaagaaccgggugggcaccggcauguacaaguacgacgacaacgacgacucuggaugccgcccgauccgguacggcgucagcugcauaggauucgacuucaugcugaagauggacaaguacccguucuucaaugcauucaucggacauaagacuccccucgagagcuucgccgacaagaucauugagaaggaggaggagaccugcgagaucggcaccaacaaggaguucaagugcuucgaggagcgcgccuacaucaaggggaccugccccacgaacaucaacgccguacauuacaucgacaacaagggcaagcugcgguacgugaagugcaaggagaaccuggagaugaccgaggacugcgccuucugcaggaagauuaagaagaaggcgggccaguccguccaggugcagaagaccucugucucccuccaggaugcgaucugccaggagaacagcgauaacuacuccggccccaagauuccguucaaggggguguguaagaucggccugaucaaguacaaggagugcaaguucaagaccagcucuuaugagaccgugagcuucaucacccugaaggaaaaggggaagaucuacaucgagcaccucaugcugaagaacauagaggucgugaccaacgugucauucgucugcuacgagcacgccgggcaggacgagcaggaaguggagcaccgggcccugaagcgcguaucggucaacgacugcaagaucguggacagcuccaagcagaagaucugcaccggcgaccacguguucugcgagaaguucgacugcagcacguccuaccccgaugugaccugcauccacgcccccgggagcggcccccucuacauuaaccugaugggguccuggaucaagccgcagugugugggcuacgagcgggugcugguugaccgcgaggugaagcagccccuccuggcgcccgagcagaacugcgacacgugcgugagcgagugccuagacgagggcguccacaucaagaguaccggguucgagaucaccucggccguggccugcucccacggcagcugcauuuccgcccaucaggaggccagcaccucagugaucguccccuacccggggcugcuggcgucagugggcgggcgcaucggcauccaccugucccacacuagcgacagcgcuuccgugcacauggucguggugugcccgccccgggacucaugcgccgcccacaacugccuccugugcuaccacggcauccuuaacuaccagugccacaguacccucagcgccauccucacguccuuccugcucauccuguuuaucuacaccguauucagcgugaccaccaacaugcucuaugugcugcgccucauccccaagcaguuaaagagccccgugggguggcugaagcuguucaucaacuggcugcugaccgcgcuccggaucaagacgcgcaacguuaugggcagaaucaaccagcggauaggguggguggaccaccacgacgucgagcgucccagacaccgggagcccaugcgccgguucaagaccacccugcugcucaccuugaucaugaugacgggaggcaacgccugcagcaacaccgucguggccaacuccaagcagacccgcugcguacaagagggcagcaacaccaagugcuccaucacagccaccauuacccugcgggcgggcguaaucggggccgagagcuguuucaucaucaagucccccauggagaaccagcagaagaccaucagcauaaaaacgaucaguagcgagaccgugugccgcgagggauccagcuucuggaccucccucuacaucccgagcugccugagcucucggcgcugccaccuggucggggacugcgugggcaacaagugccagagcuggcgggacgaccaacucucccgcgaguucagcggcgugaaggacaaccacaucaugaacgagaacaaaugcuucgaacagugcggggccaucggcugcggcugcuucaauaucaaccccaguugccuguacguacacgccuaccucaagagcgcccggaacgaggcggugcgcguguucuccugcagcgacuggguccaccgcguguccuucgaggugaagggccccgacggggagaccgagcucgucacguuaggcagccugggcaccaaauuccucaacugggggacccugucccugucccucgacgccgagggcaucuccgggaccaacagcaucuccuuccuggagagcuccaagggcggguucgcccuguacgaugagggcuacagcgagaucccgcgggagggcuuccucggggagauccgcugcuccagcgagagcgcugccaucuccgcgcacaagagcugcauccgggcccccggccucaucaaguacaagcccaugacggaccagaucgagugcaccgccucccugguggaccccuucgccaucuuccucaaggggagccugccgcagacccgcaacggccagaccuucacguccaccaaggacaagaagaccguacaggccuucaccaacggggcaaucaaggcccuacucagcaucaaucuggacgaccacgagaucaucuucaucaacaagguccgcuccugcgacgccacguuccugaacgugagcggcuguuacuccugcgacuacggcgcucacgucugcgugaaggucaagagcuccgagagcgcagacuucuucgccgaguccgaggauaagacuaccguccucagcuuccccauccaguccgggacccacgacuacugccaggugcugcacuuccagaaaccccugguggacgagcgccucagcuacuccugcggaagcgaaccaaagcugaucgucaucaaggggacgcugguguacaugggcguguacgacuuccggaacaagacuggcggguccagcaccgucgugaacccgagcgagggcgccugguccaucagcaauugguuuuccggguugcuggacuggcuaggcggaccgaugaaggccaucaucaagauccugggcuucaucgccaucggcgucgucugcuucauccuguucaugauccugauccgcaucgcggucaacagcaucaauauuaagaagaagaacuga

SEQ ID NO: 16012 - RNA, 3945 nt, Artificial Sequence
  derived and/or modified CDS sequence (opt11) from PTV(Adames)__DQ363407.1__GP
augaucuucaccaucuuaaacguguugacccgcgcuaugcugguaaugagcauguacucccugacgacgugggacagcuccagcagaaacgacaucugcuucuccaacgacaguccacucgagggccugguguacuacugggagacccacuccaagaagcacgacuacaagaagcaggggagccagaagugccgcgugggcgauuccgacaagaagaugaucagcaacgucaccaucaucucccugaucagcgagauccagaaguccaucagcgaacucagccugagcugcgggaacaacgacaacucaacgggucaggugcugaccuucaaugggcucgaggacaccauacggggcgacuacaucguggacugcguaaccgggcuguaccagucggacaucggggugggcgugggguugggccgcauuaaccacgaccaccagcaggucaagaauaaggccguggugaucgacgagaaggagaagaugaucucccuccuugagacgcagcagagcgagaacgacaucaagacccaggugcugaugagcgagaucgagcagcucaagaaccagcuguccaaacggcgcaacgagcggggccaggagaagcgcgacgcggagaagcugaugagcgaccucauggccaggaacuccgaccugcgcaaccacaacgugauccugaccgacgagaucagccagaucaagaacaacauuaccauccaccggaaccgcaacaugauguccacgaccguaguccccgccauccucagcguggcccuguuguccagcagcguggggcccauuacagccgcgccgcccgacagcaccaugaucaaccccuggccucacgccaagaaccgggucggcacggggauguacaaauacgacgagaacgacgaguccggcugccgccccauccgguacggugugagcugcauuggcuucgauuucaugcucaagauggacaaguaccccuucuucaacgccuucaucggccauaaaaccccgcuggaguccuucgccgacaagaucaucgagaaggaggaggagaccugcgagauugggaccaacaaggaguucaagugcuucgaggagagggcguacaucaagggcacgugccccaccaacaucaacgccgugcacuacaucgacaacaaggggaagcugagguacgucaagugcaaggagaaucucgagaugaccgaggauugcgccuucugccgcaagaucaagaagaaggccggccagagcguccagguccagaagaccuccgugccccugcaggacgccauuugccaggagaacagcgacaucuacuccgggcccaaaaucccguucaagggcgugugcaagaucgggcugauaaaguacaaggagugcaaguucaagacgagcuccuacgagaccaucagcuuuaucacccucaaggguaagggcaagaucuacaucgagcaccugaugcugaagaacaucgaggucgugaccaacgugagcuucgucugcuacgagcacgccggucaggacgacgagcaggagguggagcaccgggcccucaagcgcguguccgucaacgacugcaagaucguggacaacagcaagcagaagaucugcacgggcgaccacaucuucugcgagaaguacgacugcuccacgagcuaccccgacgugacgugcauccacaccccugggucgggcccccuguacaucaaccuuaugggcagcuggaucaagccgcagugugucggguacgaacggguucuaguggacagagaggucaagcagccccugcuggugcccgagcagaacugcgauaccugcguguccgagugccuggacgagggcgugcacaucaagagcaccggguucgagaucaccucggccguggccuguagccacggcuccugcaucagcgcccaccaggaagcguccaccagcguaaucauccccuacccggggcugcuggccucagucggcggccguaucggcauccaccuaagccacacguccgacagcgccagcguccacauggugguggugugcccgccccgggacuccugcgccgcccacaacugccugcugugcuaccacggcauccucaacuaccagugccacagcacccugagcgcgauccugaccagcuuucuccuaauucuguucaucuacaccgcauucuccgugaccacaaacguccuguacgugcuccgccuuauccccaagcagcucaagagccccgugggguggcugaagcuguucgucaauuggcuguuaaccgcccuucggauuaagacccgccgggugaugggccgcaucaaccagcggaucggcuggguggaccaccacgacgucgagcgcccccggcaccgcgagcccaugcggcguuucaagaccacgcugcuccugaccuugaucauggugacagggggcaacgccugcuccaacaccguggucgccaacagcaagcagacgagaugcgugcaggagggguccaacaccaagugcagcauaaccgcgaccaucacgcuccgcgccggcguaaucggggccgaguccugcuucauuaucaagggccccauggagaaccagcagaaaaccaucagcauaaagaccaucuccagcgaaaccgucugccgggagggcuccagcuucuggacgucccuguacaucccgagcugccugucuagccgccggugccaccucgugggggacugugugggcaacaagugccagucguggcgcgacgaccagcugucccgggaguucagcggggucaaggacaaucauaucaugaacgagaacaaaugcuucgagcagugcggcgccaucgggugcggcugcuucaacauuaaccccuccugccuguacgugcacgcguaccucaaaagcgcccgcaacgaggccgugcgcgucuucuccugcuccgacugggugcaccggguguccuucgaggucaagggccccgacggggagauggagcuggugacccugggcagccucgggacuaaauuucugaacuggggaacccugucccucagucuggacgccgaaggcauuuccggcacgaacagcaucuccuuccuggagucauccaagggcggguucgcccucuacgacgaaggcuacucggagaucccgcgcgagggguuccugggagagauccggugcuccagugaguccgcggccaucagcgcccacaagagcugcauccgcgcccccgggcugaucaaguacaagcccaugacagaccagaucgagugcaccgccucccucguggaccccuucgcuaucuuccugaagggcagccucccgcagacccggaacggacagacguucaccuccaccaaggacaagaagaccguccaggccuucacgaacggggccauaaaggcccuccugagcaucaaccuggacgaccacgagaucauuuucaucaacaagguuaaguccugcgaugccaccuuccucaacguaagcggcugcuacuccugcgacuacggggcgcacgucugcgugaaggucaaaagcuccgaaagcgccgacuucuucgccgaguccgaggacaagaccaccgugcugagcuuccccauccaaucaggcacgcgcgacuacugccaggugcuccacuuccagaagccccucgucgacgagcggcugagcuacuccugcggcagcgagcccaagcugaucgugaucaaagggacacucguguacaugggggucuacgacuuccgcgacaagaccgggggcuccagcaccgugauaaacccguccgaggggacguggagcaucagcaacugguucuccggccugcuggauuggcucggcgggcccaugaaggccauccucaagauccugggcuucaucgcaaucgggaucgugugcuucauccucuucaugauccugauccggauagccgucaacagcaucaacaucaagaagaaaaacuga

SEQ ID NO: 16013 - RNA, 3942 nt, Artificial Sequence
  derived and/or modified CDS sequence (opt11) from PTV__M11156.1__GP
augaucuucaccauccugaacgugcucacgcgcgccaugcuggucaugagcauguacucccucacgaccugggacagcaccucccggaacgacaugugcuucuccaacgacagcccccucgagggccugguguacuacugggagacccacagcaagcgccacgacuacaagaagcaggagucccagcggugccgcgugggggacagcgacaagaaaaugaucacgaacgucaccaucaucucccugaucagcgaaauccagaaguccaucagcgagcucucccugagcugcgugaacgacgacaacuccacuggccaggugcugaccuucaacgggcucgaggacacgaucaggggcgacuacaucguugacugcguaaccgggcuguaccagagcgacaucggcgugggugucgggcugggccgcacccaucacggucaccagcagaugaagaacaaggccgugguuaucgacgagaaggagcggaugaucucccuccuggagacccagcagagcgagaacgacaucaagaugcagguccugauguccgagaucgagcagcucaagaaccagcugagcaagaagcgcaaugagcggggucaggagaagcgcgacgcggagaaggucaugagcgaccugauggcccggaacuccgaccuccgcaagcacaacgacauccugacggccgagaucagccagaugaagaacaagaacaccauccagcggaacaagaacaccguguccaccacggucgugccggccauccugagcguggcgcuccuguccagcuccgucgcgcccaucaucgccgccccgcccgacagccccaugaucaaccccuggccccacgccaagaaccgcguggggaccggcauguacaaguacgacgagaacgacgacuccggcugccggccgauucgcuacggggugagcugcaucggcuucgacuucaugcugaagauggacaaguacccguucuucaacgcguucaucgggcacaagacgccccucgaguccuucgccgacaagaucaucgagaaggaggaggagaccugcgaaaucggcaccaacaaggaguucaagugcuucgaggagcgggccuacauaaaggggaccugccccaccaacaucaacgccguccacuacaucgacaacaaggggaagcugcgcuacgugaagugcaaggagaaccuggagaugaccgaggacugcgcguucugccggaagaucaagaagaaggcgggccagagcgugcagguccagaagacguccgugccccuccaggacgccaucugccaagagaacagcgacaccuacuccgggccgaagaucccguucaagggcgucugcaagaucgggcugaucaaguacaaggagugcaaguucaagaccagcuccuacgagaccgugagcuucaucacgcugaaggagaagggcaagauuuacaucgagcaccucaugcugaaaaacaucgagguggucaccaacguguccuucgugugcuacgagcacgucggccaggacgagcaggagguggagcaccgcgcccugaagcgggugagcgucaacgacugcaagaucguggacaacagcaagcagaagaucugcaccggggaccacguauucugcgagaaguacgacuguuccaccagcuaccccgacgugaccugcauccacgcccccggcuccgggccgcucuacaucaaccugauggggagcuggauaaagccccagugcguaggguacgagcgcgugcuggucgaccgcgaggugaagcagccccuccuggcacccgagcagaacugcgacacgugcguguccgagugccuggaugagggaguccacaucaagagcaccggcuucgaaaucaccuccgcgguggccugcagccacggguccugcaucagcgcccaucaggagccguccaccagcgugaucguccccuaccccggccuccuggccuccgucgggggccggaucgggauccaccugagccacacauccgacagcgccuccgugcacaugguggugguaugcccgccccgcgacagcugcgcugcccacaacugccuccugugcuaucacggcauccugaacuaccagugccacagcacccucuccgccauccugaccagcuuccuccucauucuguucaucuacaccgucuucuccgugacgaccaacauccuguacgugcugcggcucauccccaagcagcuaaagucccccgucggcuggcugaagcuguucaucaacuggcugcugaccgcccuccgcaucaagacccggaacgugaugcgccggaucaaccagcgcaucggguggguugaccaccacgacgucgagcggccccgccaccgggagccgaugcgccgguucaagacgacccugcugcucacccucaucaugaugaccggcgggaacgccugcuccaacacgguaguggcgaacagcaagcagacccgcugcguccaagagggcuccaauaccaagugcagcaucaccgccacgaucacccugcgggccggcgugaucggggccgaguccugcuucaucauuaagggccccauggagaaccagcagaagaccaucagcaucaagaccaucuccagcgagacggugugccgcgagggguccagcuucuggaccucccucuacauccccagcugccuguccagccggcgcugccaccuggucggcgacugcguggggaacaagugccaguccuggcgggacgaccagcucagccgcgaguucagcggcgugaaggacaaccacaucaugaacgagaacaagugcuucgagcagugcggcgcgaucggguguggcugcuucaacaucaacccguccugccuguacguccacgccuaccucaagagcgcccgcaacgaggccgugcgggucuucuccugcagcgacuggguccaccgcguguccuucgaagugaaggggcccgacggcgagaccgagcucgucacccuggggagccccggcacgaaguuccuuaacuggggcacccucucccugagccuggacgccgaagggauauccggcacuaacagcaucuccuuccucgagagcucuaagggcggcuucgcucuguacgacgagggguacaacgagaucccccgggagggcuuccugggcgagauccgcugcagcuccgagagcgccgccauuuccgcccacaagagcugcauccgggccccggggcucaucaaguacaagccaaugaccgaccagaucgagugcacggcgucccugguggaccccuucgccaucuuccugaagggcagccucccccagacccgcaacgggcagaccuucaccagcacuaaggacaagaagaccgugcaggccuucaccaacggagccaucaaggcccugcuguccaucaaccucgacgaccacgagaucguuuucaucaacaaggugaagaacugcgacgcgaccuuccugaacgucagcgggugcuacagcugugacuacggcgcccacgugugcgugaaggucaagagcuccgagagcgccgacuucuucgccgaguccgaggacaagacgaccgugcugagcuucccgauccaguccggcacgcacgacuacugccagguacuccacuuccagaagccccuggucgacgagcggcugagcuacagcugcgggagcgagcccaagcucaucgugaucaagggcacccuggugugcaugggggucuacgacuuccgcaacaagacgggcggcucaagcaccguggugaaccccuccgagggggcguggagcaucuccaacugguucagcggccugcucgacuggcucgggggcccgaugaaggcgaucuuaaagauccugggguucaucgccaucggcauugucugcuucguucuguucaugauucugauccggaucgccgugaacuccaucaacaucaagaagaagaacuga

SEQ ID NO: 16014 - RNA, 3852 nt, Artificial Sequence
  derived and/or modified CDS sequence (opt11) from Phlebovirus(CoAr170255)__HM566149.1__GP
auguacaagcugaucaccaacauccucaagcugagcguggucuccgccauguacagcaucauguucugggaccccaccggcaucuccaagcugugccucagcaacaacuccccgcuggaggggcugguguacuacugggagaacacgaugcgcgagggcgaguucaagcgggagaagcguaagaagugccggcucgggaucagcgagcccgcccccguguccaaccagaccaucgucagccugaucgaggaggugcagaagucccccgcggagaugauucugaucugcgaggccaacggcaacagcaccggguccagccucuccuucgacggacugagcgacaacgagaucaagccguccaucguggacugcaccacgggcgaccgaaccagcgaccugcggguccucguggggaagggcaucuucgagaagaagaugucgaugagcaacgagaucgaccgcguggucucccuggaggaccaccuccagcgggagaaggagcuggugcagaccuuccaggaccugcaccacaacgagagcgagaagaacaagcugcucgagcacgagcuggagaaugugcgccaacagcugaagcgggagcgcgagagcaacaagaucaagauguggaccacgaagcggcccgagaucaccaccauagggcucaccacgacaaucgccaccauccuacuggccucccagagcgucgccuccagugugcccaugcccggccagcucaacaccuggccgcacgcgaagaaccgcgucgggggcggcguguucaaggccaacgacgacgacgaggacuccugcaagcugaucgacuacgggaucgccugccacggguucgacuaccugcuccggacugacaucuaccccuucuucaacgcccacgugagccaccgcucccugcuggaggcgagcaacgaggggaucauccucaaggacgaggccuccugcgagaucgagaccaauaaggauuucaagugcuacgaggagcgggcuuuccugaaguggagcugcccccaccuggugaacuccgcccacuuuaucgacagcaagggcaaguuacgcaucauuaagugcaaggccgaguacgaaaucaccgaggacugcaccuacugccgcagaaucaagaagaaggcggcccagcagaagcaggucuacaaguccagcaucgcccugcaggaugccgugugccaggagaacuccgacuacuacgacgguccccggauaacguucacaggggugugcaagaucggcaccauggaguacaagaagugcaagcacaagagcuccagcuucgagaacaucggguucaucaccauccgcgacaagggcaaguacuacaucgagaacaugcggacgaagaacaucgagauggucucuaacgucagcuucaucugcuacaaccacaacgggcaggacaccgagaaggacguacgcuuacuaaagcgcgucaagccgggcgacugcaagguggucgacgacucaaagaccaagcacugcaccggcgaccacguguucugcgagaaguacgacugcacgaaguccuaccccgaggcgaccugcaugcacgcacccggguccggccccauccuggugcuggucaugggggugugguucaagccgcagugcgugggcuacgagcggguccucguggagagagaggugaaggcccccguccugauccaggagaaggacugcgacacgugcguguucgagugccuggaggacaagauccuaaucaaguccaccggguucaagaugaucagcgccguggcuugcucccacggcagcugcgucuccagccaccagucccccagcaccuuccuguacaucgacuaccccggccugaccgccuccgucgggggcgagaucgggcuccaccugagccauaccgacgacuccgugagcgugcacaagaagauccacugcccggcgcgggaccccugcgaggcccacuccugcaucgugugcuaccacggccuggugaacuaccagugccacaccgugcucagcuacuccguggugagcuuccugcuggucugcaugauguacuuggccuuuuucaucacgagccgccuccuguucuuccugcggaucaugccccgccggcuccgcaaccccaucuccuggcugacccugcucauccggugggugcugcagacccugcucgccauccugcgccugucauucaagaagcucuccgagaccaucggguggaacaguccgaacaaccggcagcagauggacguggaagccaaucgccggccccugcgccgguaucgcaccacguucauccugacccuccuguucgucggccugaccuccgcgugcagcaacaccgccguguccaacagcaagcagacgaagugccuccaguccggcgggucggugaagugcucgaucaccgccacgaucacccugaaggccggcacgaucggggcggagagcugcuucaucauaaagggccccuccgagaaccagcagaaaguuauccgggugaagaccgugagcuccgagaccgucugccgcgagggcagcuccuucuggaccgggcaguucacgcccaguuguguguccucccggcgcugccaccuagugggcgacugcgucgggaaccgcugccaggccuggcgggacgagguggugagccgcgaauuuggcaacaugaaggacaacaaugucauguccgagaacaagugcuucgagcagugcggggccgccggcugcggcugcuucaauaucaacccgagcugccucuacgugcacuccaccuucaagagcgugcggcgcgaggccauccgugucuucaagugcaacgacugggugcaccgccugaccuucgagguguccggucccagcggcgagaaggaccggauaguccugaacucccucagcaccaaguuccugcagugggggacgaucucccugagccuagacgcggagggcaucuccgggaccaauagcuacagcuuccuggagagcaacaagggcggcuucgccauccacgacgaggaguucuccgagaucccccgcgagggguaccugggcgagauucggugcagcuccgagagcgccgugaucgccgcccacaaguccugcauccgggcgccgaaccucaucaaguacaagccaaugaccgaccagaucgacugcacagccagccugguggaccccuucgccaucuuccugaaggggagccucccgcagucccggagcggcuacacguucaccuccagcacagacaagaagacgguccaggcuuucaacuccgggagcaucaaggcccugaucuccaucaacauggacgaccacgagaucgaguuccugaacgacgcggccgauugcgacgccacguuccucaacgugagcggcugcuacuccugcaacuacggcgcccaaguaugcaucaagguccgcagcuccaagagcuccaucuucagcuccaacaacaacgacaacagcaucgugaucaacuucgacgcggaccaggggacccgggacuacugccgcaucauccacuucaacggcccgcugguggacgaaacccugcacuacuccugcgggggcgagagcaagcuccugcagaugaaagggucccugaucaccgucggccccuacgacuucagaaacacgaccggcggcaaguccaccaucgugaacccccacgaggagagcuggaaccucuucuccugguucagcgggcugcuggacuggcucgggggcccccugcgcgccaucuuaaagaucguccucaucaucaucaucggcaucauccuguucaucgugguggccuuccugauccggcucgucaucuucaacguacuccugaaguccaagaagaauuaa

SEQ ID NO: 16015 - RNA, 3873 nt, Artificial Sequence
  derived and/or modified CDS sequence (opt11) from Phlebovirus(CoAr171616)__HM566154.1__GP
auguuccagaucaucuaccugcucaccaagcuguaccuggugucuuccauguacagcaucauguucugggagaacgagaacaucuccaagcucugccugagcaacaacagcccccuggagggccucgucuacuacugggagaacgugaugaaggagggggauuuuaaggaggagaagcgcaagaagugccggaucggcccgagcgaccugaagcgcgugaccaaccagacgcuaaccacccucaucgaggagguccagaagucccccagcgagauccagcugcugugcgaagaggacgggaacaagaccggcaucuccauguucuucgacgggcucagcgacgacaucuccacgcccagcaucguggacugcaacggcaacauccggaucucggaccugcgcgugcaggucggccgagggcacuucgagaaggaaaacgagauccgcaagaucgaggagaucgugacccuggaagacgaccuccggcgcgagcgggaccugaacaagcugcuacaggaccucaacaagaaggacgccgaggagcgccggaucaucgagcacgagcugaccaacaugcgcgagcaacuccagcgggagcgcgagcgcagcaagcagcagaucaaggagcacgagaaaaucgaggugaacaaccacaaggagcccgccacccaccugaacgucuccaagcugcucacgaucggccugcuggcgcagcaggucggccaggugaucgccaccgagccggggcagcucaacaccuggauccacgccaagaacaggaucggcaaaggccuguacaagaccgaggacacggacgaggacggcugccgggggcuggacuacggcgugagcugccucggguucgacuaccugcugcgaaccgacaucuaccccuucuucaacuccuucgugagccaccucuccaugcuggaggccagcaccgaggaccugaucgagaaggagggcaccagcugcgagaucgagacgaacaaggaguucaagugcuacgaggaacgggcauucaucaagggcuccuguccccacuuagugaacagcgcgcacuuccuggacaacaaggggaagcugcgcaucgucaagugcaagaccgacuucgagaugaccgaggacugcaccuucugccgcaagaucaagaagaagaacagccagcacaagcaagucuucaagacgagcaucgcccuccaggacgccgugugccagaacaacuccgaccuuuacaacggcccccgcaucguguacagcaacgugugcaagaucgggaugguguccuacaagcagugcaagagcaagaccuccucguacgaguccgugggcuucgugauccugaaggggaagggcaaauucuauaucgagaacaugaagaucaaaaacaucgaggugaucgccaacgucagcuucaucugccaccaguaccagggccaggacgggaccgagaaggagcagcgcucccucaagcggaucagcgugggcgagugcaagucagucaacccgcagaagaccaagcacugcacgggggaccacguauucugcgagaaguacgacugcaccaagucuuaccccgaggugaccugccugauggcgcccggcuccgggcccauccugguccagaucaugggcagcuggaucaagccgcagugcgugggauacgagaaggugcucguagagcgcgaggugaagucccccacccugacggaggagagagacugcgacacguguguguacgagugccuggaggacaagauccucaucaagagcaccggguucaagaugaucucugcggucgccugcucccacggcaugugcgugagcucccaccaggagcccagcaccuuccuguacaucaacuaccccgggauguccgccagcaucggcggggagaucggccugcaccugucccacaccgacgacagccucucccuacauaaggugaucagcugcccgucccgcaaucccugcgacguccacagcugcaucaucugcuaccacggcaucaucaacuaccagugccacaccgccuuauccuacaccauaguggcguucagcuucaucuccuuccucuaccugaccuucaaggugaucagccagcugcucuacacuuucaaggucgugcccaagaagcugaaggggccauucuacuggaugggcuaccugaucaaguggaucgugaagaccauccucggggucgugagaaacaccuucuucaccauguccaaccgcaucgggugggaacggcgcgacgagauccacgaggacaucgaggccaacccgcggcggcaccuccagcgguucaagaccacguucgugcugaccaugcugaugaucaacggcgggcugugcugcagcaacacucuggucagcaacuccaaacagacccgcugcgugcagagcggcaacgaggucaaguguuccgucagcgccacgguggugcucaaggcaggggugauuggcgccgaguccuguuucauaaucaaggggcccagcgagaaccagcacaagaugaucucggugcggacccugagcuccgagaccgugugccgcgagggagcuagcuucuggaccggccacuucucccccagcugcgucuccagccggcgcugccacuuagugggggagugccacggcaaccggugccaguccuggcgcgacgaccagaucagccgggaguucgggggcgugaaggacaacaaccgcauguccgaaaacaagugcuucgagcagugcgggagcaucggcugcggcugcuucaacaugaacccguccugccucuacgugcacacgacccugaaguccgcccgcaacgaggccgugcggguguucaagugcaacgacuggauccaccgccugaacuucgaggucaucgggccgagcggcgagaaggacguggugaccuuaaacuccaugagcaccaaguuccugcagugggggacuaucuccuuaucccucgacgccgagggcaucaccgggaccaacuccuacagcuuccuggaguccagcaagggcggcuuugccauccacgacgaggaguucuccgacaucccccgggagggguaccugggagagauccgcugcagcuccgagagcgcggucaucuccgcgcacagcuccugcauccgggcccccgaccucaucaaguacaagccaaugaccgaccaaaucgagugcacgagcaccuugaucgacccguucgccaucuucaugaaggggucccugccccagacccgcagcggcuacaccuucacguccagcaaggacaagaagaccauccaggccuucaauaccaacagcaucaaggcgcucaucucucucaaccuggacgaccacgagaucguguucgugagcgaccagaccaacugcgagugcacguuccucaaccugaccgggugcuacuccugugacuacggcgcccacgucugcuuccggaucaagagcgacaagaaggguguguucguguccaacaccgaggccaaggacaucagcuucggguucgagguccugaccggcacgcacgacuacugccagauccagcacuucaacucccccagcguguacaagacccucuccuacagcugcgggggcgaguccaagcugcuggugaucaagggcagccucaucaccaucggaccgcacgacuaccgcaacaagaccggcggggccuccacggucgugaaccccagcgaggagggcugguccgugaccaacuggaucgggggcuucaucagcuggcugggcgggccccugaaggcgcuccugaagaucgccgucaccauccuggccggcguggucaucuuccucaucaucuacuucuuccugcggcugaucgccaccaacauccucaugaagacgaagaagaacuga

SEQ ID NO: 16016 - RNA, 3852 nt, Artificial Sequence; identical to SEQ ID NO: 12730
  derived and/or modified CDS sequence (opt11) from Buenaventura virus(CoAr3319)__KP272002.1__GP

SEQ ID NO: 16017 - RNA, 3942 nt, Artificial Sequence
  derived and/or modified CDS sequence (opt11) from Cocle virus(GML244915)__KP272034.1__GP
augauguucacccaccuggacgugcucacccgcgccaugcuggucaugagcauguacucccugacgaccugggacagcaucaggcgcaacgacaucugcuucuccaacgacagcccccucgagggucugguguacuacugggagacccaguccaaaaugcacgaguacaagaaggaagacagccagaagugccgggugggggacuccgagaagaagaugaucagcaacgucaccaucaucucccugaucagcgagauccagaaguccaucagugagcucucccugagcugcggcaacgacgacaacuccacgggccaggugcugauguucaacggccucgaagacaccauccgcggggauuacaucguggacugccugaccggccuguaccagagcgacaucggcgucggggugggcuccgggaagaccaagcacgaccacacgaagcuccggaacaaggccgugaucaucgacgagaaggagaagaugaucagccuguuagaggcgcagcaguccgagaacgacaucaagacccagguccucaugagcgagauagagcagcugaaaacccagcugcucaaccgccggucugagcgcggccacgagaagcggaagaacgaggagaucguguccgaccugauggcccgcaacagcgaccugcguaagcauaacgacauccucaaggacgagauggaccagaucaaggagaaccugaccaucuucaagucccgcaacgccaucagcacgaccuccgugccggccaucaugagcaucgcccugcucuccagcuccgucaugcccaucaucgcggccgugagcgacucgcccaugaucaaccccuggccgcacgccaagaaccguguggggagcggcauguacaaguacgacgacaacgacgaguccggcugccgccccauccgguacggggucagcugcaucggcuucgaccacaugcugaaaauggacaaguaccccuuuuucaacgccuucaucgggcauaagacccugcucgaguccuucguggacaagaucaucgagaaggaggacgagaccugcgaaaucggcacgaacaaggaguucaagugcuucgaggagcgcgcguacaucaaggggaccugcccccauaacauuaacgccgugcacuaccuggacaacaaggggaagcuccgguacgucaagugcaaggagaaccucgagaugaccgaggacugcgcauucugccgcaagaucaagaagaaggccggccaaagcguccaggugcagaagaccuccgugccgcugcaggacgccaucugccaggacaacagcgacauuuacacuggaccucggauccccuacaagggcaugugcaagauugggcuggugaaguauaaggagugcaaguccaagaccagcagcuacgagaccguguccuucaucacccugaagggcaagggcaagaucuacaucgagcaccugaugcugaagaacaucgagguugugacgaacgucagcuucgugugcuacgagcacgcgggccagguggagcaggaggucgagcaccgcgcccucaagcggguguccguaaacgacugcaagaucgucgacagcuccaagcagaagaucugcaccggggaccacguguucugcgaaaaguacgacugcagcaccuccuaccccgacgugaccugcauccaggccccgggguccgggccccuguacgucaaccugaugggguccuggaucaagccccagugcgugggcuacgagcgcguguuagucgagcgcgaggugaagcagccccugcugacgccggagcagaacugcgacacgugcgugagcgagugccuagacgagggcguccacaucaaguccaccggguucgagaucaccagcgccguggcuugcucccacggcagcugcauauccgcgcaccaggaggccagcaccuccaucauugugcccuaccccggucugcuggccagcgucggcgggaagaucggccuccaccugagccacaccuccgacagcgccuccgugcacaugaucguggucugcccgccccgggauagcugcgccgcgcacaacugccugcucugcuaccacggcaugcugaacuaccagugccacuccacccugagcgcuauccugaccuccuuccuccugauccuguucaucuacacgaccuucagcuucaucaccaacauccucuaccugcugcgccuccugcccaagcagcugaagucccccaucggguggcucaagcuguucaucaacuggcuguucaccauccuccggauccgcaccaaguaccugaugggccggcuuaaccagcgcaucgggugggucgagaaucacgacguggagcggccccggccgcgggagcccaugcgccgguucaagacgacccucaugcugaccaugcugaugaucaccggcggcuacgccugcagcaacacggucguggccaacuccaagcagacccgcugcgugcaggaggggucuaacaccaagugcuccgucaccgccacggugacccucaaggcgggcgucaucggggccgagagcugcuucgucaucaagggccccauggagaaccagcagaagaccauauccaucaagaccgugagcuccgaaacggugugccgggaggggaguuccuucuggaccagccucuacauccccagcugccuguccagccgcagaugccaccucgucggcgacugcgugggcaaccgcugccaguccuggcgggaggaccagcugagccgcgaguucuccggggugaaggacaaccagaucaugaacgagaacaagugcuucgagcagugcggcgccaucgggugcggcugcuucaacaucaacccgagcugccuguacguccacgccuaccucaaauccgcgcggaacgaagccgugcgcguguucagcugcuccgacuggguccaccgcguguccuucgagguuaaggggcccgacggcgagaccgagcuggucacccugggcucccucgggacgaaguuccugaauuggggcacccugagccucucccuggacgccgaggggaucaccggcaccaacagccuguccuuccucgagagcuccaagggcggguucgcccuuuacgacgagggcuucagcgagaucccucgggagggguuccugggcgagauccgaugcuccagcgagagcgccgcgaucuccgcccauaagagcugcauccgggcuccugggcucaucaaguacaagcccaugacggaccagaucgagugcaccgccucccugguggaccccuucgccaucuuccuuaaaggcagccucccccagacccgcaacgggcagaccuuuacguccaccaaggacaagaagaccgugcaggcguucaccacgggcgccauacgggcccugcugagcaucaaccucgacgaccacgagaucaccuucaucuccaagaucaagaacugcgaggccaccuuccugaacgucagcggcugcuacuccugcgacuacggggcccacgugugcaucaagaucaagagcuccgagagcgcggacuucuacgccgaguccgaggacaagacaacgguguuaagccucccggucuccagcggcacccaggacuacugccaggugcugcacuuccagaagccccugguggacgagcgccucuccuacucgugcggguccgagcccaagcugauggucaucaagggcacccugguauacaugggcgucuacgacuuccggaacaagaccgggggcagcagcacgguggugaaccccagugacgccagcugguccaucgccaacugguucagcgggcuccuggacuggcugggcgggccgcucaaggcgauccugaagauccuaggcuucaucgccaugggcgucgugugcuuuauccucuucaugauccugaucaagaucgccgugagauccgucaacaugaagaagaagaacuga

SEQ ID NO: 16018 - RNA, 3873 nt, Artificial Sequence
  derived and/or modified CDS sequence (opt11) from Campana virus(VP-334K)__KP272041.1__GP
augcugcacuucaucaccaucaccacgaaguuccucgcuguggccagcauguacaacuugcuguacugggaccccaacggccucucccgccugugccugagcaacaacuccccgcucgaggggcugguauacuacugggaaaaccugaugaaggaaagugauuucaagaaggauaagaagaagcacugccggaucggcaccuccguggcggcccccguuacuaacgagacccucacgacccugaucgaagagguccagaagucccccagcgagauaauacuccagugcgaaagccgcaacaacgauaccgguaacuccaucuauuucgacggccucgccgaugacaucgagagccccuccaucgugaacugcgagagcgggaaacgggaguccgaccugcgcgugcuggucggccagggccucaagaaggagaucauccugaacgagaucgccgccaucgaccgccaggcgagccuggaggagcaccuccgcggggagaaggcccugaccucccugcuccaggaaaucagcaagcaggacgaggccgagcguaaacgccuggagcaugagguguccagccugcggcagcagcucaugaacgagcgcgaggaaaauaagaagcggaagaacaucccggccuuuggcguuuccagcacgacaagcuccagccugaugaacaucucccgcgucgugaccaucgggcugcucagccagcaggcgaucgccaaccccucccugcccggccaggugaacaccuggccccacgcgaagaaccggauugggcagggccuguacagaaucgacacgagcgacgaggacggcugccgggggcucaacuacggcgucaucugccugggguucgaccaccuccugcgcauggacuuauacccguucuucaaugcauacgugucccaccugagccuccuggaggccuacaccgagaacaucauccaaaaggacgagaccgagugcgagaucgagggcggcaaggaguucaagugcuacgaggagcgggcguacaucaagggggucugcccccaccgcaucaaguccgcccacuaccuggaccagaagggcaaacuccggaucaucaagugcaaggagaaccuggagcugacugaggacugcacguacugccgcaagaucaagaaggaccggggucacaccaagcaggucuacaagaccagcgugccccuccaggacgcuaucugccaggacaacuccgacgacuacagcggccccaagaucuccuucaagggggugugcaagauuggcaugaucgaguacaaggagugcaaguacaagagcucgagcuucgagaccgucggcuucaucacgaucaaggagaaggggaaguucuacaucgaggacaugaagcugaagaaccuggaggugaccaacaacguagccuucaucugccaccaguauaccggccaggacgggaccacggacgaggaaaaccgccaucucaagcgcaugagugucaaggacugcaagaacgugaacagcuccaagagcaaguacugcaccggcgaccacaucuucugucagguguacgacugcaccaagagcuacccggaggcgaccugcuucgucgcccccggguccggucccgugcugguccaagugaugggcagcuggaucaagccccagugcguggguuacgagaaaguccugguggagcgagaggugaagaugcccauccuaacggaggagcgcgauugcgacacgugugucuacgagugcaaggaggaccacauccugaucaaguccaccggcuucaacaugaucagcgccgucgccugcucgcacgggagcugcguguccgcgcaccaggaucccagcaccuuccugaacaucgaguaccccggcauguccgcgagcgucgggggcgagaucggcauccacaucucccacaccgacgacagccugucccuucacaagaagaucuacugccccgcgcgggacagcugcgaggcccacaacugcaucaugugcuaccaugggcugaucaacuaccagugccacaccgcccuguccuacgccguugugagcuuuauguucgucuccaucgccuacgugaucuucaaugugcuccgccugguccugguggcgcuccacguaguucccagaaagcucaagagccccaucgacuggcugauccugcugaucaaguggguguuccugcuccuggccaaggugauccgcgcuuuccucacccaccucaacacaacgaucggauggcgggagcgccagaacaacuucgccgcggaccucgaggcccaacggcgcccacugcagcgguucaagacaaccguccuccugaugaugaugcugaucagcgugguguccagcugcagcaacagcgucguguccaacagcaagcagacccgcugcauccaguccgggagcaacaccaagugcuccgugagcgccacgaucacccucaaagccggcgucaucggcgccgaguccugcuuugugauaaaggggcccagcgagaaccagcacaagaccaucgugauccgcaccgucuccagcgagacgaucugccgggagggcagcucauucuggacugggcacuucaccccguccugccugucuucccggcgcugccaccuggugggcgacugcguggggagccggugccagggcuggcgcgaggaugucaucucgcgggaguucggcggggugaaggacaacaaccagaugucugagaacaaaugcuucgagcagugcggcgcugccggcugcggaugcuucaacaucaaccccagcugccucuacgugcacaccauucugcgcuccgccaggaacgaggccguccggguguucaagugcaacgacuggguucacaagcugacguuccacaucaaggggcccaacggcgaggaggaggacguugugcucaacagccuguccaccaaguuccuaucguggggcaccaucucccucagccuggacuccgagggaaucaccggcacgaacagcuacuccuuccuggagagcuccaagggcggguucgcaauccacgaugaggaguucagcgagaucccccgcgagggguuccucggcgagauccggugcuccagcgaguccgcgguggucagcgcccacaaguccugcauccgcgccccgggccugaucaaguacaagcccaugaccgaccaaguggagugcagcgccagccugguggaccccuucgccaucuuuaucaaggggucccucccgcagacccggagcggcuauaccuucacguccagccgcgacaagcggaccauccaggcguuuaacaacggggccaucaaggcccugcugacccuuaaccucgacgaccacgagguaaucuucagugagagcguaaucacgugcgagugcaccuuccugaacaucuccggcugcuacagcuguaacuucggggcccaggugugcuucaagaucaaauccagcggcaucggcgacuucgucuccagcuccgagaccgggaacauccucuucagcuuucccgugaaguccggcaccgaggacuacugccagauccagcauuucaacagccccaugguauccgagagccugcaguacuccugcgggggcgagucaaagcugcuccuuaucaagggcagcuugaucuccgucgggcccuacgacuaccgcaacaagaccggcgggagcuccacgguggucaacccggcggaggacagcugguccaucuucaacuggcucagcggauuccuggauuggcucgggggccccuugcgagcccuggugaaaauagcccuggccauaaucggcgcccucgcgcugcuauucaucaccaucaugcucgcccgcuccgugaucagcaacacccuuucccggaagaagaaaaacuga

SEQ ID NO: 16019 - RNA, 3594 nt, Artificial Sequence; identical to SEQ ID NO: 14376
  derived and/or modified CDS sequence (opt11) from RVFV(ZH-548)__DQ380206.1__GP

SEQ ID NO: 16020 - RNA, 3594 nt, Artificial Sequence; identical to SEQ ID NO: 14377
  derived and/or modified CDS sequence (opt11) from RVFV(ZS-6365)__DQ380205.1__GP

SEQ ID NO: 16021 - RNA, 3594 nt, Artificial Sequence; identical to SEQ ID NO: 14378
  derived and/or modified CDS sequence (opt11) from RVFV(CAR-R1622)__DQ380219.1__GP

SEQ ID NO: 16022 - RNA, 3594 nt, Artificial Sequence; identical to SEQ ID NO: 14379
  derived and/or modified CDS sequence (opt11) from RVFV(2250/74)__DQ380209.1__GP

SEQ ID NO: 16023 - RNA, 3594 nt, Artificial Sequence; identical to SEQ ID NO: 14380
  derived and/or modified CDS sequence (opt11) from RVFV(T1)__DQ380201.1__GP

SEQ ID NO: 16024 - RNA, 3594 nt, Artificial Sequence; identical to SEQ ID NO: 14381
  derived and/or modified CDS sequence (opt11) from RVFV(1853/78)__DQ380220.1__GP

SEQ ID NO: 16025 - RNA, 3594 nt, Artificial Sequence; identical to SEQ ID NO: 14382
  derived and/or modified CDS sequence (opt11) from RVFV(MP-12)__DQ380208.1__GP

SEQ ID NO: 16026 - RNA, 3594 nt, Artificial Sequence; identical to SEQ ID NO: 14383
  derived and/or modified CDS sequence (opt11) from RVFV(ZM-657)__DQ380204.1__GP

SEQ ID NO: 16027 - RNA, 3594 nt, Artificial Sequence; identical to SEQ ID NO: 14384
  derived and/or modified CDS sequence (opt11) from RVFV(ZH-501-777)__DQ380202.1__GP

SEQ ID NO: 16028 - RNA, 3594 nt, Artificial Sequence; identical to SEQ ID NO: 14385
  derived and/or modified CDS sequence (opt11) from RVFV(OS-3)__DQ380184.1__GP

SEQ ID NO: 16029 - RNA, 3594 nt, Artificial Sequence; identical to SEQ ID NO: 14386
  derived and/or modified CDS sequence (opt11) from RVFV(Sudan 86-2010)__JQ820489.1__GP

SEQ ID NO: 16030 - RNA, 3594 nt, Artificial Sequence; identical to SEQ ID NO: 14387
  derived and/or modified CDS sequence (opt11) from RVFV(T-46 (228113))__DQ380199.1__GP

SEQ ID NO: 16031 - RNA, 3594 nt, Artificial Sequence; identical to SEQ ID NO: 14388
  derived and/or modified CDS sequence (opt11) from RVFV(2007000094)__EU574055.1__GP

SEQ ID NO: 16032 - RNA, 3594 nt, Artificial Sequence; identical to SEQ ID NO: 14389
  derived and/or modified CDS sequence (opt11) from RVFV(ZC-3349)__DQ380207.1__GP

SEQ ID NO: 16033 - RNA, 3594 nt, Artificial Sequence; identical to SEQ ID NO: 14390
  derived and/or modified CDS sequence (opt11) from RVFV(2007001602)__EU574043.1__GP

SEQ ID NO: 16034 - RNA, 3594 nt, Artificial Sequence; identical to SEQ ID NO: 14391
  derived and/or modified CDS sequence (opt11) from RVFV(1260/78)__DQ380214.1__GP

SEQ ID NO: 16035 - RNA, 3594 nt, Artificial Sequence; identical to SEQ ID NO: 14392
  derived and/or modified CDS sequence (opt11) from RVFV(2007000324)__JF326195.1__GP

SEQ ID NO: 16036 - RNA, 3594 nt, Artificial Sequence; identical to SEQ ID NO: 14393
  derived and/or modified CDS sequence (opt11) from RVFV(KEN/Gar-Msq/131B-04/06)__HM586972.1__GP

SEQ ID NO: 16037 - RNA, 3594 nt, Artificial Sequence; identical to SEQ ID NO: 14394
  derived and/or modified CDS sequence (opt11) from RVFV(2007004194)__EU574031.1__GP

SEQ ID NO: 16038 - RNA, 3594 nt, Artificial Sequence; identical to SEQ ID NO: 14395
  derived and/or modified CDS sequence (opt11) from RVFV(73HB1230)__DQ380221.1__GP

SEQ ID NO: 16039 - RNA, 3594 nt, Artificial Sequence; identical to SEQ ID NO: 14396
  derived and/or modified CDS sequence (opt11) from RVFV(73HB1449)__DQ380211.1__GP

SEQ ID NO: 16040 - RNA, 3594 nt, Artificial Sequence; identical to SEQ ID NO: 14397
  derived and/or modified CDS sequence (opt11) from RVFV(ZH-548M12)__M25276.1__GP

SEQ ID NO: 16041 - RNA, 3594 nt, Artificial Sequence; identical to SEQ ID NO: 14398
  derived and/or modified CDS sequence (opt11) from RVFV(ZINGA J83 R1)__KU978776.1__GP

SEQ ID NO: 16042 - RNA, 3594 nt, Artificial Sequence; identical to SEQ ID NO: 14399
  derived and/or modified CDS sequence (opt11) from RVFV(Sudan 28-2010)__JQ820491.1__GP

SEQ ID NO: 16043 - RNA, 3594 nt, Artificial Sequence; identical to SEQ ID NO: 14400
  derived and/or modified CDS sequence (opt11) from RVFV(2007001292)__EU574046.1__GP

SEQ ID NO: 16044 - RNA, 3594 nt, Artificial Sequence; identical to SEQ ID NO: 14401
  derived and/or modified CDS sequence (opt11) from RVFV(Sudan 85-2010)__JQ820488.1__GP

SEQ ID NO: 16045 - RNA, 3594 nt, Artificial Sequence; identical to SEQ ID NO: 14402
  derived and/or modified CDS sequence (opt11) from RVFV(2007002060)__EU574039.1__GP

SEQ ID NO: 16046 - RNA, 3594 nt, Artificial Sequence; identical to SEQ ID NO: 14403
  derived and/or modified CDS sequence (opt11) from RVFV(2007002476)__EU574036.1__GP

SEQ ID NO: 16047 - RNA, 3594 nt, Artificial Sequence; identical to SEQ ID NO: 14404
  derived and/or modified CDS sequence (opt11) from RVFV(2269/74)__DQ380222.1__GP

SEQ ID NO: 16048 - RNA, 3594 nt, Artificial Sequence; identical to SEQ ID NO: 14405
  derived and/or modified CDS sequence (opt11) from RVFV(SA-51 (Van Wyck))__DQ380195.1__GP

SEQ ID NO: 16049 - RNA, 3594 nt, Artificial Sequence; identical to SEQ ID NO: 14406
  derived and/or modified CDS sequence (opt11) from RVFV(OS-8)__DQ380185.1__GP

SEQ ID NO: 16050 - RNA, 3594 nt, Artificial Sequence; identical to SEQ ID NO: 14407
  derived and/or modified CDS sequence (opt11) from RVFV(BIME-01)__KX609032.1__GP

SEQ ID NO: 16051 - RNA, 3594 nt, Artificial Sequence; identical to SEQ ID NO: 14408
  derived and/or modified CDS sequence (opt11) from RVFV(Kenya 83 (21445))__DQ380198.1__GP

SEQ ID NO: 16052 - RNA, 3594 nt, Artificial Sequence; identical to SEQ ID NO: 14409
  derived and/or modified CDS sequence (opt11) from RVFV(2007000253)__JF326192.1__GP

SEQ ID NO: 16053 - RNA, 3594 nt, Artificial Sequence; identical to SEQ ID NO: 14410
  derived and/or modified CDS sequence (opt11) from RVFV(200803166)__JF311381.1__GP

SEQ ID NO: 16054 - RNA, 3594 nt, Artificial Sequence; identical to SEQ ID NO: 14411
  derived and/or modified CDS sequence (opt11) from RVFV(2007001107)__EU574047.1__GP

SEQ ID NO: 16055 - RNA, 3594 nt, Artificial Sequence; identical to SEQ ID NO: 14412
  derived and/or modified CDS sequence (opt11) from RVFV(ANK-3837)__DQ380215.1__GP

SEQ ID NO: 16056 - RNA, 3594 nt, Artificial Sequence; identical to SEQ ID NO: 14413
  derived and/or modified CDS sequence (opt11) from RVFV(OS-1)__DQ380186.1__GP

SEQ ID NO: 16057 - RNA, 3594 nt, Artificial Sequence; identical to SEQ ID NO: 14414
  derived and/or modified CDS sequence (opt11) from RVFV(Sudan 2V-2007)__JQ820490.1__GP

SEQ ID NO: 16058 - RNA, 3594 nt, Artificial Sequence; identical to SEQ ID NO: 14415
  derived and/or modified CDS sequence (opt11) from RVFV(200803162)__JF311377.1__GP

SEQ ID NO: 16059 - RNA, 3594 nt, Artificial Sequence; identical to SEQ ID NO: 14416
  derived and/or modified CDS sequence (opt11) from RVFV(2007001811)__EU574040.1__GP

SEQ ID NO: 16060 - RNA, 3594 nt, Artificial Sequence; identical to SEQ ID NO: 14417
  derived and/or modified CDS sequence (opt11) from RVFV(clone 13)__DQ380213.1__GP

SEQ ID NO: 16061 - RNA, 3594 nt, Artificial Sequence; identical to SEQ ID NO: 14418
  derived and/or modified CDS sequence (opt11) from RVFV(MP12)__Z30318.1__GP

SEQ ID NO: 16062 - RNA, 3594 nt, Artificial Sequence; identical to SEQ ID NO: 14419
  derived and/or modified CDS sequence (opt11) from RVFV__JQ068143.1__GP

SEQ ID NO: 16063 - RNA, 3594 nt, Artificial Sequence; identical to SEQ ID NO: 14420
  derived and/or modified CDS sequence (opt11) from RVFV(2007002445)__EU574037.1__GP

SEQ ID NO: 16064 - RNA, 3594 nt, Artificial Sequence; identical to SEQ ID NO: 14421
  derived and/or modified CDS sequence (opt11) from RVFV(2008/00101)__HE687306.1__GP

SEQ ID NO: 16065 - RNA, 3594 nt, Artificial Sequence; identical to SEQ ID NO: 14422
  derived and/or modified CDS sequence (opt11) from RVFV(Hv-B375)__DQ380218.1__GP

SEQ ID NO: 16066 - RNA, 3594 nt, Artificial Sequence; identical to SEQ ID NO: 14423
  derived and/or modified CDS sequence (opt11) from RVFV(763/70)__DQ380188.1__GP

SEQ ID NO: 16067 - RNA, 3594 nt, Artificial Sequence; identical to SEQ ID NO: 14424
  derived and/or modified CDS sequence (opt11) from RVFV(RVFBJ01/2016)__KX785331.1__GP

SEQ ID NO: 16068 - RNA, 3594 nt, Artificial Sequence; identical to SEQ ID NO: 14425
  derived and/or modified CDS sequence (opt11) from RVFV(Lunyo)__KU167026.1__GP

SEQ ID NO: 16069 - RNA, 3594 nt, Artificial Sequence; identical to SEQ ID NO: 14426
  derived and/or modified CDS sequence (opt11) from RVFV(2007000234)__JF326191.1__GP

SEQ ID NO: 16070 - RNA, 3594 nt, Artificial Sequence; identical to SEQ ID NO: 14427
  derived and/or modified CDS sequence (opt11) from RVFV(KEN07-KUR340)__EF460404.1__GP

SEQ ID NO: 16071 - RNA, 3594 nt, Artificial Sequence; identical to SEQ ID NO: 14428
  derived and/or modified CDS sequence (opt11) from RVFV(2373/74)__DQ380194.1__GP

SEQ ID NO: 16072 - RNA, 3594 nt, Artificial Sequence; identical to SEQ ID NO: 14429
  derived and/or modified CDS sequence (opt11) from RVFV(200803169)__JF311384.1__GP

SEQ ID NO: 16073 - RNA, 3594 nt, Artificial Sequence; identical to SEQ ID NO: 14430
  derived and/or modified CDS sequence (opt11) from RVFV(200803167)__JF311382.1__GP

SEQ ID NO: 16074 - RNA, 3594 nt, Artificial Sequence; identical to SEQ ID NO: 14431
  derived and/or modified CDS sequence (opt11) from RVFV(Entebbe)__DQ380191.1__GP

SEQ ID NO: 16075 - RNA, 3594 nt, Artificial Sequence; identical to SEQ ID NO: 14432
  derived and/or modified CDS sequence (opt11) from RVFV(25010-24)__KM210509.1__GP

SEQ ID NO: 16076 - RNA, 3594 nt, Artificial Sequence; identical to SEQ ID NO: 14433
  derived and/or modified CDS sequence (opt11) from RVFV(Kenya 9800523)__DQ380196.1__GP

SEQ ID NO: 16077 - RNA, 3594 nt, Artificial Sequence; identical to SEQ ID NO: 14434
  derived and/or modified CDS sequence (opt11) from RVFV(ANK-6087)__DQ380216.1__GP

SEQ ID NO: 16078 - RNA, 3594 nt, Artificial Sequence; identical to SEQ ID NO: 14435
  derived and/or modified CDS sequence (opt11) from RVFV(SAUDI 200010901)__KU978778.1__GP

SEQ ID NO: 16079 - RNA, 3594 nt, Artificial Sequence; identical to SEQ ID NO: 14436
  derived and/or modified CDS sequence (opt11) from RVFV(35/74)__JF784387.1__GP

SEQ ID NO: 16080 - RNA, 3594 nt, Artificial Sequence; identical to SEQ ID NO: 14437
  derived and/or modified CDS sequence (opt11) from RVFV(KEN/Kil-006/07)__HM586966.1__GP

SEQ ID NO: 16081 - RNA, 3594 nt, Artificial Sequence; identical to SEQ ID NO: 14438
  derived and/or modified CDS sequence (opt11) from RVFV(MgH824)__DQ380210.1__GP

SEQ ID NO: 16082 - RNA, 3594 nt, Artificial Sequence; identical to SEQ ID NO: 14439
  derived and/or modified CDS sequence (opt11) from RVFV(Kenya 57 (Rintoul))__DQ380192.1__GP

SEQ ID NO: 16083 - RNA, 3594 nt, Artificial Sequence; identical to SEQ ID NO: 14440
  derived and/or modified CDS sequence (opt11) from RVFV(SA-75)__DQ380189.1__GP

SEQ ID NO: 16084 - RNA, 3594 nt, Artificial Sequence; identical to SEQ ID NO: 14441
  derived and/or modified CDS sequence (opt11) from RVFV(SA01-1322)__KX096942.1__GP

SEQ ID NO: 16085 - RNA, 3594 nt, Artificial Sequence; identical to SEQ ID NO: 14442
  derived and/or modified CDS sequence (opt11) from RVFV(KEN/Mal-032/07)__HM586967.1__GP

SEQ ID NO: 16086 - RNA, 3594 nt, Artificial Sequence; identical to SEQ ID NO: 14443
  derived and/or modified CDS sequence (opt11) from RVFV(KEN/Gar-008/06)__HM586965.1__GP

SEQ ID NO: 16087 - RNA, 3594 nt, Artificial Sequence; identical to SEQ ID NO: 14444
  derived and/or modified CDS sequence (opt11) from RVFV(Kenya 56 (IB8))__DQ380190.1__GP

SEQ ID NO: 16088 - RNA, 3594 nt, Artificial Sequence; identical to SEQ ID NO: 14445
  derived and/or modified CDS sequence (opt11) from RVFV(KEN/Bar-035/07)__HM586969.1__GP

SEQ ID NO: 16089 - RNA, 3594 nt, Artificial Sequence; identical to SEQ ID NO: 14446
  derived and/or modified CDS sequence (opt11) from RVFV(TAN/Dod-002/07)__HM586971.1__GP

SEQ ID NO: 16090 - RNA, 3594 nt, Artificial Sequence; identical to SEQ ID NO: 14447
  derived and/or modified CDS sequence (opt11) from RVFV(Beijing-01)__KX611606.1__GP

SEQ ID NO: 16091 - RNA, 3594 nt, Artificial Sequence; identical to SEQ ID NO: 14448
  derived and/or modified CDS sequence (opt11) from RVFV(Smithburn)__DQ380193.1__GP

SEQ ID NO: 16092 - RNA, 3594 nt, Artificial Sequence; identical to SEQ ID NO: 14449
  derived and/or modified CDS sequence (opt11) from RVFV(KEN/Bar-032/07)__HM586968.1__GP

SEQ ID NO: 16093 - RNA, 3594 nt, Artificial Sequence; identical to SEQ ID NO: 14450
  derived and/or modified CDS sequence (opt11) from RVFV(KEN/Gar-004/06)__HM586964.1__GP

SEQ ID NO: 16094 - RNA, 3621 nt, Artificial Sequence; identical to SEQ ID NO: 14451
  derived and/or modified CDS sequence (opt11) from RVFV(RVFV)__M11157.1__GP

SEQ ID NO: 16095 - RNA, 3480 nt, Artificial Sequence; identical to SEQ ID NO: 14452
  derived and/or modified CDS sequence (opt11) from RVFV(ZH-548)__DQ380206.1__NSm-Gn-Gc

SEQ ID NO: 16096 - RNA, 3480 nt, Artificial Sequence; identical to SEQ ID NO: 14453
  derived and/or modified CDS sequence (opt11) from RVFV(ZS-6365)__DQ380205.1__NSm-Gn-Gc

SEQ ID NO: 16097 - RNA, 3480 nt, Artificial Sequence; identical to SEQ ID NO: 14454
  derived and/or modified CDS sequence (opt11) from RVFV(MP-12)__DQ380208.1__NSm-Gn-Gc

SEQ ID NO: 16098 - RNA, 3480 nt, Artificial Sequence; identical to SEQ ID NO: 14455
  derived and/or modified CDS sequence (opt11) from RVFV(T1)__DQ380201.1__NSm-Gn-Gc

SEQ ID NO: 16099 - RNA, 3480 nt, Artificial Sequence; identical to SEQ ID NO: 14456
  derived and/or modified CDS sequence (opt11) from RVFV(1853/78)__DQ380220.1__NSm-Gn-Gc

SEQ ID NO: 16100 - RNA, 3480 nt, Artificial Sequence; identical to SEQ ID NO: 14457
  derived and/or modified CDS sequence (opt11) from RVFV(CAR-R1622)__DQ380219.1__NSm-Gn-Gc

SEQ ID NO: 16101 - RNA, 3480 nt, Artificial Sequence; identical to SEQ ID NO: 14458
  derived and/or modified CDS sequence (opt11) from RVFV(2250/74)__DQ380209.1__NSm-Gn-Gc

SEQ ID NO: 16102 - RNA, 3480 nt, Artificial Sequence; identical to SEQ ID NO: 14459
  derived and/or modified CDS sequence (opt11) from RVFV(2007000094)__EU574055.1__NSm-Gn-Gc

SEQ ID NO: 16103 - RNA, 3480 nt, Artificial Sequence; identical to SEQ ID NO: 14460
  derived and/or modified CDS sequence (opt11) from RVFV(ZM-657)__DQ380204.1__NSm-Gn-Gc

SEQ ID NO: 16104 - RNA, 3480 nt, Artificial Sequence; identical to SEQ ID NO: 14461
  derived and/or modified CDS sequence (opt11) from RVFV(ZH-548M12)__M25276.1__NSm-Gn-Gc

SEQ ID NO: 16105 - RNA, 3480 nt, Artificial Sequence; identical to SEQ ID NO: 14462
  derived and/or modified CDS sequence (opt11) from RVFV(ZH-501-777)__DQ380202.1__NSm-Gn-Gc

SEQ ID NO: 16106 - RNA, 3480 nt, Artificial Sequence; identical to SEQ ID NO: 14463
  derived and/or modified CDS sequence (opt11) from RVFV(T-46 (228113))__DQ380199.1__NSm-Gn-Gc

SEQ ID NO: 16107 - RNA, 3480 nt, Artificial Sequence; identical to SEQ ID NO: 14464
  derived and/or modified CDS sequence (opt11) from RVFV(OS-3)__DQ380184.1__NSm-Gn-Gc

SEQ ID NO: 16108 - RNA, 3480 nt, Artificial Sequence; identical to SEQ ID NO: 14465
  derived and/or modified CDS sequence (opt11) from RVFV(Sudan 86-2010)__JQ820489.1__NSm-Gn-Gc

SEQ ID NO: 16109 - RNA, 3480 nt, Artificial Sequence; identical to SEQ ID NO: 14466
  derived and/or modified CDS sequence (opt11) from RVFV(Sudan 28-2010)__JQ820491.1__NSm-Gn-Gc

SEQ ID NO: 16110 - RNA, 3480 nt, Artificial Sequence; identical to SEQ ID NO: 14467
  derived and/or modified CDS sequence (opt11) from RVFV(2007004194)__EU574031.1__NSm-Gn-Gc

SEQ ID NO: 16111 - RNA, 3480 nt, Artificial Sequence; identical to SEQ ID NO: 14468
  derived and/or modified CDS sequence (opt11) from RVFV(73HB1230)__DQ380221.1__NSm-Gn-Gc

SEQ ID NO: 16112 - RNA, 3480 nt, Artificial Sequence; identical to SEQ ID NO: 14469
  derived and/or modified CDS sequence (opt11) from RVFV(1260/78)__DQ380214.1__NSm-Gn-Gc

SEQ ID NO: 16113 - RNA, 3480 nt, Artificial Sequence; identical to SEQ ID NO: 14470
  derived and/or modified CDS sequence (opt11) from RVFV(ZC-3349)__DQ380207.1__NSm-Gn-Gc

SEQ ID NO: 16114 - RNA, 3480 nt, Artificial Sequence; identical to SEQ ID NO: 14471
  derived and/or modified CDS sequence (opt11) from RVFV(Sudan 85-2010)__JQ820488.1__NSm-Gn-Gc

SEQ ID NO: 16115 - RNA, 3480 nt, Artificial Sequence; identical to SEQ ID NO: 14472
  derived and/or modified CDS sequence (opt11) from RVFV(2007000324)__JF326195.1__NSm-Gn-Gc

SEQ ID NO: 16116 - RNA, 3480 nt, Artificial Sequence; identical to SEQ ID NO: 14473
  derived and/or modified CDS sequence (opt11) from RVFV(OS-8)__DQ380185.1__NSm-Gn-Gc

SEQ ID NO: 16117 - RNA, 3480 nt, Artificial Sequence; identical to SEQ ID NO: 14474
  derived and/or modified CDS sequence (opt11) from RVFV(ZINGA J83 R1)__KU978776.1__NSm-Gn-Gc

SEQ ID NO: 16118 - RNA, 3480 nt, Artificial Sequence; identical to SEQ ID NO: 14475
  derived and/or modified CDS sequence (opt11) from RVFV(2007000253)__JF326192.1__NSm-Gn-Gc

SEQ ID NO: 16119 - RNA, 3480 nt, Artificial Sequence; identical to SEQ ID NO: 14476
  derived and/or modified CDS sequence (opt11) from RVFV(MP12)__Z30318.1__NSm-Gn-Gc

SEQ ID NO: 16120 - RNA, 3480 nt, Artificial Sequence; identical to SEQ ID NO: 14477
  derived and/or modified CDS sequence (opt11) from RVFV(BIME-01)__KX609032.1__NSm-Gn-Gc

SEQ ID NO: 16121 - RNA, 3480 nt, Artificial Sequence; identical to SEQ ID NO: 14478
  derived and/or modified CDS sequence (opt11) from RVFV(200803166)__JF311381.1__NSm-Gn-Gc

SEQ ID NO: 16122 - RNA, 3480 nt, Artificial Sequence; identical to SEQ ID NO: 14479
  derived and/or modified CDS sequence (opt11) from RVFV(Kenya 83 (21445))__DQ380198.1__NSm-Gn-Gc

SEQ ID NO: 16123 - RNA, 3480 nt, Artificial Sequence; identical to SEQ ID NO: 14480
  derived and/or modified CDS sequence (opt11) from RVFV(Entebbe)__DQ380191.1__NSm-Gn-Gc

SEQ ID NO: 16124 - RNA, 3480 nt, Artificial Sequence; identical to SEQ ID NO: 14481
  derived and/or modified CDS sequence (opt11) from RVFV(763/70)__DQ380188.1__NSm-Gn-Gc

SEQ ID NO: 16125 - RNA, 3480 nt, Artificial Sequence; identical to SEQ ID NO: 14482
  derived and/or modified CDS sequence (opt11) from RVFV(OS-1)__DQ380186.1__NSm-Gn-Gc

SEQ ID NO: 16126 - RNA, 3480 nt, Artificial Sequence; identical to SEQ ID NO: 14483
  derived and/or modified CDS sequence (opt11) from RVFV(2008/00101)__HE687306.1__NSm-Gn-Gc

SEQ ID NO: 16127 - RNA, 3480 nt, Artificial Sequence; identical to SEQ ID NO: 14484
  derived and/or modified CDS sequence (opt11) from RVFV(200803162)__JF311377.1__NSm-Gn-Gc

SEQ ID NO: 16128 - RNA, 3480 nt, Artificial Sequence; identical to SEQ ID NO: 14485
  derived and/or modified CDS sequence (opt11) from RVFV(2007002060)__EU574039.1__NSm-Gn-Gc

SEQ ID NO: 16129 - RNA, 3480 nt, Artificial Sequence; identical to SEQ ID NO: 14486
  derived and/or modified CDS sequence (opt11) from RVFV(2007002476)__EU574036.1__NSm-Gn-Gc

SEQ ID NO: 16130 - RNA, 3480 nt, Artificial Sequence; identical to SEQ ID NO: 14487
  derived and/or modified CDS sequence (opt11) from RVFV(2269/74)__DQ380222.1__NSm-Gn-Gc

SEQ ID NO: 16131 - RNA, 3480 nt, Artificial Sequence; identical to SEQ ID NO: 14488
  derived and/or modified CDS sequence (opt11) from RVFV(73HB1449)__DQ380211.1__NSm-Gn-Gc

SEQ ID NO: 16132 - RNA, 3480 nt, Artificial Sequence; identical to SEQ ID NO: 14489
  derived and/or modified CDS sequence (opt11) from RVFV(SA-51 (Van Wyck))__DQ380195.1__NSm-Gn-Gc

SEQ ID NO: 16133 - RNA, 3480 nt, Artificial Sequence; identical to SEQ ID NO: 14490
  derived and/or modified CDS sequence (opt11) from RVFV(KEN/Gar-Msq/131B-04/06)__HM586972.1__NSm-Gn-Gc

SEQ ID NO: 16134 - RNA, 3480 nt, Artificial Sequence; identical to SEQ ID NO: 14491
  derived and/or modified CDS sequence (opt11) from RVFV(2007001107)__EU574047.1__NSm-Gn-Gc

SEQ ID NO: 16135 - RNA, 3480 nt, Artificial Sequence; identical to SEQ ID NO: 14492
  derived and/or modified CDS sequence (opt11) from RVFV(ANK-3837)__DQ380215.1__NSm-Gn-Gc

SEQ ID NO: 16136 - RNA, 3480 nt, Artificial Sequence; identical to SEQ ID NO: 14493
  derived and/or modified CDS sequence (opt11) from RVFV(Lunyo)__KU167026.1__NSm-Gn-Gc

SEQ ID NO: 16137 - RNA, 3480 nt, Artificial Sequence; identical to SEQ ID NO: 14494
  derived and/or modified CDS sequence (opt11) from RVFV(RVFBJ01/2016)__KX785331.1__NSm-Gn-Gc

SEQ ID NO: 16138 - RNA, 3480 nt, Artificial Sequence; identical to SEQ ID NO: 14495
  derived and/or modified CDS sequence (opt11) from RVFV(Ken 199800523)__KU978777.1__NSm-Gn-Gc

SEQ ID NO: 16139 - RNA, 3480 nt, Artificial Sequence; identical to SEQ ID NO: 14496
  derived and/or modified CDS sequence (opt11) from RVFV__JQ068143.1__NSm-Gn-Gc

SEQ ID NO: 16140 - RNA, 3480 nt, Artificial Sequence; identical to SEQ ID NO: 14497
  derived and/or modified CDS sequence (opt11) from RVFV(200803169)__JF311384.1__NSm-Gn-Gc

SEQ ID NO: 16141 - RNA, 3480 nt, Artificial Sequence; identical to SEQ ID NO: 14498
  derived and/or modified CDS sequence (opt11) from RVFV(2007002445)__EU574037.1__NSm-Gn-Gc

SEQ ID NO: 16142 - RNA, 3480 nt, Artificial Sequence; identical to SEQ ID NO: 14499
  derived and/or modified CDS sequence (opt11) from RVFV(Hv-B375)__DQ380218.1__NSm-Gn-Gc

SEQ ID NO: 16143 - RNA, 3480 nt, Artificial Sequence; identical to SEQ ID NO: 14500
  derived and/or modified CDS sequence (opt11) from RVFV(clone 13)__DQ380213.1__NSm-Gn-Gc

SEQ ID NO: 16144 - RNA, 3480 nt, Artificial Sequence; identical to SEQ ID NO: 14501
  derived and/or modified CDS sequence (opt11) from RVFV(Kenya 57 (Rintoul))__DQ380192.1__NSm-Gn-Gc

SEQ ID NO: 16145 - RNA, 3480 nt, Artificial Sequence; identical to SEQ ID NO: 14502
  derived and/or modified CDS sequence (opt11) from RVFV(2007001292)__EU574046.1__NSm-Gn-Gc

SEQ ID NO: 16146 - RNA, 3480 nt, Artificial Sequence; identical to SEQ ID NO: 14503
  derived and/or modified CDS sequence (opt11) from RVFV(2007001811)__EU574040.1__NSm-Gn-Gc

SEQ ID NO: 16147 - RNA, 3480 nt, Artificial Sequence; identical to SEQ ID NO: 14504
  derived and/or modified CDS sequence (opt11) from RVFV(ANK-6087)__DQ380216.1__NSm-Gn-Gc

SEQ ID NO: 16148 - RNA, 3480 nt, Artificial Sequence; identical to SEQ ID NO: 14505
  derived and/or modified CDS sequence (opt11) from RVFV(2007000234)__JF326191.1__NSm-Gn-Gc

SEQ ID NO: 16149 - RNA, 3480 nt, Artificial Sequence; identical to SEQ ID NO: 14506
  derived and/or modified CDS sequence (opt11) from RVFV(SA-75)__DQ380189.1__NSm-Gn-Gc

SEQ ID NO: 16150 - RNA, 3480 nt, Artificial Sequence; identical to SEQ ID NO: 14507
  derived and/or modified CDS sequence (opt11) from RVFV(KEN07-KUR340)__EF460404.1__NSm-Gn-Gc

SEQ ID NO: 16151 - RNA, 3480 nt, Artificial Sequence; identical to SEQ ID NO: 14508
  derived and/or modified CDS sequence (opt11) from RVFV(35/74)__JF784387.1__NSm-Gn-Gc

SEQ ID NO: 16152 - RNA, 3480 nt, Artificial Sequence; identical to SEQ ID NO: 14509
  derived and/or modified CDS sequence (opt11) from RVFV(200803167)__JF311382.1__NSm-Gn-Gc

SEQ ID NO: 16153 - RNA, 3480 nt, Artificial Sequence; identical to SEQ ID NO: 14510
  derived and/or modified CDS sequence (opt11) from RVFV(25010-24)__KM210509.1__NSm-Gn-Gc

SEQ ID NO: 16154 - RNA, 3480 nt, Artificial Sequence; identical to SEQ ID NO: 14511
  derived and/or modified CDS sequence (opt11) from RVFV(Sudan 2V-2007)__JQ820490.1__NSm-Gn-Gc

SEQ ID NO: 16155 - RNA, 3480 nt, Artificial Sequence; identical to SEQ ID NO: 14512
  derived and/or modified CDS sequence (opt11) from RVFV(SAUDI 200010901)__KU978778.1__NSm-Gn-Gc

SEQ ID NO: 16156 - RNA, 3480 nt, Artificial Sequence; identical to SEQ ID NO: 14513
  derived and/or modified CDS sequence (opt11) from RVFV(2373/74)__DQ380194.1__NSm-Gn-Gc

SEQ ID NO: 16157 - RNA, 3480 nt, Artificial Sequence; identical to SEQ ID NO: 14514
  derived and/or modified CDS sequence (opt11) from RVFV(KEN/Kil-006/07)__HM586966.1__NSm-Gn-Gc

SEQ ID NO: 16158 - RNA, 3480 nt, Artificial Sequence; identical to SEQ ID NO: 14515
  derived and/or modified CDS sequence (opt11) from RVFV(MgH824)__DQ380210.1__NSm-Gn-Gc

SEQ ID NO: 16159 - RNA, 3480 nt, Artificial Sequence; identical to SEQ ID NO: 14516
  derived and/or modified CDS sequence (opt11) from RVFV(SA01-1322)__KX096942.1__NSm-Gn-Gc

SEQ ID NO: 16160 - RNA, 3480 nt, Artificial Sequence; identical to SEQ ID NO: 14517
  derived and/or modified CDS sequence (opt11) from RVFV(Kenya 56 (IB8))__DQ380190.1__NSm-Gn-Gc

SEQ ID NO: 16161 - RNA, 3480 nt, Artificial Sequence; identical to SEQ ID NO: 14518
  derived and/or modified CDS sequence (opt11) from RVFV(KEN/Mal-032/07)__HM586967.1__NSm-Gn-Gc

SEQ ID NO: 16162 - RNA, 3480 nt, Artificial Sequence; identical to SEQ ID NO: 14519
  derived and/or modified CDS sequence (opt11) from RVFV(KEN/Gar-008/06)__HM586965.1__NSm-Gn-Gc

SEQ ID NO: 16163 - RNA, 3480 nt, Artificial Sequence; identical to SEQ ID NO: 14520
  derived and/or modified CDS sequence (opt11) from RVFV(Beijing-01)__KX611606.1__NSm-Gn-Gc

SEQ ID NO: 16164 - RNA, 3480 nt, Artificial Sequence; identical to SEQ ID NO: 14521
  derived and/or modified CDS sequence (opt11) from RVFV(KEN/Bar-035/07)__HM586969.1__NSm-Gn-Gc

SEQ ID NO: 16165 - RNA, 3480 nt, Artificial Sequence; identical to SEQ ID NO: 14522
  derived and/or modified CDS sequence (opt11) from RVFV(KEN/Bar-032/07)__HM586968.1__NSm-Gn-Gc

SEQ ID NO: 16166 - RNA, 3480 nt, Artificial Sequence; identical to SEQ ID NO: 14523
  derived and/or modified CDS sequence (opt11) from RVFV(TAN/Dod-002/07)__HM586971.1__NSm-Gn-Gc

SEQ ID NO: 16167 - RNA, 3480 nt, Artificial Sequence; identical to SEQ ID NO: 14524
  derived and/or modified CDS sequence (opt11) from RVFV(Smithburn)__DQ380193.1__NSm-Gn-Gc

SEQ ID NO: 16168 - RNA, 3480 nt, Artificial Sequence; identical to SEQ ID NO: 14525
  derived and/or modified CDS sequence (opt11) from RVFV(KEN/Gar-004/06)__HM586964.1__NSm-Gn-Gc

SEQ ID NO: 16169 - RNA, 3204 nt, Artificial Sequence; identical to SEQ ID NO: 14526
  derived and/or modified CDS sequence (opt11) from RVFV(ZH-548)__DQ380206.1__Gn-Gc

SEQ ID NO: 16170 - RNA, 3204 nt, Artificial Sequence; identical to SEQ ID NO: 14527
  derived and/or modified CDS sequence (opt11) from RVFV(2007000094)__EU574055.1__Gn-Gc

SEQ ID NO: 16171 - RNA, 3204 nt, Artificial Sequence; identical to SEQ ID NO: 14528
  derived and/or modified CDS sequence (opt11) from RVFV(ZH-548M12)__M25276.1__Gn-Gc

SEQ ID NO: 16172 - RNA, 3204 nt, Artificial Sequence; identical to SEQ ID NO: 14529
  derived and/or modified CDS sequence (opt11) from RVFV(Sudan 86-2010)__JQ820489.1__Gn-Gc

SEQ ID NO: 16173 - RNA, 3204 nt, Artificial Sequence; identical to SEQ ID NO: 14530
  derived and/or modified CDS sequence (opt11) from RVFV(ZS-6365)__DQ380205.1__Gn-Gc

SEQ ID NO: 16174 - RNA, 3204 nt, Artificial Sequence; identical to SEQ ID NO: 14531
  derived and/or modified CDS sequence (opt11) from RVFV(1853/78)__DQ380220.1__Gn-Gc

SEQ ID NO: 16175 - RNA, 3204 nt, Artificial Sequence; identical to SEQ ID NO: 14532
  derived and/or modified CDS sequence (opt11) from RVFV(T1)__DQ380201.1__Gn-Gc

SEQ ID NO: 16176 - RNA, 3204 nt, Artificial Sequence; identical to SEQ ID NO: 14533
  derived and/or modified CDS sequence (opt11) from RVFV(Kenya 83 (21445))__DQ380198.1__Gn-Gc

SEQ ID NO: 16177 - RNA, 3204 nt, Artificial Sequence; identical to SEQ ID NO: 14534
  derived and/or modified CDS sequence (opt11) from RVFV(Sudan 85-2010)__JQ820488.1__Gn-Gc

SEQ ID NO: 16178 - RNA, 3204 nt, Artificial Sequence; identical to SEQ ID NO: 14535
  derived and/or modified CDS sequence (opt11) from RVFV(2007004194)__EU574031.1__Gn-Gc

SEQ ID NO: 16179 - RNA, 3204 nt, Artificial Sequence; identical to SEQ ID NO: 14536
  derived and/or modified CDS sequence (opt11) from RVFV(2250/74)__DQ380209.1__Gn-Gc

SEQ ID NO: 16180 - RNA, 3204 nt, Artificial Sequence; identical to SEQ ID NO: 14537
  derived and/or modified CDS sequence (opt11) from RVFV(Sudan 28-2010)__JQ820491.1__Gn-Gc

SEQ ID NO: 16181 - RNA, 3204 nt, Artificial Sequence; identical to SEQ ID NO: 14538
  derived and/or modified CDS sequence (opt11) from RVFV(2007000324)__JF326195.1__Gn-Gc

SEQ ID NO: 16182 - RNA, 3204 nt, Artificial Sequence; identical to SEQ ID NO: 14539
  derived and/or modified CDS sequence (opt11) from RVFV(ZM-657)__DQ380204.1__Gn-Gc

SEQ ID NO: 16183 - RNA, 3204 nt, Artificial Sequence; identical to SEQ ID NO: 14540
  derived and/or modified CDS sequence (opt11) from RVFV(T-46 (228113))__DQ380199.1__Gn-Gc

SEQ ID NO: 16184 - RNA, 3204 nt, Artificial Sequence; identical to SEQ ID NO: 14541
  derived and/or modified CDS sequence (opt11) from RVFV(MP12)__Z30318.1__Gn-Gc

SEQ ID NO: 16185 - RNA, 3204 nt, Artificial Sequence; identical to SEQ ID NO: 14542
  derived and/or modified CDS sequence (opt11) from RVFV(200803166)__JF311381.1__Gn-Gc

SEQ ID NO: 16186 - RNA, 3204 nt, Artificial Sequence; identical to SEQ ID NO: 14543
  derived and/or modified CDS sequence (opt11) from RVFV(200803162)__JF311377.1__Gn-Gc

SEQ ID NO: 16187 - RNA, 3204 nt, Artificial Sequence; identical to SEQ ID NO: 14544
  derived and/or modified CDS sequence (opt11) from RVFV(Hv-B375)__DQ380218.1__Gn-Gc

SEQ ID NO: 16188 - RNA, 3204 nt, Artificial Sequence; identical to SEQ ID NO: 14545
  derived and/or modified CDS sequence (opt11) from RVFV(1260/78)__DQ380214.1__Gn-Gc

SEQ ID NO: 16189 - RNA, 3204 nt, Artificial Sequence; identical to SEQ ID NO: 14546
  derived and/or modified CDS sequence (opt11) from RVFV(ZH-501-777)__DQ380202.1__Gn-Gc

SEQ ID NO: 16190 - RNA, 3204 nt, Artificial Sequence; identical to SEQ ID NO: 14547
  derived and/or modified CDS sequence (opt11) from RVFV(OS-3)__DQ380184.1__Gn-Gc

SEQ ID NO: 16191 - RNA, 3204 nt, Artificial Sequence; identical to SEQ ID NO: 14548
  derived and/or modified CDS sequence (opt11) from RVFV(SAUDI 200010901)__KU978778.1__Gn-Gc

SEQ ID NO: 16192 - RNA, 3204 nt, Artificial Sequence; identical to SEQ ID NO: 14549
  derived and/or modified CDS sequence (opt11) from RVFV(2007001811)__EU574040.1__Gn-Gc

SEQ ID NO: 16193 - RNA, 3204 nt, Artificial Sequence; identical to SEQ ID NO: 14550
  derived and/or modified CDS sequence (opt11) from RVFV(2007000253)__JF326192.1__Gn-Gc

SEQ ID NO: 16194 - RNA, 3204 nt, Artificial Sequence; identical to SEQ ID NO: 14551
  derived and/or modified CDS sequence (opt11) from RVFV(2007001292)__EU574046.1__Gn-Gc

SEQ ID NO: 16195 - RNA, 3204 nt, Artificial Sequence; identical to SEQ ID NO: 14552
  derived and/or modified CDS sequence (opt11) from RVFV(2007002476)__EU574036.1__Gn-Gc

SEQ ID NO: 16196 - RNA, 3204 nt, Artificial Sequence; identical to SEQ ID NO: 14553
  derived and/or modified CDS sequence (opt11) from RVFV(73HB1230)__DQ380221.1__Gn-Gc

SEQ ID NO: 16197 - RNA, 3204 nt, Artificial Sequence; identical to SEQ ID NO: 14554
  derived and/or modified CDS sequence (opt11) from RVFV(ZINGA J83 R1)__KU978776.1__Gn-Gc

SEQ ID NO: 16198 - RNA, 3204 nt, Artificial Sequence; identical to SEQ ID NO: 14555
  derived and/or modified CDS sequence (opt11) from RVFV(2008/00101)__HE687306.1__Gn-Gc

SEQ ID NO: 16199 - RNA, 3204 nt, Artificial Sequence; identical to SEQ ID NO: 14556
  derived and/or modified CDS sequence (opt11) from RVFV(2007002445)__EU574037.1__Gn-Gc

SEQ ID NO: 16200 - RNA, 3204 nt, Artificial Sequence; identical to SEQ ID NO: 14557
  derived and/or modified CDS sequence (opt11) from RVFV(ZC-3349)__DQ380207.1__Gn-Gc

SEQ ID NO: 16201 - RNA, 3204 nt, Artificial Sequence; identical to SEQ ID NO: 14558
  derived and/or modified CDS sequence (opt11) from RVFV(Kenya 9800523)__DQ380196.1__Gn-Gc

SEQ ID NO: 16202 - RNA, 3204 nt, Artificial Sequence; identical to SEQ ID NO: 14559
  derived and/or modified CDS sequence (opt11) from RVFV(Entebbe)__DQ380191.1__Gn-Gc

SEQ ID NO: 16203 - RNA, 3204 nt, Artificial Sequence; identical to SEQ ID NO: 14560
  derived and/or modified CDS sequence (opt11) from RVFV(25010-24)__KM210509.1__Gn-Gc

SEQ ID NO: 16204 - RNA, 3204 nt, Artificial Sequence; identical to SEQ ID NO: 14561
  derived and/or modified CDS sequence (opt11) from RVFV(763/70)__DQ380188.1__Gn-Gc

SEQ ID NO: 16205 - RNA, 3204 nt, Artificial Sequence; identical to SEQ ID NO: 14562
  derived and/or modified CDS sequence (opt11) from RVFV(OS-1)__DQ380186.1__Gn-Gc

SEQ ID NO: 16206 - RNA, 3204 nt, Artificial Sequence; identical to SEQ ID NO: 14563
  derived and/or modified CDS sequence (opt11) from RVFV(BIME-01)__KX609032.1__Gn-Gc

SEQ ID NO: 16207 - RNA, 3204 nt, Artificial Sequence; identical to SEQ ID NO: 14564
  derived and/or modified CDS sequence (opt11) from RVFV(73HB1449)__DQ380211.1__Gn-Gc

SEQ ID NO: 16208 - RNA, 3204 nt, Artificial Sequence; identical to SEQ ID NO: 14565
  derived and/or modified CDS sequence (opt11) from RVFV(SA01-1322)__KX096942.1__Gn-Gc

SEQ ID NO: 16209 - RNA, 3204 nt, Artificial Sequence; identical to SEQ ID NO: 14566
  derived and/or modified CDS sequence (opt11) from RVFV(Sudan 2V-2007)__JQ820490.1__Gn-Gc

SEQ ID NO: 16210 - RNA, 3204 nt, Artificial Sequence; identical to SEQ ID NO: 14567
  derived and/or modified CDS sequence (opt11) from RVFV(35/74)__JF784387.1__Gn-Gc

SEQ ID NO: 16211 - RNA, 3204 nt, Artificial Sequence; identical to SEQ ID NO: 14568
  derived and/or modified CDS sequence (opt11) from RVFV(200803169)__JF311384.1__Gn-Gc

SEQ ID NO: 16212 - RNA, 3204 nt, Artificial Sequence; identical to SEQ ID NO: 14569
  derived and/or modified CDS sequence (opt11) from RVFV(2269/74)__DQ380222.1__Gn-Gc

SEQ ID NO: 16213 - RNA, 3204 nt, Artificial Sequence; identical to SEQ ID NO: 14570
  derived and/or modified CDS sequence (opt11) from RVFV(SA-51 (Van Wyck))__DQ380195.1__Gn-Gc

SEQ ID NO: 16214 - RNA, 3204 nt, Artificial Sequence; identical to SEQ ID NO: 14571
  derived and/or modified CDS sequence (opt11) from RVFV(OS-8)__DQ380185.1__Gn-Gc

SEQ ID NO: 16215 - RNA, 3204 nt, Artificial Sequence; identical to SEQ ID NO: 14572
  derived and/or modified CDS sequence (opt11) from RVFV(KEN07-KUR340)__EF460404.1__Gn-Gc

SEQ ID NO: 16216 - RNA, 3204 nt, Artificial Sequence; identical to SEQ ID NO: 14573
  derived and/or modified CDS sequence (opt11) from RVFV(ANK-3837)__DQ380215.1__Gn-Gc

SEQ ID NO: 16217 - RNA, 3204 nt, Artificial Sequence; identical to SEQ ID NO: 14574
  derived and/or modified CDS sequence (opt11) from RVFV(Lunyo)__KU167026.1__Gn-Gc

SEQ ID NO: 16218 - RNA, 3204 nt, Artificial Sequence; identical to SEQ ID NO: 14575
  derived and/or modified CDS sequence (opt11) from RVFV(200803167)__JF311382.1__Gn-Gc

SEQ ID NO: 16219 - RNA, 3204 nt, Artificial Sequence; identical to SEQ ID NO: 14576
  derived and/or modified CDS sequence (opt11) from RVFV(2373/74)__DQ380194.1__Gn-Gc

SEQ ID NO: 16220 - RNA, 3204 nt, Artificial Sequence; identical to SEQ ID NO: 14577
  derived and/or modified CDS sequence (opt11) from RVFV(Kenya 57 (Rintoul))__DQ380192.1__Gn-Gc

SEQ ID NO: 16221 - RNA, 3204 nt, Artificial Sequence; identical to SEQ ID NO: 14578
  derived and/or modified CDS sequence (opt11) from RVFV(RVFBJ01/2016)__KX785331.1__Gn-Gc

SEQ ID NO: 16222 - RNA, 3204 nt, Artificial Sequence; identical to SEQ ID NO: 14579
  derived and/or modified CDS sequence (opt11) from RVFV(clone 13)__DQ380213.1__Gn-Gc

SEQ ID NO: 16223 - RNA, 3204 nt, Artificial Sequence; identical to SEQ ID NO: 14580
  derived and/or modified CDS sequence (opt11) from RVFV__JQ068143.1__Gn-Gc

SEQ ID NO: 16224 - RNA, 3204 nt, Artificial Sequence; identical to SEQ ID NO: 14581
  derived and/or modified CDS sequence (opt11) from RVFV(SA-75)__DQ380189.1__Gn-Gc

SEQ ID NO: 16225 - RNA, 3204 nt, Artificial Sequence; identical to SEQ ID NO: 14582
  derived and/or modified CDS sequence (opt11) from RVFV(ANK-6087)__DQ380216.1__Gn-Gc

SEQ ID NO: 16226 - RNA, 3204 nt, Artificial Sequence; identical to SEQ ID NO: 14583
  derived and/or modified CDS sequence (opt11) from RVFV(KEN/Kil-006/07)__HM586966.1__Gn-Gc

SEQ ID NO: 16227 - RNA, 3204 nt, Artificial Sequence; identical to SEQ ID NO: 14584
  derived and/or modified CDS sequence (opt11) from RVFV(MgH824)__DQ380210.1__Gn-Gc

SEQ ID NO: 16228 - RNA, 3204 nt, Artificial Sequence; identical to SEQ ID NO: 14585
  derived and/or modified CDS sequence (opt11) from RVFV(KEN/Mal-032/07)__HM586967.1__Gn-Gc

SEQ ID NO: 16229 - RNA, 3204 nt, Artificial Sequence; identical to SEQ ID NO: 14586
  derived and/or modified CDS sequence (opt11) from RVFV(Kenya 56 (IB8))__DQ380190.1__Gn-Gc

SEQ ID NO: 16230 - RNA, 3204 nt, Artificial Sequence; identical to SEQ ID NO: 14587
  derived and/or modified CDS sequence (opt11) from RVFV(KEN/Gar-008/06)__HM586965.1__Gn-Gc

SEQ ID NO: 16231 - RNA, 3204 nt, Artificial Sequence; identical to SEQ ID NO: 14588
  derived and/or modified CDS sequence (opt11) from RVFV(KEN/Bar-035/07)__HM586969.1__Gn-Gc

SEQ ID NO: 16232 - RNA, 3204 nt, Artificial Sequence; identical to SEQ ID NO: 14589
  derived and/or modified CDS sequence (opt11) from RVFV(Smithburn)__DQ380193.1__Gn-Gc

SEQ ID NO: 16233 - RNA, 3204 nt, Artificial Sequence; identical to SEQ ID NO: 14590
  derived and/or modified CDS sequence (opt11) from RVFV(Beijing-01)__KX611606.1__Gn-Gc

SEQ ID NO: 16234 - RNA, 3204 nt, Artificial Sequence; identical to SEQ ID NO: 14591
  derived and/or modified CDS sequence (opt11) from RVFV(KEN/Bar-032/07)__HM586968.1__Gn-Gc

SEQ ID NO: 16235 - RNA, 3204 nt, Artificial Sequence; identical to SEQ ID NO: 14592
  derived and/or modified CDS sequence (opt11) from RVFV(TAN/Dod-002/07)__HM586971.1__Gn-Gc

SEQ ID NO: 16236 - RNA, 3204 nt, Artificial Sequence; identical to SEQ ID NO: 14593
  derived and/or modified CDS sequence (opt11) from RVFV(KEN/Gar-004/06)__HM586964.1__Gn-Gc

SEQ ID NO: 16237 - RNA, 1680 nt, Artificial Sequence; identical to SEQ ID NO: 14594
  derived and/or modified CDS sequence (opt11) from RVFV(ZH-548)__DQ380206.1__Gn

SEQ ID NO: 16238 - RNA, 1680 nt, Artificial Sequence; identical to SEQ ID NO: 14595
  derived and/or modified CDS sequence (opt11) from RVFV(MP-12)__DQ380208.1__Gn

SEQ ID NO: 16239 - RNA, 1680 nt, Artificial Sequence; identical to SEQ ID NO: 14596
  derived and/or modified CDS sequence (opt11) from RVFV(MP12)__Z30318.1__Gn

SEQ ID NO: 16240 - RNA, 1680 nt, Artificial Sequence; identical to SEQ ID NO: 14597
  derived and/or modified CDS sequence (opt11) from RVFV(2007001811)__EU574040.1__Gn

SEQ ID NO: 16241 - RNA, 1680 nt, Artificial Sequence; identical to SEQ ID NO: 14598
  derived and/or modified CDS sequence (opt11) from RVFV(2250/74)__DQ380209.1__Gn

SEQ ID NO: 16242 - RNA, 1680 nt, Artificial Sequence; identical to SEQ ID NO: 14599
  derived and/or modified CDS sequence (opt11) from RVFV(T1)__DQ380201.1__Gn

SEQ ID NO: 16243 - RNA, 1680 nt, Artificial Sequence; identical to SEQ ID NO: 14600
  derived and/or modified CDS sequence (opt11) from RVFV(Ken 199800523)__KU978777.1__Gn

SEQ ID NO: 16244 - RNA, 1680 nt, Artificial Sequence; identical to SEQ ID NO: 14601
  derived and/or modified CDS sequence (opt11) from RVFV(1853/78)__DQ380220.1__Gn

SEQ ID NO: 16245 - RNA, 1680 nt, Artificial Sequence; identical to SEQ ID NO: 14602
  derived and/or modified CDS sequence (opt11) from RVFV(73HB1449)__DQ380211.1__Gn

SEQ ID NO: 16246 - RNA, 1680 nt, Artificial Sequence; identical to SEQ ID NO: 14603
  derived and/or modified CDS sequence (opt11) from RVFV(2007000234)__JF326191.1__Gn

SEQ ID NO: 16247 - RNA, 1680 nt, Artificial Sequence; identical to SEQ ID NO: 14604
  derived and/or modified CDS sequence (opt11) from RVFV(73HB1230)__DQ380221.1__Gn

SEQ ID NO: 16248 - RNA, 1680 nt, Artificial Sequence; identical to SEQ ID NO: 14605
  derived and/or modified CDS sequence (opt11) from RVFV(ZM-657)__DQ380204.1__Gn

SEQ ID NO: 16249 - RNA, 1680 nt, Artificial Sequence; identical to SEQ ID NO: 14606
  derived and/or modified CDS sequence (opt11) from RVFV(Kenya 83 (21445))__DQ380198.1__Gn

SEQ ID NO: 16250 - RNA, 1680 nt, Artificial Sequence; identical to SEQ ID NO: 14607
  derived and/or modified CDS sequence (opt11) from RVFV(SAUDI 200010901)__KU978778.1__Gn

SEQ ID NO: 16251 - RNA, 1680 nt, Artificial Sequence; identical to SEQ ID NO: 14608
  derived and/or modified CDS sequence (opt11) from RVFV(2007004194)__EU574031.1__Gn

SEQ ID NO: 16252 - RNA, 1680 nt, Artificial Sequence; identical to SEQ ID NO: 14609
  derived and/or modified CDS sequence (opt11) from RVFV(ZH-501-777)__DQ380202.1__Gn

SEQ ID NO: 16253 - RNA, 1680 nt, Artificial Sequence; identical to SEQ ID NO: 14610
  derived and/or modified CDS sequence (opt11) from RVFV(ZC-3349)__DQ380207.1__Gn

SEQ ID NO: 16254 - RNA, 1680 nt, Artificial Sequence; identical to SEQ ID NO: 14611
  derived and/or modified CDS sequence (opt11) from RVFV(200803166)__JF311381.1__Gn

SEQ ID NO: 16255 - RNA, 1680 nt, Artificial Sequence; identical to SEQ ID NO: 14612
  derived and/or modified CDS sequence (opt11) from RVFV(1260/78)__DQ380214.1__Gn

SEQ ID NO: 16256 - RNA, 1680 nt, Artificial Sequence; identical to SEQ ID NO: 14613
  derived and/or modified CDS sequence (opt11) from RVFV(T-46 (228113))__DQ380199.1__Gn

SEQ ID NO: 16257 - RNA, 1680 nt, Artificial Sequence; identical to SEQ ID NO: 14614
  derived and/or modified CDS sequence (opt11) from RVFV(ZINGA J83 R1)__KU978776.1__Gn

SEQ ID NO: 16258 - RNA, 1680 nt, Artificial Sequence; identical to SEQ ID NO: 14615
  derived and/or modified CDS sequence (opt11) from RVFV(clone 13)__DQ380213.1__Gn

SEQ ID NO: 16259 - RNA, 1680 nt, Artificial Sequence; identical to SEQ ID NO: 14616
  derived and/or modified CDS sequence (opt11) from RVFV(SA01-1322)__KX096942.1__Gn

SEQ ID NO: 16260 - RNA, 1680 nt, Artificial Sequence; identical to SEQ ID NO: 14617
  derived and/or modified CDS sequence (opt11) from RVFV(25010-24)__KM210509.1__Gn

SEQ ID NO: 16261 - RNA, 1680 nt, Artificial Sequence; identical to SEQ ID NO: 14618
  derived and/or modified CDS sequence (opt11) from RVFV(200803162)__JF311377.1__Gn

SEQ ID NO: 16262 - RNA, 1680 nt, Artificial Sequence; identical to SEQ ID NO: 14619
  derived and/or modified CDS sequence (opt11) from RVFV(2007002476)__EU574036.1__Gn

SEQ ID NO: 16263 - RNA, 1680 nt, Artificial Sequence; identical to SEQ ID NO: 14620
  derived and/or modified CDS sequence (opt11) from RVFV(Hv-B375)__DQ380218.1__Gn

SEQ ID NO: 16264 - RNA, 1680 nt, Artificial Sequence; identical to SEQ ID NO: 14621
  derived and/or modified CDS sequence (opt11) from RVFV(OS-1)__DQ380186.1__Gn

SEQ ID NO: 16265 - RNA, 1680 nt, Artificial Sequence; identical to SEQ ID NO: 14622
  derived and/or modified CDS sequence (opt11) from RVFV(2373/74)__DQ380194.1__Gn

SEQ ID NO: 16266 - RNA, 1680 nt, Artificial Sequence; identical to SEQ ID NO: 14623
  derived and/or modified CDS sequence (opt11) from RVFV(Kenya 57 (Rintoul))__DQ380192.1__Gn

SEQ ID NO: 16267 - RNA, 1680 nt, Artificial Sequence; identical to SEQ ID NO: 14624
  derived and/or modified CDS sequence (opt11) from RVFV(Sudan 2V-2007)__JQ820490.1__Gn

SEQ ID NO: 16268 - RNA, 1680 nt, Artificial Sequence; identical to SEQ ID NO: 14625
  derived and/or modified CDS sequence (opt11) from RVFV(200803167)__JF311382.1__Gn

SEQ ID NO: 16269 - RNA, 1680 nt, Artificial Sequence; identical to SEQ ID NO: 14626
  derived and/or modified CDS sequence (opt11) from RVFV(KEN/Gar-008/06)__HM586965.1__Gn

SEQ ID NO: 16270 - RNA, 1680 nt, Artificial Sequence; identical to SEQ ID NO: 14627
  derived and/or modified CDS sequence (opt11) from RVFV(ANK-6087)__DQ380216.1__Gn

SEQ ID NO: 16271 - RNA, 1680 nt, Artificial Sequence; identical to SEQ ID NO: 14628
  derived and/or modified CDS sequence (opt11) from RVFV(763/70)__DQ380188.1__Gn

SEQ ID NO: 16272 - RNA, 1680 nt, Artificial Sequence; identical to SEQ ID NO: 14629
  derived and/or modified CDS sequence (opt11) from RVFV(BIME-01)__KX609032.1__Gn

SEQ ID NO: 16273 - RNA, 1680 nt, Artificial Sequence; identical to SEQ ID NO: 14630
  derived and/or modified CDS sequence (opt11) from RVFV(KEN07-KUR340)__EF460404.1__Gn

SEQ ID NO: 16274 - RNA, 1680 nt, Artificial Sequence; identical to SEQ ID NO: 14631
  derived and/or modified CDS sequence (opt11) from RVFV(SA-51 (Van Wyck))__DQ380195.1__Gn

SEQ ID NO: 16275 - RNA, 1680 nt, Artificial Sequence; identical to SEQ ID NO: 14632
  derived and/or modified CDS sequence (opt11) from RVFV(Lunyo)__KU167026.1__Gn

SEQ ID NO: 16276 - RNA, 1680 nt, Artificial Sequence; identical to SEQ ID NO: 14633
  derived and/or modified CDS sequence (opt11) from RVFV(2269/74)__DQ380222.1__Gn

SEQ ID NO: 16277 - RNA, 1680 nt, Artificial Sequence; identical to SEQ ID NO: 14634
  derived and/or modified CDS sequence (opt11) from RVFV(MgH824)__DQ380210.1__Gn

SEQ ID NO: 16278 - RNA, 1680 nt, Artificial Sequence; identical to SEQ ID NO: 14635
  derived and/or modified CDS sequence (opt11) from RVFV__JQ068143.1__Gn

SEQ ID NO: 16279 - RNA, 1680 nt, Artificial Sequence; identical to SEQ ID NO: 14636
  derived and/or modified CDS sequence (opt11) from RVFV(RVFBJ01/2016)__KX785331.1__Gn

SEQ ID NO: 16280 - RNA, 1680 nt, Artificial Sequence; identical to SEQ ID NO: 14637
  derived and/or modified CDS sequence (opt11) from RVFV(KEN/Kil-006/07)__HM586966.1__Gn

SEQ ID NO: 16281 - RNA, 1680 nt, Artificial Sequence; identical to SEQ ID NO: 14638
  derived and/or modified CDS sequence (opt11) from RVFV(SA-75)__DQ380189.1__Gn

SEQ ID NO: 16282 - RNA, 1680 nt, Artificial Sequence; identical to SEQ ID NO: 14639
  derived and/or modified CDS sequence (opt11) from RVFV(35/74)__JF784387.1__Gn

SEQ ID NO: 16283 - RNA, 1680 nt, Artificial Sequence; identical to SEQ ID NO: 14640
  derived and/or modified CDS sequence (opt11) from RVFV__M11157.1__Gn

SEQ ID NO: 16284 - RNA, 1680 nt, Artificial Sequence; identical to SEQ ID NO: 14641
  derived and/or modified CDS sequence (opt11) from RVFV(KEN/Bar-035/07)__HM586969.1__Gn

SEQ ID NO: 16285 - RNA, 1680 nt, Artificial Sequence; identical to SEQ ID NO: 14642
  derived and/or modified CDS sequence (opt11) from RVFV(Kenya 56 (IB8))__DQ380190.1__Gn

SEQ ID NO: 16286 - RNA, 1680 nt, Artificial Sequence; identical to SEQ ID NO: 14643
  derived and/or modified CDS sequence (opt11) from RVFV(KEN/Bar-032/07)__HM586968.1__Gn

SEQ ID NO: 16287 - RNA, 1680 nt, Artificial Sequence; identical to SEQ ID NO: 14644
  derived and/or modified CDS sequence (opt11) from RVFV(Beijing-01)__KX611606.1__Gn

SEQ ID NO: 16288 - RNA, 1680 nt, Artificial Sequence; identical to SEQ ID NO: 14645
  derived and/or modified CDS sequence (opt11) from RVFV(Smithburn)__DQ380193.1__Gn

SEQ ID NO: 16289 - RNA, 1680 nt, Artificial Sequence; identical to SEQ ID NO: 14646
  derived and/or modified CDS sequence (opt11) from RVFV(TAN/Dod-002/07)__HM586971.1__Gn

SEQ ID NO: 16290 - RNA, 1680 nt, Artificial Sequence; identical to SEQ ID NO: 14647
  derived and/or modified CDS sequence (opt11) from RVFV(KEN/Gar-004/06)__HM586964.1__Gn

SEQ ID NO: 16291 - RNA, 1521 nt, Artificial Sequence; identical to SEQ ID NO: 14648
  derived and/or modified CDS sequence (opt11) from RVFV(ZH-548)__DQ380206.1__Gc

SEQ ID NO: 16292 - RNA, 1521 nt, Artificial Sequence; identical to SEQ ID NO: 14649
  derived and/or modified CDS sequence (opt11) from RVFV(35/74)__JF784387.1__Gc

SEQ ID NO: 16293 - RNA, 1521 nt, Artificial Sequence; identical to SEQ ID NO: 14650
  derived and/or modified CDS sequence (opt11) from RVFV(200803162)__JF311377.1__Gc

SEQ ID NO: 16294 - RNA, 1521 nt, Artificial Sequence; identical to SEQ ID NO: 14651
  derived and/or modified CDS sequence (opt11) from RVFV(200803166)__JF311381.1__Gc

SEQ ID NO: 16295 - RNA, 1521 nt, Artificial Sequence; identical to SEQ ID NO: 14652
  derived and/or modified CDS sequence (opt11) from RVFV(SA-51 (Van Wyck))__DQ380195.1__Gc

SEQ ID NO: 16296 - RNA, 1521 nt, Artificial Sequence; identical to SEQ ID NO: 14653
  derived and/or modified CDS sequence (opt11) from RVFV(ZINGA J83 R1)__KU978776.1__Gc

SEQ ID NO: 16297 - RNA, 1521 nt, Artificial Sequence; identical to SEQ ID NO: 14654
  derived and/or modified CDS sequence (opt11) from RVFV(Entebbe)__DQ380191.1__Gc

SEQ ID NO: 16298 - RNA, 1521 nt, Artificial Sequence; identical to SEQ ID NO: 14655
  derived and/or modified CDS sequence (opt11) from RVFV(Sudan 2V-2007)__JQ820490.1__Gc

SEQ ID NO: 16299 - RNA, 1521 nt, Artificial Sequence; identical to SEQ ID NO: 14656
  derived and/or modified CDS sequence (opt11) from RVFV(Sudan 86-2010)__JQ820489.1__Gc

SEQ ID NO: 16300 - RNA, 1521 nt, Artificial Sequence; identical to SEQ ID NO: 14657
  derived and/or modified CDS sequence (opt11) from RVFV(Kenya 56 (IB8))__DQ380190.1__Gc

SEQ ID NO: 16301 - RNA, 1521 nt, Artificial Sequence; identical to SEQ ID NO: 14658
  derived and/or modified CDS sequence (opt11) from RVFV(ARD-38388)__DQ380187.1__Gc

SEQ ID NO: 16302 - RNA, 1521 nt, Artificial Sequence; identical to SEQ ID NO: 14659
  derived and/or modified CDS sequence (opt11) from RVFV(Sudan 28-2010)__JQ820491.1__Gc

SEQ ID NO: 16303 - RNA, 1521 nt, Artificial Sequence; identical to SEQ ID NO: 14660
  derived and/or modified CDS sequence (opt11) from RVFV(200803167)__JF311382.1__Gc

SEQ ID NO: 16304 - RNA, 1521 nt, Artificial Sequence; identical to SEQ ID NO: 14661
  derived and/or modified CDS sequence (opt11) from RVFV(73HB1230)__DQ380221.1__Gc

SEQ ID NO: 16305 - RNA, 1521 nt, Artificial Sequence; identical to SEQ ID NO: 14662
  derived and/or modified CDS sequence (opt11) from RVFV(2250/74)__DQ380209.1__Gc

SEQ ID NO: 16306 - RNA, 1521 nt, Artificial Sequence; identical to SEQ ID NO: 14663
  derived and/or modified CDS sequence (opt11) from RVFV(SAUDI 200010901)__KU978778.1__Gc

SEQ ID NO: 16307 - RNA, 1521 nt, Artificial Sequence; identical to SEQ ID NO: 14664
  derived and/or modified CDS sequence (opt11) from RVFV(Lunyo)__KU167026.1__Gc

SEQ ID NO: 16308 - RNA, 1521 nt, Artificial Sequence; identical to SEQ ID NO: 14665
  derived and/or modified CDS sequence (opt11) from RVFV(25010-24)__KM210509.1__Gc

SEQ ID NO: 16309 - RNA, 1521 nt, Artificial Sequence; identical to SEQ ID NO: 14666
  derived and/or modified CDS sequence (opt11) from RVFV(2007000253)__JF326192.1__Gc

SEQ ID NO: 16310 - RNA, 1521 nt, Artificial Sequence; identical to SEQ ID NO: 14667
  derived and/or modified CDS sequence (opt11) from RVFV(ZC-3349)__DQ380207.1__Gc

SEQ ID NO: 16311 - RNA, 1521 nt, Artificial Sequence; identical to SEQ ID NO: 14668
  derived and/or modified CDS sequence (opt11) from RVFV(OS-1)__DQ380186.1__Gc

SEQ ID NO: 16312 - RNA, 1521 nt, Artificial Sequence; identical to SEQ ID NO: 14669
  derived and/or modified CDS sequence (opt11) from RVFV(KEN/Gar-004/06)__HM586964.1__Gc

SEQ ID NO: 16313 - RNA, 1521 nt, Artificial Sequence; identical to SEQ ID NO: 14670
  derived and/or modified CDS sequence (opt11) from RVFV(Smithburn)__DQ380193.1__Gc

SEQ ID NO: 16314 - RNA, 1521 nt, Artificial Sequence; identical to SEQ ID NO: 14671
  derived and/or modified CDS sequence (opt11) from RVFV(2008/00101)__HE687306.1__Gc

SEQ ID NO: 16315 - RNA, 1521 nt, Artificial Sequence; identical to SEQ ID NO: 14672
  derived and/or modified CDS sequence (opt11) from RVFV(2007001292)__EU574046.1__Gc

SEQ ID NO: 16316 - RNA, 1521 nt, Artificial Sequence; identical to SEQ ID NO: 14673
  derived and/or modified CDS sequence (opt11) from RVFV(2007002445)__EU574037.1__Gc

SEQ ID NO: 16317 - RNA, 1521 nt, Artificial Sequence; identical to SEQ ID NO: 14674
  derived and/or modified CDS sequence (opt11) from RVFV(Ken 199800523)__KU978777.1__Gc

SEQ ID NO: 16318 - RNA, 1521 nt, Artificial Sequence; identical to SEQ ID NO: 14675
  derived and/or modified CDS sequence (opt11) from RVFV(clone 13)__DQ380213.1__Gc

SEQ ID NO: 16319 - RNA, 1521 nt, Artificial Sequence; identical to SEQ ID NO: 14676
  derived and/or modified CDS sequence (opt11) from RVFV(2373/74)__DQ380194.1__Gc

SEQ ID NO: 16320 - RNA, 1521 nt, Artificial Sequence; identical to SEQ ID NO: 14677
  derived and/or modified CDS sequence (opt11) from RVFV(OS-8)__DQ380185.1__Gc

SEQ ID NO: 16321 - RNA, 1521 nt, Artificial Sequence; identical to SEQ ID NO: 14678
  derived and/or modified CDS sequence (opt11) from RVFV(KEN/Bar-035/07)__HM586969.1__Gc

SEQ ID NO: 16322 - RNA, 1521 nt, Artificial Sequence; identical to SEQ ID NO: 14679
  derived and/or modified CDS sequence (opt11) from RVFV(MgH824)__DQ380210.1__Gc

SEQ ID NO: 16323 - RNA, 1521 nt, Artificial Sequence; identical to SEQ ID NO: 14680
  derived and/or modified CDS sequence (opt11) from RVFV(200803169)__JF311384.1__Gc

SEQ ID NO: 16324 - RNA, 1521 nt, Artificial Sequence; identical to SEQ ID NO: 14681
  derived and/or modified CDS sequence (opt11) from RVFV(2007001811)__EU574040.1__Gc

SEQ ID NO: 16325 - RNA, 1521 nt, Artificial Sequence; identical to SEQ ID NO: 14682
  derived and/or modified CDS sequence (opt11) from RVFV(Kenya 57 (Rintoul))__DQ380192.1__Gc

SEQ ID NO: 16326 - RNA, 1521 nt, Artificial Sequence; identical to SEQ ID NO: 14683
  derived and/or modified CDS sequence (opt11) from RVFV(Beijing-01)__KX611606.1__Gc

SEQ ID NO: 16327 - RNA, 1521 nt, Artificial Sequence; identical to SEQ ID NO: 14684
  derived and/or modified CDS sequence (opt11) from RVFV(ANK-6087)__DQ380216.1__Gc

SEQ ID NO: 16328 - RNA, 1521 nt, Artificial Sequence; identical to SEQ ID NO: 14685
  derived and/or modified CDS sequence (opt11) from RVFV(MP12)__Z30318.1__Gc

SEQ ID NO: 16329 - RNA, 1521 nt, Artificial Sequence; identical to SEQ ID NO: 14686
  derived and/or modified CDS sequence (opt11) from RVFV(KEN/Bar-032/07)__HM586968.1__Gc

SEQ ID NO: 16330 - RNA, 4020 nt, Artificial Sequence
  derived and/or modified CDS sequence (opt11) from SFNV(Toscana)__NC_006320.1__GP
auguucaucgccaaguugcuccugaucagcugccuggugcaacaagccuaccucaaguacaccaucauuuccgagauuggcaaugggacccgcacgagcuucuguuacuccucacggaccucccugggcagccugcucgaggcuugggacaacaucaccgagucaaucggacugaccaguggcacgugcaaggucgggucccuggagaaccgcgacugcaagcgggauaucaugagcaacuacguggccgaggugcacuccaaccuccauggacuuggcgcaaugaugcacaacuacggggacgacaagcgcgucgaggugcugaacgacguuauucccgacgagcucaacccgggacggcacaacugcagcgaccuagaccggaagcccuucuggaccgaguuuaucaacguagccaagccugccaauaagaucgcgcccaucuccgugaucccgccgcccaucgugaagccaaucccgaucgccgagagcacuaucaagaagaccauccccuucgacaagcugcucuccgaagccgagaaggagcugaaccagaccaagauccgguuggagaccgagcgccgguccaacgccgaggaggcagcccgggagcgggcccggaugagggagaucgaggauaagcucagaaagaacugggagcuggagcgggagcgcaaggacgccgucgccgacgaccuggccaaggagauugcccggcgccgugaaaucgagcgcaaggcccacgagcucgauaagaugcugaagaagaaggagcgggaggaccagguggccaucgagcgcguguccgaggauaugcggaaccacgucaggcgccccaacaccaccaucgcccccgcgccgaccaucauaaccaccuuacucauggccagcgccgugauggccggcccccucgagaaccgcgagaccaaccacuuacugaaccgccccggcaacggggccuauacucugucagacuucgcggagagcacgugcacccuggccuacggcagcaagugcaagucuugggaacaccagcucgaugaacugagcuucccguucuuccacuccaaccuggacaaguacagcaugcucgaagccgccacugagaccaucccgauucugaacaaauccagcgccguaugcaccaucucccccagcacccacucaagcaacgcgugugggcgggaggcuucccugaucaagaaaaagugcgggaacaacaugagcgccuuuuucuacgucaaccucgcuggccaaaucacaguagugaagugcgauacgaaccacguccugaguaacgacugcgggaacugcaucagcaagacccuguccggccagaagaucuacaccccagugcaggacauguucugccagcgcggcuggaccgagagcauccccuccacgagauacucuaaggaccucugcuccaucgggcugcacaccgugaaggagugcaagaccggcaccacuaacuucgagcgcgucggguuuaucguggucaagagccggaagauguacaucgagcagaugaagaugcgcucucgccaggaguucucugaggaccaguuccugugcuacaagagcgagagcagcaguggcagcuccgugaagcucaagaaggugaagguugagagcuguaagggugugaccaccaguucggcguccaagugcucgggcgacgaguacuucugcucccgcuacccgugcgagaccgcaaacguggaggcgcauugcauccugcgacgccacagcgccgucaucgaggugaacgucaacggcgucuggguggugccccggugcaucggguacgaggagguccucgugcgccggacgucccucaaaauggaggacaccucuucgcgcgagugcgauacgugccugugggagugcgggaagaacaagcugaucgugaagacccacgggcccaagaucguauacgccacagcgugcagccauggcagcugcaagagugugaugcagaagcccgccaccuucguguaccucccguacccugggaacagcgagaucgucggaggcgauaucggaguucacaugaccgaggagucaagccccuccaacauccacaugguagcccauugccccgccaaagacagcugcgaagucuccagcugccucuucugcgugcacggccugcugaacuaccagugccacacccucuucuccgcccugcugaucagcaccaccgucaugucuauccucaccuugcugcuccugcuaguaaagggggcgaaagaucucguaaagaagcuguucuacuggcugaucaccccgcucugcuggcugucgguguucugcggcuggaugaucaagagcuggaagaagaaggucgggagcgccaucucccggacaaacgacacgaucggcuggcgcgacaaucgccgguacggccgcgacguggaaagagcucaguacaccgggggcgcccccggcgccaaguacagcuucuacggcgugaugauccugggacuccuggggaacguccacucuuguagcgaguccgugaucgcggacagcaaggugaugcagugcacgaccucuggcuccagcacgcugugcaaggccuccggcaccgucaucaugaaacucggccccaucgggucagaauccugccugauccugaagggccucaaggacaacgagaagcaguuuaucagcaucaagaccauaaguagcgagcugaccugccgggagggcgaguccuucuggacgacccuguacacgccggugugccucucaucccggcgcugccaccugaugggggaguguugcagcgaccggugccuuaaauggaagaccaacgagacauccgcggaguucaccggcaaggcccacggggaggugaugcacgaaaaccgcuguuucgagcaaagcggcggaaucggcuacggcuguuucaacgucaaccccucaugucucuacgugcacagcauccugaaguccguauacaagaacgguuucaagaucuuccggugcgucgcguggaaccacagaauccggcuggaagugaccacccacagccgcaaguuccccauggugcucauggcaauguccacgcagcccaccgacugggguagcaucggguuaauccuggacagcgaaggcaucaccgggaccaacgccuacagcuucaugaagcacggcagcggaucccuagccaucaucgacgacccguacagccccgagcccagaaaaggguuccuaggagagguccggugccccacggaggagaccgccauucgggcgucccccagcugcaagauggcccccaaucugauugaguaccagcccgagauggacaccgcggagugcaccacgaacaugaucgaccccauggccaucuucaaccgcgggucucucccacagguacgggacggcaugaccuucacccagagcaucgagaagaacacagugcaggcccugacuaccggggaaguccgcgcguccauccggcugacguuagacgacuacgacgucguguaccacaacagccaguccgacugcagcgccaccuucaaaaacuuaacgggcugcuacucaugcgacgagggcagccgcaugugcuaucaggucaaggccgagggggagacgaucuuccacuucgugaacgaggacgaguccaucaacguaaucaacaagguaagccccgacguguccgacuacugcaccgugcugcacuucagccggcccgucaucagcaucgagggccgcuacgacugcgggcucagcaagagccccauggugauaaagggcaccuugaucgccaccgccccgcacgacgaccgcaagcacgagggcggguccagccugguugugaaccccaagggugguacgguggauuucuucggcugggucuccggguuaaccagcuggcugggcggcccccucaagaccuuccucaccauccugggguuccucgcgcuagggcugcugcucguggugaucaucaucacgaucgcccggaccggggucgagcaggcucugaagaagaagaacaaguga

SEQ ID NO: 16331 - RNA, 3972 nt, Artificial Sequence
  derived and/or modified CDS sequence (opt11) from SFNV__HM566171.1__GP
augcugaacaccaagagcaucaucuugaucacgugccuggugcagcagguccaccugaaguacacgaucaucuccgaggugacaaagggcgcccgcgaggugagcugcuacuccagcaccacccggcucgaucagcugcuggaggccugggagaacaaguccgcgcucauggggcugcgcaagggcaacugcaagcugggggccauggagcaagucgacugcaaccucgaccugaugagcaacuacguguccaacguguacgacaacccccacggccugggggccaugauguacaacgacaagcggaucgagguccucaacgaccagaucccggacagcaugauccccggcggccacaacugcucuuugcuggagcgcaagcccuucugggccgaccucauccccaguaagaaggagaacccgcggcccucccugaucucauuagugccaacgccacgcuccgacuucaagcggaaguucgaggaggccgaggaggagaugaagaagauccgcaaggagcuccaggacgagcggcaggcgcagcugagcgugaucgaggaggggcgcaagcggaugcgcgaccuggaggacaagcucaugcggcaguggaacgaggagaagcagaagaagggccugcuggaggagacccucgagaagaagcgccaacugaagaacaaggcccugcucgacgcccacaaccuggacaagcaguugaaggagaaggaccgggaguucaagaccgccauggaggaacaccagaacgagcgccaccggaucaacuccaacaugaucaggccgcccaucaccacgcccgcggccgucauccuaaccagccugcuguccgccagcgugguguuaggguucgagcuggagaaccggaacaccaaucacgcccugaaccgccccggcaacgggggcuacuccaucagcgacaauaaccucaucgaggccaagugcaugaucaccuacggcaacaagugcccgagcugggagaugcagcuggaccccgucuccuaccccuucuucagcuccaacuucgagaaguacagccugcucgagagcaucagcgagacgucccccaucaucgggaaauucagcgaggugugcgugcuguccaaccugccgggcgcgcagaagaccugcgccaaggaggccagccucaucaagaagcagugcuccgacgacaugcgggccuacuucuacaucaacagccuggggaagcuggcuaucgugacuugccccgagaacaacguccugucccaggacugcaacuuuugccugcgcaaggcgaagggcgagcaguacguguacaagcccauccaggacggcuucugccagaacggaggcgucagcuccgugcccagcauccgcuacuccaaggacaucugcagcauagggccgacaaaggugaagaauugccacaagggcacgucccgguacgagcgcaccgccuucaucagcaccggggacaagaaggucuaccuggaggagaucaagauccggagccgccaggaguacgagcccgaccaguuccucugcuacaaggugaaggacuccagcuccagcccccuggccuacgagaaggugcaggucuccaagugcaagggaaucgagaccaacagccccaagaagugcacgggcgacgaguacuucugcuccaaguaccccugcgagagcaccucccccgaggccaacugcuuccugcggaagcacagcgccauccuggaggugaacaucgggggcauguggaucaagcccaaguguaucggguacgagauggcgcucgucaagcgcgugggcuugcgguccgaggacgugagcuccaaggagugcgcaaccugccugugggagugcaguuccggguacaucagcaucaccacgcacggccccaagaucuccuaugccaccgccugcagucacggcagcugcaaguccaucguccagaacccgagcaccuccauccgcaucagcuaccccgggaacuccgagaucgugggcggggacaucggcauccaccucaccgaggacagcagucccaucaaccugcaucugaagauccacugcagcccgaaggacuccugcgaggugagcgacugcaucuucugcguccacgggcuucugaacuaccagugccacuccguggccucugcccugcuccuguccacgaucaccgccagccugaucgugcucaugaucuacaugcugagcaagaccaaguucgucaugaagaagcugauccccaucaugcucacgccccugugcuggugcuucguguugcucgccuggcugaccaagagcuggaagggcaagaugcggaacgccauccaguccgcgaacagcaccaucggcuggaccgagcgcgaggagcggaucguggccgagcgcccccggucccgcaacacuguccgguacagcuucuacgggguggugauccuggccaugcucgagagcgccuucggcugcuccgaaagccugaucgccgaguccaaggucaugcagugcaacaucgcgaacgggaagaccagcugccgcgccuccggcaccaucaucaugaagcugggcccgaucgggagcgaggccugccuaauccugaagggccugcgggacuccgacaagcaguacauaagcguuaagaccgaguccagcgagcuaaucugcagagagggggaguccuucuggaccagccuguacacccccgugugccuguccagccggcgcugccacuuaaugggcgaaugcacgggggaccugugccugaaguggaaguccaacaagaccagccucgaguucgccggcaagacccgcuccgacgucaucaacgagaacaagugcuuugagcagagcggcgggcugggcuacgggugcuucaacgugaaccccuccugccuguauacccacgccuaccucaagagcguauaccggaacggcuuccgcgucuucaagugcgcuagcuggacgcaccgggugaagcugaccaucaccacccacucccgcacguuccccaugacccuggccgccaugagcacccagccgaccgacuggggguccaucggccucauccuggacagcgagggcaucuccgggaccaacagcuucuccuucaugaagcacggccuggggagcuucgcuaucaucgacgagcccuacuccauggagccccggaaaggcuucaucggggaggugagaugccccaccgaggaggccgcgaucaaggccagcacccucugcaagaccgccccgcagcugaucgaguaccagcccgagauggacuccgccgagugcacgacgaacaugaucgacccgaugagcgucuucaaucggggcucccugccccaggugcgcgagggcaugaccuucacccagagcauggagaaaaauacggugcaggcgaugaccaccggggagguccacgccuccauccggaucgugcucgacgacuacgagguggaguaccugagcucccaggucgacugcgacgccaccuucaagaaccugacgggcugcuacagcugcgacgagggggcccgcgugugcaugcagaucaucgcccacggcgacaccaucuuccacuuccgaaacccggacguguccauaaacauccuccagaaggucaauacaaacacccugaucuacugcagcguggugcacuucagcaagcccgugaucaaggaggaggguacguacgacugcggugcgggcgagaagcccaugauccugaaggggacccucguugccgugagcccccacaacgaccgccuggagcagggcggguccuccaucgucaucaacccgaagggcggcgggguggacuuccuggguuggcucagcggguucuccagcugguucggcgggccccugaaggccauccugauggugaucggcuuccuccugcugggccucauccuguucgucaccaucgccaucgggcugaaguucgcccuccgccagaugaucgugaagcgcaugaaguga

SEQ ID NO: 16332 - RNA, 3873 nt, Artificial Sequence
  derived and/or modified CDS sequence (opt11) from SFNV(Namru)__HM566169.1__GP
auguuccagaucaucuaccugcucaccaagcuguaccuggugagcuccauguacagcaucauguucugggagaacgagaacaucuccaagcucugccugagcaacaacagcccccuggagggccucgucuacuacugggagaacgugaugaaggagggggacuucaaggaggagaagcgcaagaagugccggaucggcccgagcgaccugaagcgcguaaccaaccagacgcugaccacccucaucgaggagguccagaagucccccagcgagauccagcugcugugcgaggaggacgggaacaagaccggcaucuccauguucuucgacgggcucagcgacgauaucuccacacccagcaucguugacugcaacggcaacauccggaucucagaccugcgcgugcaagucggccgggggcacuucgagaaggagaacgagauccgcaagaucgaggagaucgugacccuggaggacgaccuccggcgcgagcgggaccugaacaaacugcuccaggaccugaauaagaaggacgccgaggaacgccggaucaucgagcacgagcugaccaacaugcgcgagcagcuccagcgggagcgcgagcggagcaagcagcagaucaaggagcacgagaagaucgaggugaacaaccacaaagagcccgccacccaccugaacgucuccaagcugcucacgaucggccugcuggcgcagcaggucggccaggugauagccaccgagccggggcagcucaacaccuggauccacgccaagaaccgcaucgggaagggccuguacaagacugaggacacggacgaggacggcugucggggguuggacuacggcgugucuugccucggguucgacuaccugcugcgcaccgacaucuaccccuucuucaacuccuucgugagccaccucuccaugcuggaggccaguacugaggaccugauugagaaggagggcaccagcugcgagaucgagacgaacaaggaguucaagugcuaugaggagcgggccuucaucaagggcuccugcccccaccucgugaacagcgcgcacuuccuggacaacaaggggaaacuucgcaucgucaagugcaagaccgacuucgagaugaccgaggacugcaccuucugccggaagaucaagaagaagaacucccagcacaagcaggucuucaagacgagcaucgcccuccaggacgccgucugccagaacaacuccgaccuguacaacggcccccgcauuguguacagcaacgugugcaagaucgggaugguguccuacaagcaguguaagagcaagacguccagcuacgaguccgucggcuucgugauucugaaggggaagggcaaauucuacaucgagaacaugaagaucaagaacaucgaggugaucgccaacgucagcuucaucugccaccaguaccagggccaggacgggaccgagaaggagcagcgcucccucaagcggaucucggugggcgagugcaaguccgucaacccgcagaagaccaagcacuguacgggggaccacgucuucugcgaaaaguacgacugcaccaagagcuaccccgaggugaccugccugauggcgcccggcuccgggcccauccugguccagaucaugggcagcuggaucaagccgcagugcgugggcuacgagaaggugcucgucgagcgcgaggugaagucccccacccugacggaggagcgggacugcgacacgugcguuuacgagugccuggaggacaagauccucaucaagagcaccggguucaagaugaucagcgccgucgccugcucccacggcaugugcgucagcucccaccaggagcccucaaccuuccuguacaucaacuacccagggauguccgccagcauuggcggagagaucggccuacaccuuucccacaccgacgacagccucucccugcacaaggugaucucgugcccgucccgcaaccccugcgacguccacagcugcaucaucugcuaccacggcaucaucaacuaucagugccacaccgcccuguccuacaccaucguggcguucagcuucaucucuuuccucuaccugacguucaaggugaucagccagcugcucuacacguucaaggucgugcccaagaaacugaaggggcccuucuacuggaugggcuaccugaucaaguggaucgucaagaccauccucggggucgugcggaacaccuucuucaccauguccaaccgcaucggcugggagcggcgcgacgagauccacgaggacaucgaggccaacccucggcgccaucuccagcgguucaagaccacguucgugcugaccaugcugaugaucaacggcgggcugugcugcaguaacacccuggucagcaacuccaagcagacccgcugcgugcagucuggcaacgaggugaagugcuccgucagcgccacgguggugcucaaggccggcgucauaggcgccgaguccugcuucaucaucaaggggcccagcgagaaccagcacaagaugaucuccgugcggacccugagcuccgagaccgugugccgcgagggcgcgagcuucuggaccggccacuucucccccagcugcguuuccagccggcgcugccaccuggugggcgagugccacggcaaccggugccaguccuggcgcgacgaccagaucagccgggaguucgggggcgugaaggacaacaaccgcauguccgagaacaagugcuucgaacagugcgggagcaucggaugcgggugcuucaacaugaaccccuccugccucuacguccacacgacccugaaguccgcccgcaacgaggccgugcggguguucaagugcaacgacuggauccaccgccugaacuucgaggucaucgggccgagcggcgaaaaggacguggugacccucaacuccaugagcaccaaguuccugcagugggggacgaucucccugagccucgacgccgagggcaucaccgggaccaacuccuacagcuuccuggaguccagcaagggcggcuucgcaauccacgacgaggaguucuccgacaucccccgggagggguaccugggggagauccgcugcagcuccgagagcgcggucaucuccgcccacagcuccugcauucgggcccccgaccucaucaaguacaagcccaugaccgaccagaucgagugcacgagcacccugaucgacccguucgccaucuucaugaaggggucccugccccaaacccgcagcggcuacaccuucacguccagcaaggacaagaagaccauccaggccuucaacaccaacaguaucaaggcgcucaucucccugaaucuggacgaccacgagaucguguucgugagcgaccagaccaauugcgaguguacguuccucaaccugaccggguguuacuccugcgacuacggcgcacacgucugcuuccggaucaagagcgacaagaagggcguguucguguccaacaccgaggccaaagacaucagcuucggguucgaaguacugaccggcacgcacgacuacugccagauccagcacuucaacucccccagcguguacaagacccucuccuacagcugcgggggcgaguccaagcugcuggugaucaagggcagccucaucaccaucgggccccacgacuaccgcaacaagacgggcggggccuccacggucgugaaccccagcgaagagggcugguccgugaccaacuggaucgggggcuucaucagcuggcugggcgggccccugaaggcgcuccugaagauugccgucaccauccuggccgggguggucaucuuccucaucaucuacuucuucuugcggcugaucgccaccaacauccucaugaagacgaagaagaacuga

SEQ ID NO: 16333 - RNA, 3990 nt, Artificial Sequence; identical to SEQ ID NO: 13047
  derived and/or modified CDS sequence (opt11) from SFNV/SFNV-like(Poona)__HM566177.1__GP

SEQ ID NO: 16334 - RNA, 4002 nt, Artificial Sequence; identical to SEQ ID NO: 13048
  derived and/or modified CDS sequence (opt11) from Arrabida virus(PoSFPhlebV/126/2008)__KP863800.1__GP

SEQ ID NO: 16335 - RNA, 4005 nt, Artificial Sequence
  derived and/or modified CDS sequence (opt11) from Massilia virus(127)__KT906100.1__GP
auguucuacgccaaauucgucauuuccuuaugccuggagcccggauucucccucaaauauaccaucauaaguaaauccggcagcgggacaauccgacaaauaugucuaagucacagcaccgacauagacaaagucuuggaacuuuccuccggagaaaugaacacuauagggaucuuaggugggcugugcacguucggcgaacuaaaaagggaagauugcuccccagacguauucucgaacuacguggcaaauauguacggaaccgcgcaccccucgagcuguaaguuuguggacauaacgggagaccguucaauagagguccucaacgacgccguacccgacucauuuacgccaggcgcacacaacugcuccucauucgaaaagaagccguucuggacggaucucauaccagcgaaaaacucaucgggagcaauacccuccguagucucagugcuccccagcgucgcagagcacgacuucaaccugaaagucaaggaagcaaaugacaaacuagagguaauccagcgcgaacucgcugcagaaaaagcgcgcucaggcagacuggaggacgaagccagagcgaagaugaaagcccuagaagacgaacuacgcaacggcuggcuagcagagagagaggcaaaagaacuagccaaaagcgcccuggagaaagagcggaucaauaaacucgaaguggaacggaaacuccacgaccucggcaagaaacugagacaauccgaagacgacgucgagaaaaugcgcguccaccacaagaaaggacgcaaagaaucggacgaagaaaugaaaaucgccagaacgacagcccccagcgucucaacaacucuggccacgguagucuucacaucccuccucgccacuggcuuagcagcuaucgaaccgaucgaagaccgaaacgucaaccacauuuuaaaccgaccaggaagcgguguauauauggccagcccaacauuaacgcagaacgaaugcagccucgacuacggcaaagaaugcaaagcgugggagcugcaggucagcccccuacacuacccauucuucacaagcaacguagauaaauacaccuuccuagaaagcaucacacuacucccaccuauccugcucauaaacaacgaauuuugcgagcuuaccacuucaucaggcccccucaaacagugccaaaaagaaaguucccucaucaagaaaugcugcacggaagacgccagagccuacuuuuucauagaccuggaagggaaacuguccauaguacacugcucaaacaaccaaguacucucugaagacugcaacuuuugugucacaaaaucuggaggcgucucgcacaaaauauuuaugcccauacaagacgcauucugccagaaaggaggaagcgaauccauaccaguaguccgcuacagcaaagacaucugcagcaucggacucucaaaggucaaaucaugccacaaaagcaccagccgguacgagcgaaugggauuuaucgucgcaggcaaaaagaaacuauacauagaggaccuaaaaaugagauacagacaagaguacgacgaagaucaauucuucugcuacaaagucaacaaaaccagcccacuagaauacggcaaggagaguccgagcaaaugcaaaggcgucggcuccaaugagcaaaaaugcaacggugaugaguacuuuugcaaccgauaccccugcgagacgaauagcccagaagcccacuguagccuccgccgccacgccgcugucguagagguauacgucggaggggcauggauuaaacccaaaugcgugggcuacgaaaaaguccuagugaaaaggggcgggcugaagaccgaagaccugagcguccgagaaugcacaaguugccucugggaaugcgagaaaaacaagaucguuaucaagacacacgggccaaaaaucguaagcgcgacagccugcgguggcagaucauggaaaagcgucaugcaaaaacccuccacauuccuagaccuacccuauccgggcaacuccgaaaucaucggcggagaccggggcaaccaccuaagcgaaaggggcuccccguacaacauccacagcacgauacacucgccuccugaggacucacgagacgccucagacugcaucuacugccgacacggacuccucaacuaccaaucgcacuccgucgaaucagccauccuacuaagcaccguaguagccaccauacuagcacuaacgggcgucgugcuuuccagauccaaauccgcgguaagauuucuggccuccgccguagccgucccauucagaugggucagccuccuaguggucugggucaugaaaaaguggaaagcuagagucgcuacagccauucgagcgaccaacaacgcaaucggaugggacaacggacucgaacaagcccgggucgagaacgcggcacgacgccaacagacggccggccguuggcgcucacucgacgccaguacaauacucagcguccugucaacaggacucugcugcacagaaucccuuauagcugagaguuccauaaugcagugcacaaccggcgagggcucgacgacuugcaaagccaccgguacugucguccuaaaacuaggcccaaucggcuccgaaagcugccuaauccucaaaggacuacgagacaaugagcgccaauucauauccauaaaaacaaucaguagcgaguuaaccuguagagaaggcgagucauucuggacaccccuuuacacuccaguguguuuauccucccgccguugccaccucaugggagagugcaccggcgacaugugccuaaaauggaaaucaaauaagacaaguuccgaguucacuggaaaaacucacucagaggugauccacgaaaacaaguguuucgagcaaucaggcggaaucggcuacauguguuucaacgucaacccauccugcuugaugguacauuccuaccucaaaccaauuuacaaaaacgcauucaaggucuuccgaugcaucgccuggaaccaccgaguacgguuaggcaucacaacgcacaagcggaaauucgagguaacccucauggcgaugucuacgcagcaagcugacuggggaucgaucggacuaauccucgacucagaaggcauaaguggaacuaacuccuacucauucaugaaacacggucucggcaguuacgccaucauagaugaacccuacaguguagaacccagaaagggcuaccuuggagaaguacgaugccccacggaggaaacggcaaucaaggccuccccuucuugcaaaguugcaccagggcucgucgaauaccaacccgaaauggacacucuagaaugcaccaccaacaugauggacccaauggcaauauuuaaccgaggcucacuuccccaaguacggggaggauggacauucucccaaagcaucgagaaaaacucacgccaagcccugaacacgggugcaaucaacgccucgguaagacauguucuugaugaauaugaguucgacuacaaagucaagaccaacgacugcgauuccaccuucgucaacaucaccggauguuacucaugcgacgaaggcgcccggcucugcgucaaaguucgcacuucaucggaggcaauauaccacuucaccgacagcggauacaacaucaacguguuauucaaaguagaaagcgggguacacgaucacuguacaauauuacacuuuuccaagccaguaauauccaucgagggcaaguaugauugcgggaaaaacaagaaacccaugcuaauaaaaggaacccugaucgccauggcaccccacgacgaucggguggucagugguggcagcucgacaguaguaaaccccaaaggccaaggcguagacuuccucggauggcucucacgucucucuucaugguucggggguggaccacucaaaacguuccuuaugguaaccggguuccucaugacaggugucauaggaggcauaguaaccaucauacucauacgcauaguccuccagcaggcacucgcgaagaaagucaaguag

SEQ ID NO: 16336 - RNA, 4005 nt, Artificial Sequence
  derived and/or modified CDS sequence (opt11) from Massilia virus(130)__KT906101.1__GP
auguucuacgccaaguucgugaucagccugugccucgagcccggcuucucccugaaguacacaaucaucagcaaguccgggagcggcaccauccgccagaucugccugucccacagcacggacaucgacaaggugcucgaguugucccgcggggagauggauaccauaagcauccugggcggucucugcaccuucggcgagcugaagcgggaggacugcucccccgacguguucagcaacuacguggccaacauguacggcaccacgcaccccuccagcugcaaguucgucgacaucaucggagaccggucaaucgaggugcugaacgacgcggugcccgacucauucacccccggcgcccacaacugcuccagcuucgagaagaagccuuucuggacagaccucauccccgccaagaacuccagcggggccauccccuccgucgugagcgugcugcccagcgucgccgagcacgacuuuaacuuaaaggugaaggaggcgaacgagaagcucgaggugauccagcgcgagcuggccgcugagaaggcccggagcggccgccuggaggacgaggcccgugcaaagaugaaggcccucgaggacgagcugcgcaacggguggcuggcggagcgggaggccaaagaacucgcaaaaagcgcgcuggagaaagagcguaucaacaagcuggaggucgagcggaagcuccacgaccugggcaagaagcugcgccaauccgaggacgacguagagaagaugcggguacaccacaagaagcgccguaaggagagcgacgaggagaugaagaucgccaagaccacggccccguccguuagcaccacccucgccaccgugguguucacgucccugcuggcgacaggccucgcggccaucgagccgaucgaggaccgcaacgucaaccauauccugaaccggcccgggagcggcguguacauggccucccccaccuuaacccagaacgaaugcagcuuagacuacgggaaggagugcaaggccugggagcuccagguguccccgcugcacuaccccuuuuucacgagcaacgucgacaaguacuccauccuggagagcaucacacaguccagccccauucugcugaagaacaacaacuccugcgagcucacuaccagcccuggcacgcagaagcaaugccagaaggagaguagcaccaucaagaaguauugcaccgacgaugcgcgcgcauacuuuuucaucgaccuggagggcaaacugagcauugugcacugcacgaacaacuacauccuauccgaagacuguaacuuuugcgugucaaagcugggugagguaggucauaagaucuucaugccgauccaggacgccuucugccagaagggcggguccgagucgauccccaucgugcgguacuccaaggacaucugcagcauagggcuguucaaaaucaagaacugccacaaguccacgagccgcuacgagcggaugggcuucaucgucgccggcaaaaagaagcucuacaucgaggagcugaagaugcgcuaccgccaggaguacgacgaggaccaguucuucugcuacaaggugaagaagaccagcccccuggaguacgccaaggugagcccaucgaagugcaagggcgucggcagcaacgagcagaagugcaauggggacgaguacuucugcaaccgguacccuugcgagacaaacucccccgaggcgcacugcagccuccgccggcacgccgcagugguggaggucuacgugggcggugccuggaucaagcccaagugcgugggcuacgagaagguccugguaaagcgcggcggguugaaaaccgaggaccucuccgugagggagugcacgagcugccugugggagugcgagaagaacaagauagucauuaaaacccacggccccaagaucguguccgcuaccgccugcgggcacggcagcugcaagagcgugaugcagaagccguccaccuuccuggaccugccuuaccccgggaacagcgagaucaucggcggcgaccgcgguaaccaccucagcgagagggggagccccuacaacauccacuccacgauccacugcccgcccgaagacagccgcgacgccuccgacugcauauacugccggcacgggcuucuuaauuaccagagccacuccgucgccagcgccauccuccuguccaccgugguugcgacaauccuggcccucacuggggucgugcugagccgcuccaagagcgccgugcgguuccuggccuccgccgucgcggugcccuuccgcugggugucccuccuggucgugugggugaugaagaaguggaaggcccgggucacgacugccauccgcgccacuaacaacgccaucgguugggacaacgggcuggagcagguccggguggagaacgccgcccgccggcagcagccggccgugcguuggcggucccucgacgccagcaccauccuguccauccugggcaccggguuaugcugcacggagagccugaucgcggagagcuccaucaugcagugcaccaccgaagagggcagcaccacgugcaaggccaccgguaccguggugcugaagcucggccccaucggcuccgagagcugccugauccugaaggggcuccgcgacaacgagaagcaguucaucuccaucaaaaccaucagcucagagcugacgugccgggagggcgagagcuucuggaccucccuguacacccccguuugccucucgucccggcgcugccacuugaugggggagugcaccggcgacaucugccugaaauggaagucuaacaagacguccucugaguucacugggaagacccacuccgaggugauccacgagaacaagugcuucgagcagagcggcggcaucggguacaugugcuucaacgugaaccccuccugccucaugguccacagcuaccugaagcccaucuacaagaacgccuucaagguguuccggugcaucgccuggaaccaccgcgugcgacugggcaucaccacgcacaagcgcaaguucgagaucacccucauggccauguccacccagcagaccgacugggggagcaucggccugauccuggauagcgagggggucgcggguacgaacgcauacuccuucaugaagcacggccucgggagcuuugccaucaucgacgagcccuacuccguggagccccggaagggcuaccugggggaagugaagggccccagagaggagacggcgaucaaggccagcccguccugccaggucgcgcccgggcugguggaguaucagccugugauggacaccguagagugcaccacgaacaugauggacccccucgccaucuucaaccggggcagccugccccaggugcgcggcggguggaccuucucccagucaaucgaaaagaacucccuacaggcccucaauacaggcgccauccaugccagcgugaggcacguccuggacgaguacgaguucgaguauaaggugaaguccaacgacugcgacagcaccuucgugaacaucacgggguguuauucuugcgacgagggcgcacgccucugcgucaaggugcggaccagcuccgaggccaucuaccacuucaccgacagcggcuacaacauuaacguccucuucaagguggacuccggggugcacgaccacugcaccauccugcacuucagcaagccggucaucuccaucgagggcaaguacgacugcgggaagaacaagaagcccaugcugaucaagggcacgcucaucgccauggcgccccacgacgaccgcgucguuagcgggggcagcuccaccguagugaacccgaagggccaggggguggacuuccuggguuggcugagcgggcucuccaguugguucggcgggggcccccugaagaccuuccugauggucaccggcuuccucaugacgggggugaucaguggcaucgugaccaucauccugauccggauuguccugcagcaggcgcucgccaagaaggugaaguga

SEQ ID NO: 16337 - RNA, 3999 nt, Artificial Sequence
  derived and/or modified CDS sequence (opt11) from Massilia virus(W)__EU725772.1__GP
auguucuacgccaaguuugugaucauccugugccucguccagggcuucagccuaaaguacaccaucauuuccaagagcgggagcggcaccauccgccagauaugccuaagccacuccacggacaucgacaaggugcucgagcugagcuccggggagauggacaccauuaacauccagggcggacugugcaccuucggcgaacucaaacgagaagacugcagccccgacguguuuuccaacuacauugcgaacauguacggcaccacgcacccgucauccugccgcuuccuggacaucaucggggaccggagcaucgaggugaugaacgacgcgucccccgacagcuucacccccggcgcccacaacuguuccagcuucgagaaggcucccuucugguccgaccugauuccggccaagaacgggagcggccccucccccagcgugguuucgguccucccauccgccaccgaaagcgacuucucccugaaggugaagaaggcgaacgagaggcuggaggugauccagagggagcucgccgccgagaaggcccgcagcgggcgccuggaggacgaggcgcgcacaaagaugcgggcacuggaggacgagcucaggaacggcuggcuggccgagcgggaggccaaggagcuggcuaaauccgaccuugagaaggagcgcgucaacaagcuggagguggagcggaagcugcacgaccucaacaagaagcugcgucagagcgaggacgaggcggagaggcuccgcgaguaccacaacaagcggcgcaaggaauccgacgagaaaaugaaaaugacgaagaccguggccccgaacgucucgaccacccucgccacgguggugcugaccucccugcucgccaccggccuggccgcaaucgaacccauagaggaccggaacaccaaccacauccugaaccgccccgggacgggcgucuacauggccagccccacccucaccgagaacgacugcucccuggacuacgggaaggagugcaaggccugggagcuccaggugagcccgcuucacuaccccuucuucaccuccaacguggacaaguacagccugcuggaguccaucacgcaggccagccccauccucauuaagaacaacaacuccugcgagcugaccaccucacccggcucccaaaagcagugccagaaggagagcagcaccaucaagaaguacuguacggaugacgcccgggcauacuucuucgucgaccuggagggcaaccucaguaucgugcacugcagcaacaacaacauccuguccgaggacugcaacuucugcaucagcaaguccggggugacuggccagaaaaucuucaugccgauccaggacgccuucugccagcgugggggcagugagucccugcccgucauccgcuauagcaaagacaucugcuccaucgggcuguucaagauaaaaagcugccacaaguccaccucucgguacgagcgcaugggauucaucguggugggccggaaaaagcuguaccuggaggagcucaagaugcgcuaccggcaggaguacgacgaagaucaguucuacugcuacaaggccaagaccacgucccagcugcaguaccagaaggucagccccuccaagugcaagggggugggcagcaaggaccagaagugcaacggggacgaguacuucugcaaccgcuuccccugcgagaccaacaacccggacgcccacuguucccugcggcgccacgccgcggucguggaagugaacgucggcggggccugggugaagcccaagugcgugggcuacgagaagguacucgugaaacggggcgggcugaagaccgaggaccuuagcguccgcgagugcaccucgugccugugggagugcgagaagaacaagaucgucaucaaaacgcacggccccaagaucguguccgcaacugcgugcagccacggguccugcaagagcgugaugcagaagccguccacauuccucgaccugccguaccccggcaacagcgagaucauagggggcgacaucggcauccacaugucagagcgggggagccccuccaacauacacaucaccauccacugcccgccgaaggacagcugcgacgucuccgacugcaucuucugccgccacggcauccugaacuaccagugccacagcguggcgucugcgauccucuugagcacgguggucgccaccauccuggcccucaccggggucaucaucucccggagcaaauucgccgugcgcuuccuggcguccgccgucgccauccccuuccggugggugagccugcucguggucugggugaugaagaaguggaagucccgcaucgccaccgccauccgagcgaccaacaacgccaucggcugggacaacggccuggagcagguccgcguugagaacgccgcccggcgcccccagccggccgugcgcuaugcauuuuaugccacgacaauccugucuauccucggaagcggccugugcugcaccgagucccugaucgccgagagcuccaucaugcagugcaccacggaggacucauccacgaccugcaaggccaccgggaccguggugcucaagcuggggcccaucgggagcgaguccugccugauacucaagggccugcgggacaacgagaagcaguucaucagcaucaagaccaucuccucagaacugaccugccgcgagggcgaguccuucuggaccagccuuuacacgcccgugugccuguccucgcggcgcugccaucugaugggugagugcaccggcgacauuugccucaaguggaaguccaacaagaccagcuccgaguucaccggcaaggcgcacagcgaggugauccacgagaacaaguguuucgagcaguccggcggaaucggcuauggcugcuuuaacguuaaccccagcugcuugauggugcauagcuaccugaagccgaucuacaagaacgcuuuccggguguuccgcugcaucgccuggaaccaccggguccgccucggggugacgacccacaagcggaaguucgagaucacccugauggccauguccacccagcaaacggacuggggcucgaucgggcugauucuugacuccgagggcaucgaggggaccaaugccuacagcuucaugaagcacggacugggcuccuucgcuaucguggacgagcccuacucggucgagccccgcaagggguaucugggcgaagugcggugccccaccgaggagaccgccaucaaggccuccccgagcugcaagguggcccccgggcucaucgaguaccagcccgagauggacaccgucgagugcaccaccaacaugauggaccccauggcgaucuucaaccgcggcucccugccccagguacgagaggggaagaccuucacgcagagcaucgaaaagaacuccgugcaggcgcuaaccaccggcgagauccaugcuagcguccgccucgugcuggaugaauacgaaaucgaguacaaggugaccuccaacgauugugauagcacguucgucaacaucaccggcuguuacuccugcgacgagggggcccggcugugcgugaaggucaagagcuccagcgaggccauauaccacuucaccgacuccuccuucagcguuaacguccucuucaaggugacaccauccgugcacgacuacugcacgauauugcacuucagccgccccgugaucuccaucgagggcaaguacgacugcgggaagaauaagaagcccaugcugaucaagggcacccucauugccauggcgccgcacgacgaccgggucaucaacggcggaagcuccaccguggugaacccgaagggccacgggguugacuuccugggcuggcuguccgggcucuccucaugguucgggggcccccugaagacuuuccugauggugaugggguuccucaugaucggcgugaucaucgucaucgugaccaucauccugauccgaaucgggcugcaacaggcccucgccaaaaaguucaaauga

SEQ ID NO: 16338 - RNA, 3996 nt, Artificial Sequence
  derived and/or modified CDS sequence (opt11) from Punique virus(PI-B4-2008)__JF920134.1__GP
auguucuacgccaaguucgugaucauccugugccucguccagggcuucagcuugaaguauaccaucaucucuaagcuggggucagguaccacgcgccaggugugccucucccacagcacagaccuggacaaggugcuggagaucuccaacauggaaauggacgccaucaaccuccucgggggcuucugcacccugggggagcugcggcgcgaggacuguagccccaacgucuucuccaacuauguggugaacguucauggcaccauccacagcuccaacugcaaguucguggacaucgugggcgaccggagcaucgagguccuaaacgacgcaacgccggacucuuucaccccgggggcccacaacugcagcuccuucgagaagccgcccuucuggaccgaccuggugcccaagaagaacgacaccgaccccuccccauccuuacugagcguguuacccgccgcggccgagcucgacuucaaccugaagcugaaagaggcgaacgacaaggucgaagccauccagcgcgagcucguagccgagaaggcccgguccggccgcaucgaggacgaggcucggacgaagaugcgcgagcuggaggacgagcugcggcgcggguggaucgccgagcgggaggccaaggagcucgcccacaagaaccuggaggaggagcgcgugagcaagcuggagaucgagcggcgcaugcacgaccucgacaagaagcugcggcaguccgagaacgacgccgaccgccugcgggagcaguacaacaagaagcgcaagagcgaggaggaagucaagacaccgaaggcgagcacccucaacgccaccacgacgcuggccaccguggugcugaccucccuccuggccacgggccuggccgcgaucgagcagaucgaggagcggaacaccaaccacauccucaaccgccccgggaccggcgucuacauggccagccccacccugacucagaccgagugcagucugggcuacgggaaggagugcaagagcugggagcuccaggugagcccccugcauuacccguucuuuaccagcaacguggacaaguacucgauccuggagagcaucacccaggaacccacgcuccugaucaagaacaacaacuccugcgagcugaccaccagucccggcucccagaagcagugccagaaggagagcuccaccaucaagaaguacugcacggacgacgcccgggccuacuucuucaucgaccucgggggcaaccugagcaucguccacugcuccaacaacuucguguugagcgaggacugcaacuucugcauuuccaagagcggcggggugggccagaaaaucuucaugcccauccaggacgccuucugccagcgagggggcuccgagucgccgccugucgugcgcuacagcaaggaccucuguuccaucggguuauuuaagaucaagucuugucacaaguccaccagccgguacgagcgcaugggcuucaucgucgcgggccagaagaagcuguaccucgaggagcugaagaugcgguaccgccaggaguacgacgaggaccaguucuucugcuacaaggugaaguccaacagcccccugcaguacgagaaggugucccccagcaagugcaagggggucggcucccaggaccaaaagugcaacggggacgaguacuucugcaaccgguacccgugcgacaccaacaaccccgacgcccacugcagccugcgccggcacgccgccguaguggaggucaacgugggcgggguguggaucaagcccaagugcgucggcuacgagaaggugcucgugaagcgcggcgggcugaagaccgaggaccuguccguucgggagugcacgagcugccucugggaaugcgagcgcaacaaggugguggucaagacccacggccccaagaucguguccgccaccgcgugcagccacggguccugcaagagcgugaugcagaagccguccacuuuccuggagauacccuaccccggcaacagcgagaucaucgggggcgacaucggcauccacaugagcgagcgggggucccccucuaacauccacgucguggugcacugcaagccgaaggacucaugcgacaucagcgacugcaucuucugcaagcacggcauccugaacuaccagugccacuccgucgccagcgccgugcuccuguccacgaugaucgccgcgugccuggcccucguggggguuaucgugagccgcuccaagcacgccgugaaguuccuggcuagcgucguggccauccccuucaaguggguguccuugcucaccgucuggguggugaagaacuggaagcugcggaucacccgcgucauccgggccaccaacgacgccaucggcugggagaacaaccuggagcagguccgcguggagaacgccgcgcggcgcccccagccggccgugcgguacgcguucuacggcaccacgauccucagcauccuguccaccgggcugugcugcagcgagucccucaucgccgagagcuccaucaugcagugcaccaccgaggacagcuccacggugugcaaggccaccggcaccgugguccucaagcuggggcccaucgguagcgagagcugccucauccugaaggggcugcgcgacaacgagaagcaguucaucuccaucaagaccaucagcuccgagcucacgugccgcgagggcgagagcuucuggaccucccuguacacccccgugugccugagcucccgccggugccaccucaugggcgagugcaccggggacaucugccugaaguggaagacgaacaagaccagcgccgaguucaccggcaagacccacuccgaggugauccacgagaacaagugcuucgagcagagcgggggcaugggguacggcugcuucaacgucaaccccuccugccugauggugcacagcuaccucaagccgaucuacaaaaacgccuucaagguguuccggugcgucgcguggaaccaccgcgugcggcugggcaucacgacccacaaacgcaacuucgagaucacccugauggccauguccacccagcagacggacugggggagcaucggccucauccuggacuccgaggggaucaccggcaccaacagcuacuccuucaugaagcacgggcugggcagcuucgccaucaucgacgagcccuacgugaccgagccccggaaggguuaccucggggagguccgcuguccuacggaggagaccgccgugaaggcguccccgagcugcaagguggcccccggccugaucgaguaccagcccgagauggacgucguggagugcaccacaaacaugauggaccccauggccaucuucaaccgggggagccugccgcagguccgcgacggcaagacguuuacccaguccaucgagaaguccucagugcaagcccucaccaccggggagauccacgccagcgugcggcugguccuggacgaguacgagguggaguacaagguggucaacaaugacugcgacuccacguucgugaacaucaccggcugcuacagcugcgacgagggcgcgcgccucugcgugaagguaaaggccuccagcgacgugaucuaccacuucaccgacuccgacaacagcaugaacguccuguucaaggucuccagcaacauccaggacuacugcaucgugcugcacuucuccaagcccguggucaacguggaggggaaguacgacugcggucggagcaagaagcccaugcucauaaaggggacccugaucgcgauggcaccccacgacgaccgcgugacgaacggcggcuccagcaucaucaucaacccgaagggcggcggggucgacuuccugggguggcucuccgggcugagcuccugguucgguggcccccugaaaaccuuccuuaucaucgcuggguuucugaucgugggcaucaucaucgugaucaucaucaucauccuggcccggcucgggauacagcaggcccuggccaagaaguugaaguga

SEQ ID NO: 16339 - RNA, 4020 nt, Artificial Sequence
  derived and/or modified CDS sequence (opt11) from TOSV(9028)__KU904264.1__GP
auguuuaucgccaagcugcuucugauuucuugccuggugcagcaggcguaccucaaguacaccaucaucuccgagaucggcaacgggacucgcacgagcuucugcuacuccagccggaccucucuggguagccugcucgaggcgugggauaacgugaccgaguccaucgggcugaccagcgggacgugcaagguggggucccuugagaaccgcgacugccggaaggacaucaugucuaacuacguggccgagguccacuccgaccuccacggacuaggcgccaugaugcacaacuacggagaugacaagcgcguggagauacugaacgacgugauccccgacgagcucaacccaggccaccacaacugcagcgaccuggaccggaaacccuucuggaccgaauuuaucaacgucgccaagccccugagugaaaucgugcccaugagcgugauaccgccgccaguugugaagcuccagccgcccgccgagcccuccucaaagaagcaugugcccuucgacguccuacuguccgaggcagagaaggagcucaaccagaccaagauccgccuggaggacgaacgcaagagcaacgccgaggagaccgccaaggagcgggcacggaugaaagaaauugaggacgagcugcgccgagagugggagcucgagcgcaagcggaaggacgcgauggccgacgaccuggcuaaggagacggcccgccggcgagaaaucgagcggaaggcucacgagcuggacaagaugcucaagaagaaggagcgcgagucccuaaucgcaaaagagaaggccgacgaggacaugcggagccacguccauaaacccaacaccacgcgcgcccccgcccccaccaucaucaccacccugcucauggccucagcggcgcuggccgggccccuggagaaccgggaaacgaaccaucucuuaaaccgccccggcaacggggccuacacccuguccgacuucgccgagagcacgugcacccucgcguauggcuccgagugcaagagcugggagcaucuccucaacgaagaacuguuuccguucuuccacuccaaccuggacaaguacagcaugcuggaggccgccaccgagacagugcccauccucaacaaguccagcgccgucugcacgaucucucccagcacccauuccagcaacgccugcggccgcgaggcguccgugauccggaagaaaugcuacucuaacauguccgcuuucuucuacaucaaccuggcugggcagaucaccgugauaaaaugugagacgaaccacguccugagcuccgacuguggcaauugcaucucgaagucccucagcggccagaaaguuuacacgcccgugcaggacguuuucugccagaagggcuggacccagagcauuccguccacccgcuauucuaaggauaucugcuccaucggccuccacaccguaaaggagugcaagaucggcacgaccagcuucgagcgggugggcuucaucguugugaaggggcgcaagauguacaucgaacagaugaagaugcggucccgccaggaauacagcgaggaccaguucuuaugcuacaaguccgagagcggcuccgguagcuccgucaagcucaagaaguuuaagguggagagcuguaagggcgugacaaccuccucagccaguaagugcagcggugacgaguacuucuguucccgguaccccugcgagacggcgaacgucgaggcccacuguauccugcgccgccacagcgccaucguggaggugaaugucaacggggucugggugguccccaggugcaucggcuacgaggagguguuggugaagcggacuagccucaagguugaggacaccaccgggcgcgaaugcgacuccugccugugggagugcggcaagaacaagcugauugugaagacgcacgggcccaagguagucuacgccaccgccugcagccacggauccugcaagagcguuaugcagaaacccgcaaccuucgucuaucugccauaccccggcaacuccgagaucgucgggggagacaucgggauccacaugacagaggaaagcucccccagcaacauucaccucguggcccacugcccggcccgcgacuccugcgacgugagcgacugccuguucugcguccacggccugcucaacuaccagugccacacgcuguucuccgcccugcucaucagcaccacggugauguccauacugacccugcuccugcugcuggugaagggggccaaggaucugguuaaaaagcuguuccauuggcucaucacuccccugugcuggcugaguguguucugcugcuggguggucaaguccuggaaaagacgggugggcagcgcgaucuccaggaccaaugacaccaucggcuggcgggagaaccgccggcacgcccaggacaucgagcgagcccaguacaccgggggcgcaccgggugccaaguacagcuucuacggcgugaugauccucggccugcuguccagcgcgcagagcugcuccgaguccgucaucgccgacuccaagaucaugcagugcacaacgagcggguccagcacccucugcaaggccuccggcaccgugaucaugcgccuggggcccaucggcagcgaguccugccugauccucaagggccucaaggauagcgagaagcaguucaucucuauaaagaccaucaguuccgagcugacgugccgggaaggcgagagcuucuggaccacuuuauacacccccaucugccucuccagccgccggugccaucugaugggcgagugcguguccgaccgcugccucaaguggaagacgaaucagaccagcgcagagcugaccgggaaggcgcacggcgacgucaugcacgagaaccggugcuucgagcaguccgggggcaucgguuacggcugcuucaacgugaaccccaguugccuguacgugcacagcuaccucaaguccgucuaccgcaacggauucaagguguuccggugcguagcauggaaccaccgcaucaggcuggagguuaccacgcacagccgcaaguuucccauggugcugauggccauguccacccagccgaccgacugggggagcauaggccugaucuuagacuccgaagggaucaccggcacgaacagcuacagcuucaugaagcacgggagcggcuccuucgccaucaucgacgaccccuacagcccagagccccggaagggcuuccugggggaggugcgcugcccgaccgaggagaccgccaugcgcgcuuccccaagcuguaagauggcccccaaccucauugaguaccagcccgaaauggauaccgccgagugcacgaccaacaugauugacccgauggccaucuuuaaccgaggcucccucccacagguccgggacgggaugaccuucacccagagcaucgagaagaacacggugcaggcacugaccaccggcgaggucaaggcaucuauccgcuuaaucuuagacgauuacgacgucguauaccaaaacagccaguccgacugcagcgccaccuucaagaaucugacggggugcuacuccugugacgagggcagccggcucuguuaccaggugaaggccgagggcgagaccaucuuccacuuuaucaacgaggaagagagcaucaacgucaucaauaaggugucccccggagugagcgacuacugcaccguccugcacuucucccgccccgugauuaguaucgaaggcaccuacgacugcgggcuguccaagcggcccauggucaucaagggcacgcucaucgcgacggcgccccacgacgaccgcaagcaugaaggcggguccucccuugucgugaacccgaaaggcgggagcguugauuucuucgguuggcugucagggcucaccagcuggcugggcggcccccugaagaccuuccucacuauccucggguuccuggcggugggacuucugcugguggucaucauuaucaucaucauccggacggggaugcagcaggcccuuaagaagaagaucaaguga

SEQ ID NO: 16340 - RNA, 4020 nt, Artificial Sequence
  derived and/or modified CDS sequence (opt11) from TOSV(A189)__KP694241.1__GP
auguucaucgccaaguuacuccugauaagcugccuggugcagcaggccuaccucaaguacaccauaaucuccgagauaggcaacgggacccgcacgagcuccugcuacagcucccggaccagccugggcucccugcucgaggcgugggacaacaucaccgagagcaucgggcucaccuccggcacgugcaaggucgggagccuggaaaacagggacugcaagcgggacaucauguccaacuacguggccgaggugcacagcaaccuccacggccugggcgcuaugaugcacaacuacggggacgacaagcgcgucgaggugcugaacgacgugauccccgacgagcugaacccgggccggcacaacugcuccgaccuggaccgcaagcccuucuggaccgaguucaucaacgucgcccggcccaccaacaagauggcccccaugagcgugaucccgccgcccaucgugaagcccauccccgucgcggagcccaccaucgagaagacgaucccuuucgacaagcugcucuccgaggccgaaaaagagcuuaaccagaccaagauccgccuggaggcggagcggcgcagcaacgccgaggaggcggccaaggagcgggcccgcaugcgcgagaucgaggacaaguuacgcaaggacugggagcuagagcgggagcgcaaggacgcaguggccgacgaccuggcgaaggagaucgcccggcgccgggaaauagagcgcaaggcccacgagcucgacaagaugcugaagaagaaggagcgggaggaccugguggcccgcgaacgcgucuccgaggauaugcggaaccacgugcgccgacccaacaccaccaucgccccggcgcccacgaucaucaccacacuccugauggccucggccgugauggccgggccccuggagaaccgagagaccaaccaccuccugaaccggcccggcaacggggccuacacgcuguccgacuucgcugagagcacgugcacccucgccuacggcagcgagugcaaguccugggagcaccagcuggacgagcugagcuucccguucuuccacagcaaccucgacaaguacagcaugcuggaggccgccaccgaaaccguccccauccugaacaaguccagcgccgugugcaccaucuaccaccccaggauucaccggauggcgugcggccgcgaggccucccucaucaaaaagaagugcgggagcaacauguccgccuucuucuacgugaaccuggccggccagaucaccgucgugaagugcgacaccaaccacgugcugagcaacgacugcggaaacugcaucuccaaaacgcucagcggccagaagaucuacacccccguccaggacauguucugccagaagggcuggaccgaguccaucccgaacacccgguacagcaaggaucugugcuccaucgggcugcacacgguaaaggagugcaagaccggcaccaccaacuucgagcgcgugggguucaucgucgugaagggccggaagauguacaucgagcagaugaagaugcgcagccggcaggaguucuccgaggaccaguuccucugcuacaagagcgaguccaguaguggguccagcgucaagcugaagaaggugaagguggaguccugcaagggcgucacgaccagcuccgcgagcaagugcuccggcgacgaguacuucugcagccgcuaccccugcgagaccgccaacguggaggcgcacugcauccugcggcgccacagugccgugaucgaggucaacgugaacggggugugggucgugccccggugcauaggcuacgaggaggugcucguccgccggaccagccugaagguggaggacacguccagccgcgagugcgacacgugccugugggagugcgggaagaacaagcucaucgugaagacccacggccccaagaucgucuacgccaccgcgugcucccacgggagcugcaaguccgugaugcaaaagccggccaccuucguguaccugcccuaccccggcaacagcgagaucgucggcggggacaucggcguacacaugacagaggaguccagccccagcaacauucacaugguggcccacugcccggccaaggacuccugcgaggucagcuccugccuguucugugugcacgggcugcucaacuaccagugccacacccuguucagcgcccugcucaucuccaccaccgugaugagcauucugacgcugcucuugcugcucaugcgcggcgcgaaggaccugguuaagcggcuguucuacuggcucaucacgccgcugugcugguuguccguguucugcagcuggaugaucaaguccuggaagaagcgcgucgggagcgccaucagccggaccaacgacaccaucggcuggcgcgauaaccggcgcuacggccaggacgucgagcgggcccaguacaccgggggcgcccccggggcaaaguacucauucuacggugugaugauccucggccugcuggggaacgugcacucaugcagcgaguccguccucgccgacagcaaaaucaugcagugcaccaccuccgguagcuccacccugugcaaggccagcgggaccgugaucaugaagcuggguccgaucgggagcgaguccugucucauccugaagggccugaaggacagcgagaagcaguucaucuccaucaagaccaucagcucggagcugaccugccgcgagggcgagagcuucuggaccacgcucuacacccccgugugccuguccagccggcgcugccaccucaugggggagugcgucuccgaccggugccugaaguggaagacaaacgagaccagcgccgaguucacgggcaaggcccacggggaggugaugcacgagaaccgcugcuucgagcagaguggcgguaucggcuacggcugcuucaacgugaaccccagcugccuguacguccacuccuaccucaagagcguguacaagaacgguuucaagaucuuccggugcguggcguggaaccaccgcauccggcuggaggucaccacccacucccgcaaguuccccauggugcugauggccaugagcacccagccgacggacuggggcaguaucgggcucauccuggacagcgagggcaucaccgggaccaaugccuacuccuucaugaagcacggcagcgggagcuucgccaucaucgacgaccccuacucccccgagccccggaagggauuccugggcgaggugcgcugcccgaccgaggagacggccauccgggcgagccccuccugcaagauggcccccaaccucaucgaguaccagcccgagauggacaccgccgagugcaccaccaacaugaucgacccgauggccaucuucaacagagggagccugccccaggugcgggacggcaugacguucacccaguccaucgagaagaacaccgugcaagcccugaccacgggggaggugcgcgcgagcauccgcuuaacccuggacgacuacgaugucguguaccagaacucccagagcgacugcuccgccaccuucaagaaccugaccggcugcuacagcugugacgagggcucccggaugugcuaccaggugaaggccgagggggagaccaucuuccacuucguaaacgaggacgagagcaucaacgugaucaacaaggugucccccgacgucagcgacuacugcacggugcuccacuucucccgccccgucaucagcaucgagggccgguacgacugcgggcuguccaagcgcccgauggugaucaagggcacccugaucgccaccgcgccccacgacgaccggaagcacgagggcgggagcucccucguggucaaccccaagggagggaccguggacuucuucggcugggugagcgggcuaacgagcuggcugggcggcccccucaagaccuuucugaccauccugggguuccucgcccugggccugcuccuggucgugaucaucaucaucaucgcccgcaccggggugcagcaagcccugaagaagaagaacaaguga

SEQ ID NO: 16341 - RNA, 4020 nt, Artificial Sequence
  derived and/or modified CDS sequence (opt11) from TOSV(AR)__EF656362.1__GP
auguucaucgccaaacuacuacuaaucucgugccuaguacaacaagccuaccuaaaguauacgaucauaucagaaauaggcaacggcacccguacgagcuucugcuauagcucccgaacgucccuagguucgcuccuggaagcgugggacaacguaaccgaaagcauuggccuaaccucuggaaccugcaaagucggcagccucgaaaaccgagacugccgaaaggacauaauguccaauuacgucgccgaaguacacuccaaccuucacggccuaggcgcuaugaugcacaacuacggcgacgacaaaagaguagagauccucaacgauguaauccccgacgaacuuaacccaggacaccacaacugcuccgaucucgaucggaaaccauucuggacugaguucauaaacguagcaaagcccucgagcgaaauagugccaauguccguuaucccaccaccaguaguaaagcuccaaccuccagcggaacccuccucgaagaaacacguacccuuugacguccuacuaucugaagccgaaaaagagcucaaucaaacgaagauacgacucgaggaugagcgcaaauccaaugcugaagaaaccgccaaagagcgcgcccgcaugaaggaaaucgaggaugaacuccguagagaaugggaacuggagcguaagcgcaaagacgccauggccgaugaucucgcaaaagagacggcacgccgccgagaaaucgagcgcaaggcccacgagcucgaccgcaugcucaaaaagaaagaaagggagagccucaucgccaaagagaaagcggaugaagacaugcggagucacgugcauaaaccaaacaccaccagagcucccgcccccaccaucaucacgacgcugcugauggccuccgcggcccuagcgggaccccucgaaaaccgcgaaacuaaccaccuacucaaccgaccaggcaacggcgccuacacccuauccgacuuugccgaaagcacgugcacccuagcuuacggaagcgagugcaaaucaugggaacaucuacucaacgaagaacuauuccccuucuuucacuccaaucuagacaaauacuccaugcucgaagccgcaacagaaacaguccccauccucaacaaaagcagugcagucuguacgauuucccccucgacacacucauccaacgcaugcggcagagaagcuagcguaauuagaaagaaaugcuacucaaacauguccgccuuuuucuacaucaaccuugcaggacaaaucaccgucgucaaaugcgaaacaaaucacguccuaaguucugacugcggaaacugcaucagcaaaagccuuagcgggcaaaaaguguacacacccguacaagacgucuucugccaaaaaggcuggacccagucgaucccuagcacccgauacagcaaggacaucugcagcaucggacuccauacagucaaagaaugcaaaaucggaacaacaucauuugagcgagucggguucaucgugguaaaaggcaggaagauguauauagaacaaaugaaaaugagaucccgacaggaauacagugaagaccaguucuuaugcuacaaauccgaaucagggagcggcucgagcguaaaacucaagaaauucaaaguagaaagcugcaaaggggucaccaccuccagcgcuucaaaaugcucuggagaugaguacuucugcaaccgcuacccgugugaaaccgcgaacgucgaggcccacugcauucugagacgccauucggcaauagucgaagucaacguaaacggcguguggguagucccacgcuguauaggauacgaggaagugcucguaaaacgaacgucacuaaaaguagaagacacgacaggacgcgaaugcgacucaugccuuugggagugcgggaaagauaaacuaaucgucaagacacacggacccaaagucgucuacgccaccgccugcucccacggcuccugcaaaagcgugaugcaaaagcccgccaccuucgucuaccuacccuauccagggaacucagaaaucgucggcggggacaucggcauacacaugacggaagagucguccccuagcaacauccaccugguagcacacugccccgccaaagacagcugcgacgucagugacugccucuucuguguacacggacuccucaauuaccaaugccacacccuauucucggcccuacucauauccaccacagugauguccauccucacccugcuccuacuucuugucaagggugcaaaagaccucguaaagaaacuauucuacugguuaauaaccccacuaugcuggcugagugucuuuugcuguugggucgucaaaucuuggaaacgccgcgugggcucagcuaucucccgaaccaacgacacaauaggcuggcgcgaaaacaggcgccacgcccaggacauagagagagcacaguacacugggggagcgccuggagcaaaauauucuuucuauggaguuaugauccuaggccuacucagcucggcacaaucuugcuccgaauccgucaucgccgacuccaagaucaugcaaugcacgaccagcggcagcagcacccuuuguaaggcaucaggcacaguaauaaugagacugggaccgauugguagcgagucuugccuaauccucaaaggauuaaaagacuccgaaaaacaauucauauccaucaagaccauauccucagaacuaacuugccgcgaaggcgaaucguucuggaccacccucuacacaccaaucugucucuccucacgaagaugccaccucaugggagaaugcguaucagaucgcugucucaaguggaaaaccaaucaaacaagugcagaguucaccggaaaagcgcacggggauguaaugcacgaaaaccgaugcuuugaacaaucgggcgggauagguuacggcugcuucaacgucaaucccucaugucuauacguacacucauaccucaaauccguauacaggaacggcuucaaggucuuuagaugcgucgccuggauacaccgcauccgacucgaagucacaacacacagccggaaguucccaaugguccucauggccauguccacccaaccgacagacuggggcucgauaggacuaauucucgacuccgagggcauaacagggacaaacagcuauucuuuuaugaaacacggcucaggauccuuugccauaauagacgacccauacucacccgaaccuaggaagggauuccuaggcgaaguuagauguccuacagaagaaacagcaaugcgggcgagcccauccuguaaaauggcccccaaccucaucgaauaccagccagagauggacacggcagaauguacaacaaacaugaucgaccccauggccauauucaaccgaggcagccucccccaagucagggacgggaugacauucacccaaagcauagagaaaaacacaguacaggcacuaaccacuggagaagucaaagcguccauacgccugacacuagacgauuacgacgucgucuaccaaaacucgcaaucugacugcucagccaccuucaagaaccuaacaggaugcuacucuugugaugaagguucucgccucuguuaccaggucaaggccgaaggcgagacagucuuccacuucaucaacgaagaggaaucgaucaacgucaucaacaagguuuccccgggcgugucagacuacugcaccguacuccacuucagcaggccagugaucucaaucgaaggcacuuacgacugcggccucuccaaacggccgauggucaucaaagggacgcuaaucgcaacagcaccccacgacgaccggaagcacgaaggaggcagcucccucgucgucaaccccaaagguggcucgguggacuucuucggaugggucucaggacugacaucuugguuaggcgggccccuuaaaaccuuccuaaccauacucggauuccucgcaguaggacugcuucuggucguuaucauaaucauuaucauccgcaccggaaugcagcaagcacucaaaaagaagauaaaauga

SEQ ID NO: 16342 - RNA, 4020 nt, Artificial Sequence
  derived and/or modified CDS sequence (opt11) from TOSV(EsPhGR40)__FJ153283.1__GP
auguucaucgcgaaacugcuacuaaucagcugucucguccagcaagccuaccuaaaauacacgauuaucagcgagaucggcaaugguacgcgaacaucuuucuguuacucaagccgaacuagccuaggcagccucuuagaagcgugggacaacgucacagagagcaucggcuuaaccagcggaaccugcaaagucgguagucuagagaaccgugacuguggcaaggacaucauguccaauuacguagccgaaguucauagcaaucuccacggccuaggagccaugaugcacaacuacggugacgacaaaagaguagaaauacucaacgacguaauaccugacgaacuaaacccaggccaucacaauuguucagaccuggaccgcaagccauucuggaccgaguucaucaauguagcaaagccacucagcgaaauagcaccaauguccgucauacccccacccgucguuaaauugcaacccccagccgaacccucaucaaagaaacauguacccuuugacgugcuucuaagcgaagccgaaaaagaacucaaccaaacuaagauccgucuagaggaugaaagaaaaagcaacgcagaagaaaccgcccgagaacgcgcgcgcaugcgcgacauagaagaagaacuacgcaaagaaugggaacucgagcgcaaacgaaaggacgcaauggcagacgaccuggcaaaagaaacagcaaaaagacgagaaaucgaacgcaaagcccaugaacuagaucguauguuaaagaagaaagaacgagaaucccuaauagcaaaagagaaggaggacgaaaacaugaggucccgcguccacaaacccuccacaacgagagcgcccgcaccaacgaucaucaccacacuccucauggcaucgacggccuuagcggggccacuggagaaccgagaaacaaaucacuugcuaaacagaccaggcaacggcgccuacacacuaagcgacuucgcagaaagcacauguacgcuagcauacggaagcgagugcaaauccugggaacaucugcuaaacgaagaauuauucccauucuuccacuccaaccucgauaaauacucgaugcuugaagccgcuacggagacagucccuauacuaaacaaaucauccgccguuugcacaauaagucccucgacacacagcucaaacgcgugcgggcgagaagcaucagucauucgcaagaagugcuacucuaacaugagcgcccuguucuacaucaaccuagccggacaaaucaccguagugaagugcgaaaccaaccacgugcuauccuccgacugcggcaacugcauaucgaaaucccuuaguggccagaaagucuacacacccguccaggacguguucugucaaaagggguggacagaaucgauaccuuccacgagauauucaaaagacauaugcucuauaggacuacacaccgucaaagaaugcaaaaucggaaccacgagcuucgagcgcgucggcuucauaguagucaaaggccgaaagauguauaucgagcaaaugaaaaugcgcucccgacaagaauacuccgaagaccaauuccugugcuacaaauccgaauccggcagcggcagcuccguaaaacucaaaaaguucaaggucgaauccugcaaaggaguaacaaccucgagugccagcaaaugcucaggcgacgaguacuucugcagucguuacccaugcgagacagcaaacguagaggcccacugcauccugagaaggcacagugcuauagucgagguaaacguaaacggcguuuggguugucccucgaugcaucggcuacgaagaaguccucgucaagcgcacaagccucaaagucgaagacacaacagagcgcgaaugcgacuccugucucugggaaugcggcaaaaauaaacuuauagucaaaacccacggaccgaaaguagucuacgccacugccugcagccaugguucauguaaaucagucaugcagaaaccaacuacauucguauaccuaccuuacccgggcaacucggaaaucgucggcggcgacaucgggauccauaugaccgaggaauccucaccuuccaacauacaccuggucgcccacugccccgcacgagacucgugcgacgugagcgacugccuauucugcguccauggccuacucaacuaccagugccauacccuguucucagcacuacuaaucucaaccaccguaauguccauacuaacgcugcugcuucuccucguaaaaggcgcgaaagaccuaguuaagaaacuguucuacuggcucaucaccccucuaugcuggcuaagugucuucugcuguuggguggucaaaucauggaaacgacgcguaggcagugcaaucagccgcacaaacgauaccauaggauggcgugagaaccgccgauacgcccaagacauagaacgcgcacaguacacaggcggcgcccccggagcaaaauauagcuucuacggagucaugauucuaggccuacuaucaagugcacaaucaugcuccgaaaguguuaucgccgacucgaaaauaaugcaaugcacuacgagcggauccucgacccugugcaaagcaagcggaacgguaaucaugcgccucggacccauagggucagaguccuguuugauacuaaaaggguugaaagacucagaaaagcaauucauaucaauaaagacaaucuccagcgaacuaacaugccgagaaggcgaauccuucuggacuacucuguacacccccaucugccucucaucgcgcagaugccaccuaaugggagaauguguuucggaccguugccuaaaauggaaaacaaacgaaacuagcgccgaguucacggguaaagcccacggagacgugaugcaugaaaauaaauguuuugaacaaucuggcgggauaggcuacgggugcuucaacgucaacccgagcugccucuacguacacucauaccugaagucaguauaccgaaauggguucaaaaucuuccguugcgucgcauggaaccacagaauccgacucgaaguaacaacucaaucccgcaaauuccccaugguccucauggcgaugucaacacagcccaccgacuggggguccaucggauuaauucucgauagcgaaggaaucaccggaaccaacagcuacucguucaugaaacacggguccgguagcuucgccauuauagaugacccauacucccccgaaccccggaaaggauuccugggagaagugaggugcccaaccgaagaaacagcuaugcgcgcauccccgucauguaaaauggccccaaaucugaucgaguaccaacccgaaauggauacugcagaguguacgaccaacaugaucgauccuauggcaaucuucaaccgcggaucccuuccccagguccgagacggaaugacauucacacaauccaucgagaaaaacacaguacaagcccuuaccaccggagaaguaaaagcauccauccgacuaacucuagaugacuacgacguggucuaccaaaacucucaguccgacugcagugccaccuucaaaaaucuaacgggcuguuacuccugcgacgaaggcucaaggcucugcuaccaaguaaaggccgaaggcgaaacaguuuuccacuucauuaacgaagaagaaagcaucaacguaauaaacaaagucucgccagacguaucagacuacugcaccguuuuacacuucucacgcccuauaaucagcauagaggggaccuacgauugcggccuuagcaagcgccccaugguuauuaagggcacccuaauagcgaccgcaccccaugacgacagaaagcaugaaggcggaucgagucuaguagucaaucccaagggcggaucaguagacuucuucggcuggcuaucgggccuaacuuccuggcucggcggcccacuaaaaacguuccuaaccauacugggcuuccucgcggucggccuacuacuugucguaaucauaaucaucaucauccgcacaggaaugcaacaggcacugaaaaagaaaauaaaauag

SEQ ID NO: 16343 - RNA, 4014 nt, Artificial Sequence
  derived and/or modified CDS sequence (opt11) from TOSV(SI-121283)__JF330279.1__GP
auguucaucgccaagcugcuccuaaucaguugccuggugcagcaggccuaucucaaguacaccaucaucuccgagaucggcaacgggacccgcacgagcuucugcuacuccagccggaccucccugggcagccugcucgaggcgugggacaacaucaccgaguccauugggcugacuagcgggaccugcaaggucggcucccuugagaaccgcgagugcaagcgggacaucaugagcaacuacgucgcagaggugcacuccaaccuccacggccugggcgccaugaugcacaauuacggggacgacaagcgcaucgagguccugaacgacgucauccccgacgagcucaacccgggccggcacaauugcagcgaucuggaccgcaagccuuucuggaccgaguucauuaacguggccaagcccgccaaugagauggcgcccauguccgucaucccgccgcccaucgugaagcccauccccguggccgagagcaccaccaagaagacgauccccuucgacaaacugcucuccgaggccgagaaggaacugaaccaaaccaagauccggcuggagaccgagcgccgcagcaacgccgaggaggcggccaaggagagggcccggaugcgcgagaucgaggacaagcuccggaaggacugggagcuggagcgcgagcggaaggacgcggucgccgaggaccuggcgaaggagaucgcccgccgccgcgagauagagcggaaagcccacgagcucgauaagaugcugaagaagaaagagcgcgaagaccugguggcccgggagcgcguggacgaggacaugcgcaaccacguccggcgccccaacaccacgaucgcccccaccaucaucaccacccuccugaugggguccgcggugauggccggcccgcuggagaaccgggagcccacgcaccuccugaaccgccccgggaacggcgccuauccccuguccgauuucgccgagccuaccugcacccucgccuacgggagcgagugcaagagcugggagcaccaacuggacgagcugagcuuccccuucuuccacuccaaccucgacaaguacagcaugcuggaggcggccaccgagacgauccccauccugaacaagucgagcgccguuugcaccaucucccccuccacgcacuccagcaacgccugcgggcgggaggccucucucaucaaaaagaaguguggcagcgacauguccgcguucuucuacgucaaccuggcggggcagaucaccguggugaagugcgacacgaaccacguccugagcaacgacugcggcaacugcaucuccaagaccuugagcggucagaagauuuacacccccgugcaagauauguucugucagaaggggugguccgaaagcauucccuccacccgauacagcaaggaccugugcuccaucggccugcacacggugaaggagugcaagaucgggacgaccaacuucgagcgggucggcuucaucguggugaaggggcgcaagauguacaucgagcagaugaagaugcggagccgccaggaguucagcgaggaccaguuccucugcuacaaguccgagggcagcuccggcucauccgucaagcugaagaaggugaaggucgagaguugcaagggggugaccacguccagcgccuccaagugcagcggcgacgaguacuucugcucccgguacccgugcgaaaccgccaacguggaggcgcauugcauacugcgccggcacagcgcagugaucgaagugaacguuaacggggucuggguggucccgcgcugcauaggcuacgaggagguccucgugcggcgcaccucccugaagguggaggacaccagcucccgggagugcgacacgugccugugggagugcgggaagaacaagcucaucgucaagacccacggcccuaagaucguuuacgccaccgcuugcucgcacggcuccugcaagagcgugaugcagaagcccgccaccuucgucuaccugcccuaucccgggaacagugagaucgugggcggcgacaucggcgugcacaugaccgaggaguccucgccguccaacauccacauggucgcgcacugucccgccaaggacagcugcgaaguguccagcugccuguuuugcgugcacgggcugcucaacuaccagugccacacgcuguucuccgcccugcucaucagcaccaccgucauguccauccugacccugcuccugcugcucgugaagggcgccaaagaccuggugaagcgccuguucuacuggcucaucacgccacugugcuggcugagcgucuucugcggcuggaugauccggagcuggaagaagcgcguggguagcgccaucucccgcaccaacgacaccaucggcuggcgggacaacagccgccgggggcaggacaucgaacgcgcgcaguacaccggcggcgccccgggggccaaguacuccuucuacggugugaugauccucgggcuguugggaaacguccacagcugcuccgagagcaucauagccgacuccaagaucaugcagugcacuaccagcgggagcuccacccucugcaaggccagcggcacagugaucaugaagcugggcccgauaggguccgagaguugccugauccucaaaggccugaaggauuccgagaagcaguucaucagcaucaagacgauauccagcgagcugaccugcagggagggggaguccuucuggacuacccucuauacccccgugugccugagcucccgccgcugccaccugaugggcgaaugcgucagcgaucgcugccuccgguggaagaccaacgagaccucagcggaguucaccgggaaggcucacggcgagguaaugcacgagaaccgcugcuucgagcagagcggcgggauuggcuacgggugcuucaacgugaaccccuccugccuguacguucacagcuaccuuaaguccguguacaagaacggcuucaagauauuccgcugcguggccuggaaccaccgcauccggcucgaggucacgacucacagccgcaaguucccgauggugcucauggccauguccacccaaccgaccgacugggggagcauuggccugauccucgacagcgagggcaucacggggaccaacgcguacagcuucaugaaacauggccuggggagcuucgccaucaucgaugaccccuacucccccgagccgcggaagggcuuccugggggaggugcgcugccccacagaggagaccgccauccgggccagccccuccugcaagauggccccaaaccucauagaguaccagccggagauggacacggcggaaugcaccaccaacaugaucgaccccauggccaucuucaaccgcggcagccugccccaaguccgggacggcaugaccuuuacgcaguccaucgagaagaacaccgugcaggcccugaccaccggggaagugagagccucgauccgauugacgcuagacgacuacgaugucguguaccagaacucccaguucgacugcagcgccaccuucaagaaccugaccggcugcuacuccugcgacgagggaagccgcaugugcuaccaggugaaggcggagggcgagaccauuuuccacuucgucaaugaggacgagaguaucaacgugaucaacaagguaagccccgacgucucugacuacugcaccgugcuccacuucagccgcccggugaucuccaucgaaggccgguacgacugcgggcugagcaagcgucccauggucaucaagggcacucugaucgccaccgcgccucacgacgaccggaagcacgagggcggguccucgcucguggucaaccccaagggcgggaccguggacuucuucggcuggguaagcggucugaccuccuggcugggcgggccccucaagacguuccugaccauucugggcuuccucgcccuggggcugcuccuggucgugaucaucauaaucauugcccgcaccggcguggaacaggcccugaagaagaagaacaaguga

SEQ ID NO: 16344 - RNA, 4014 nt, Artificial Sequence
  derived and/or modified CDS sequence (opt11) from TOSV(SI-121487)__JF330280.1__GP
auguucaucgccaagcugcuccuaaucuccugccuagugcagcaggccuaccucaaauacacuaucaucuccgaaauuggcaacgggacccgcacgagcuucugcuacuccagccggaccucccugggcagccugcucgaggcgugggacaacaucaccgaguccaucgggcugaccagcggcacgugcaaggucgggucccuggagaaucgcgagugcaagcgggacaucaugagcaacuacgucgcggagguucacuccaaccuccacggucuuggcgccaugaugcacaacuacggagaugauaagcgaaucgaaguccugaacgacgugauccccgacgagcuuaacccgggccggcacaacugcuccgaccuggaccggaagcccuucuggaccgaguuuaucaacguggcgaagcccgccaaugagauggcgcccauguccgucauucccccgccuaucgugaagcccauccccguggccgagagcaccaccaagaagacgaucccauucgacaagcugcucuccgaggccgagaaggagcuaaaucagaccaagaucaugcuggagaccgagcggagaagcaacgccgaggaggcggccaaggaacgcgcccgcaugcgggagaucgaggacaagcuccgcaaggacugggaacuugagcgggagcgaaaggaugccgucgcggaggaccuggcgaaagagaucgcccggcgccgggagauagagcgcaaggcgcacgagcucgacaagaugcugaagaagaaggagcgggaggaccucgucgcccgcgagcggguggacgaggacaugcgcaaccacgugcgucggccuaacaccacgaucgcccccaccauuaucaccacccuucugauggcguccgccgugauggccgggccgcuggagaaccgcgagaucaaucaccuucugaacuggcccggcaacggugccuacacgcuaagcgacuucgccgaguccacgugcacgcucgcguacggcagcgagugcaagucgugggagcaucagcuggacgaacuuuccuuccccuucuuccacagcaaccucgacaaguacuccauguuagaggccgccacugagaccauccccauucugaacaaaagcuccgccguaugcaccauaagcccguccacccacagcuccaacgccugcggccgggaggcgagccugaucaagaagaagugcgggucagacaugagcgccuucuucuacgucaaccuggccggucagaucaccguggugaagugcgacaccaaucacguccugucgaacgacugugggaauugcaucagcaaaacccucucuggccagaagaucuacacccccguccaggacauguucugccagaagggcuggucugaguccauccccagcacccgcuauuccaaggaucugugcagcaucgggcugcacacggucaaggagugcaagaucggaaccaccaacuucgagcgagucggguucaucguggugaagggccgcaagauguacaucgagcagaugaagaugcggaguagacaggaguucuccgaggaccaguuccucugcuacaagagcgaggggucuagcggcuccagcgucaagcugaagaaggugaaggucgaauccugcaagggcguaaccacgagcuccgccagcaagugcagcggagaugaguacuucugcagccguuacccaugcgaaaccgcaaacguggaggcccacugcauccugcgccgucacuccgccgucaucgaggugaacgugaacgggguguggguugugccgcgaugcauaggguacgaggaaguccucgugcggcgcacuagccugaagguggaggacaccuccagccgggagugcgacacgugcuugugggagugcgggaaaaacaagcugaucgucaagacccacgggcccaagaucguguaugccacggccuguucccacggcagcugcaagagcguaaugcaaaagcccgcgaccuucgucuaccugcccuacccgggcaacuccgagaucgucgggggcgacauaggggugcacaugaccgaggagagcuccccuagcaauauccacaugguggcccacugccccgccaaggauuccugugagguuagcuccugccuguucugugugcacggccugcuaaacuaccaaugucacacgcuguucagcgcccugcucaucuccaccaccgucaugaguauacugacccuacuccugcuccucgugaagggggccaaagaucuggugaagcgccuguucuacugguuaaucacgccacucuguuggcuguccgucuucugcggauggaugauccgaagcuggaagaagagggugggcuccgcgauaagccgaacaaacgacaccaucggguggcgcgacaacuccaggaggggacaggacaucgagcgcgcccaguauaccggaggggccccuggcgccaaauacagcuucuacggggucaugauccucggccugcuggggaauguccacucgugcagugagucgaucaucgcagauagcaagaucaugcagugcacgaccagcgguuccagcacccucugcaaggcgucagggaccgugauuaugaagcugggccccaucggcagcgaguccugccuaauccucaaggggcugaaggacucagagaagcaguucaucuccaucaagacgaucagcuccgagcugaccugucgggagggcgagucguucuggaccacgcucuacacgcccgugugccuauccagccgccggugucaccugaugggggagugcgucuccgaccgcugccucagauggaagaccaaugagacuagcgcugaguucaccggcaaagcacacggggaggugaugcacgaaaauagaugcuucgagcaguccggcggcaucggguacggguguuucaacgugaacccaagcugccuguacguccacuccuaccucaaaagcguguacaagaacggguucaagaucuuccggugcguggccuggaaucaccgcauccggcuggagguaacgacucacucccgcaaguuccccauggugcugauggcgaugagcacccagccuaccgacuggggcagcauaggguuaauccucgauuccgagggcaucacgggcaccaacgccuauagcuucaugaagcacggguccggcagcuucgccaucaucgacgacccuuacucuccggagccccguaagggguuccugggcgaggugcgcugcccuaccgaggagaccgccauccgggcuagccccuccugcaaaauggcgccgaaccugaucgaguaccagcccgagauggacacggccgagugcaccaccaacaugaucgaccccauggccaucuucaaccgcggaagccucccccaaguccgggacggaaugaccuuuacgcaauccaucgagaagaacaccguacaggcccugaccaccggcgaggugcgugccagcauccggcugacgcucgacgacuacgacgucguguaucaaaacucacaguucgacuguagcgcuaccuucaagaaccugaccggcuguuacuccugcgacgagggcagcaggaugugcuaccaggugaaagccgagggugaaaccauuuuccacuuugucaacgaggaugaguccaucaacgugaucaacaaggugagcccggacgucuccgauuacugcaccguucugcauuucagccggcccgugaucuccaucgagggccgcuacgacugcggccucagcaagcgacccauggucaucaagucaacacugaucgccaccgcaccccacgacgaucggaagcacgagggcggcuccagccucgugguuaacccgaagggcgggaccguggacuuuuucggauggguguccggccucacuagcuggcugggcggaccccuuaagacguuccucaccauccugggcuuccuggcccucggccuccugcugguagugaucaucaucaucaucgcccguaccggcguucagcaggcgcucaagaagaagaacaaguga

SEQ ID NO: 16345 - RNA, 4014 nt, Artificial Sequence
  derived and/or modified CDS sequence (opt11) from TOSV(SI-21137)__EU003173.1__GP
auguucaucgcaaagcugcuucucaucagcugccuggugcagcaagccuaccucaaauauacaaucaucuccgagauaggcaaugggacgcggacguccuucugcuacuccagccggaccucucugggcagucugcuagaggcgugggacaacaucaccgaguccaucgggcugaccagcggcacaugcaaggucgggucccuggagaaucgcgagugcaagcgggauaucaugagcaauuaugucgccgaggugcacuccaaccuccacggccugggcgccaugaugcacaacuacggggacgauaagcgcauugagguacugaacgacgugauccccgacgagcucaacccgcgucgccauaauugcagcgaccuggaccggaaacccuucuggaccgaguucaucaacguggccaagcccgccaacgaaaucgcgcccauguccgucaucccgccgcccauagugaagccaauccccguggcugagagcacaaccaaaaagacgauccccuuugacaagcugcucuccgaggccgagaaggagcugaaccagaccaagauccgcuuagagacggagcggcgcagcaacgccgaggaggcggccaaggagcgggcgcgcaugcgggagauugaggacaagcuccgcaaggacugggagcuggagcgcgagcgcaaggacgcagucgccgaggaccuggcgaaagagauagcccggcgccgggaaaucgagcggaaagcccacgaacucgacaagaugcugaaaaagaaggagcgggaggaccuaguggcccgcgaacgcguggaugaggacaugcggaaccacguccgccggcccaacaccacgaucgcccccaccaucaucaccacgcuccugauggcguccgccgugauggcgggcccgcucgagaaccgugaaacgaaccaccuccugaaucggccugggaacggugcguacacccugagcgacuucgccgaguccacgugcaccuuggcguacgggagcgagugcaagagcugggagcaccagcuggaugagcuguccuuccccuucuuccacagcaaccucgacaaguacuccaugcucgaggccgccaccgagaccauccccauccugaacaagagcuccgccgugugcaccaucagcccgagcacccacagcuccaacgccugcggccgcgaggcgagccucaucaagaagaagugcggauccaacaugagcgccuucuucuacgucaaccuggccgggcagauuacgguggugaagugcgauaccaaccauguccuguccaacgacugcggcaacugcaucucgaaaacccucuccgggcagaagaucuacacucccgugcaggacauguucugccagaagggcuggagcgagacgaaccccucaacuagauacagcaaagaccuuugcuccaucggacugcacaccguaaaggagugcaagaucgggaccacgaacuucgagcgcgagggcuucaucguagugaaggggcggaagauguacaucgagcagaugaagaugcgcagccggcaggaguucagcgaggaucaguuccuuugcuacaaguccgagggcagcucgggaucauccgugaagcugaagaaggucaagguggagagcugcaagggcgugaccaccaguagcgccucuaagugcagcggcgacgaguacuucuguuccagguacccaugcgagaccgcgaacguggaggcgcacugcauccuucgucgccacucagcagugaucgaggucaacgugaacgggguguggguaguaccgcggugcaucgguuacgaggaggugcucguccgccggacuucccugaaaguggaggacaccucgucgcgugagugcgauaccugccugugggaaugugggaagaacaaguugaucgugaagacccacggccccaagaucgucuacgccaccgccugcagccacggcuccugcaagagcgugaugcagaagcccgcaaccuuuguguaucugcccuaccccggcaauagcgagauagucggcggggacaucggcgugcacaugaccgaggaguccagccccuccaacauccacauggucgcccacugccccgccaaggacucaugcgaggucuccagcugccuguucugcguacacgggcugcucaacuaccaaugccacacccuguucuccgcccugcucaucagcaccacggugaugucgauccugaccuuacuucugcucuuagucaagggagcuaaggaccuggugaagagacuauucuacuggcucaucacgccccuguguugguugagcguguucugcggguggaugauccgcuccuggaaaaagcgcgucggcucggcaaucucccggaccaacgacacgaucggcuggcgcgacaacagccggcgcggacaagacauagagcgggcccaguacaccggcggggcccccggugccaaguacuccuucuacggcgugaugauacuggggcugcugggcaacgugcauagcugcucagagagcaucaucgccgacuccaaaaucaugcagugcaccaccagugggagcuccacgcucugcaaggcgagcggcaccgucaucaugaagcucgggccaaucggcucagaaagcugucugauccucaaaggccugaaggacagcgagaagcaguucaucagcaucaagacaaucuccagcgagcugaccugccgcgagggggaauccuucuggacgacccucuacacccccgugugccugagcucccggcgcugccaccugaugggcgagugcgugagcgaccggugccuccgguggaagaccaacgagacgagcgccgaguucaccggcaaggcccauggcgaggucaugcacgagaaccggugcuuugagcagagcgggggcaucggcuacggguguuucaacgugaacccguccugccuguacgugcacagcuaccugaaguccgucuacaagaacggcuucaagaucuuccgcugcguggccuggaaccaccgaauccgccucgaagugaccacccacagccggaaauucccaaugguccugauggcuauguccacacagcccaccgacugggggagcauuggcuuaauccucgacagcggcgggaucacggggaccaacgccuacuccuucaugaaacacgggcucggcagcuucgcuaucauugacgaccccuacuccccggagccgcgcaagggguuccucggagaggugcggugcccuacggaggagaccgccauccgcgccagccccucaugcaagauggcgccgaauuugaucgaauaccagcccgagauggacaccgccgaauguaccacgaacaugaucgaccccauggcuaucuucaaccgggggagcuugccccaagugcgcgacggcaugaccuucacccagaguaucgagaagaacaccguccaggcccugacgaccggcgagguaagagccucuauccggcucacccuggacgacuacgacguggucuaccagaacucccaguucgacugcagcgccaccuucaaaaaucuaaccgggugcuacuccugcgacgagggcagcagaaugugcuaucaagugaaggccgagggggagacgaucuuccacuucgugaaugaggacgaauccaucaacgucaucaacaagguuagcccggacguguccgacuauugcaccguacuccacuucucccggccggugaucuccaucgagggccgcuacgacugcggucugucuaagcggcccauggugaucaagggcacucugauagccaccgcgccgcaugacgaccgcaagcacgagggugggagcagccucguggugaauccgaaaggcgggacgguggacuucuuugggugggugagcggcuugaccucuuggcucgggggcccccuaaaaaccuuccugaccauccugggguucuuggcgcugggccugcuccuaguggucaucaucaucaucaucgcacggacggggguggagcaggcccugaaaaagaagaacaaguga

SEQ ID NO: 16346 - RNA, 4014 nt, Artificial Sequence
  derived and/or modified CDS sequence (opt11) from TOSV(SI-31051)__EU003174.1__GP
auguucaucgccaagcugcuucugaucagcugccuggugcagcaagccuaccucaaguacaccaucaucuccgagaucggcaacgggacgcgcacgagcuucugcuacuccagcagaaccucccuggguagccugcucgaggcgugggacaacauuaccgagucgauugggcuuaccagcggcacgugcaaagucgggagccuggagaacagagaaugcaagcgggauauaaugaguaacuauguggccgaggugcacuccaaccuccacggucugggcgccaugaugcacaacuauggcgacgacaagcgcaucgagguccugaacgacgugauccccgacgaacucaacccgggucggcacaacugcagcgaccuagaccgcaagcccuuuugcaccgaguucaucaacguggccaagcccgccaacgagauggcgcccauguccgucaucccgccgcccaucguuaagcccaucccaguggcagagcccaccaccaaaaagacgauccccuucgacaaacugcucagcgaggccgagaaggagcugaaucagaccaagauccgguuggaaaccgagcggcgguccaaugccgaggaggcggccaaggagcgcgcccggaugcgcgagaucgaggauaaacuccggaaggacugggaguuggagcgcgagcggaaggacgcggucgccgaggaucuggcgaaggaaaucgcccgcagacgcgagaucgagcggaaggcacacgagcucgacaagaugcugaagaaaaaggagagggaggaccugguggcccgugaacggguggacgaggacaugcgcaaccacguccggcggcccaacaccacuaucgccccgacaaucaucaccacccuccugauggcuagcgccgugauggcggggccccuggagaaucgcgaaacgaaccaccuccugaauagacccggcaacggcgccuacacccuguccgauuucgccgaguccacgugcacccucgcguacggcuccgagugcaagagcugggaacaccagcuggacgaacugagcuuccccuuuuuccacuccaaccuugacaaguacagcaugcuggaggccgccaccgaaaccaucccgauccugaacaaguccagcgccgugugcaccaucucccccagcacccacuccagcaacgccugcggcagagaggcgucccucaucaaaaagaagugcggcagcgacauguccgccuucuucuacgucaaucuugccggccagauaacgguggugaagugcgacaccaaccacguucugucuaacgacugcgggaacugcauauccaagacccucagcggccaaaagaucuacacccccgugcaggacauguuuugccagaaaggcugguccgagagcaucccuuccacgcgcuacagcaaggaccugugcuccaucggccugcacaccgugaaagagugcaagauaggcaccaccaacuucgaacgggugggguucaucguggugaagggccgcaagauguacaucgagcagaugaaaaugcggagccgccaggaguucagugaggaccaguuccugugcuacaaguccgagggcucaucaggcagcucggucaaguugaagaaggugaaggucgagagcugcaagggcgugacgaccucgagcgccucgaaguguucuggggacgaguacuucuguucccgguacccgugcgagaccgcgaacguggaggcccacugcaucuuacgccggcacagcgccguuaucgaggugaacgugaacggcgucuggguggugccccgcugcaucggguacgaggagguccuggugcggcgcaccuccuuaaaaguggaggacacgagcucccgggagugcgacacgugccugugggagugcggcaagaacaagcucauaguuaaaacccacgggcccaaaaucguguacgccaccgcaugcagccauggguccugcaagagcgugaugcaaaagcccgcgaccuucgucuaccugccguaccccggcaacuccgagaucguagggggcgacaucggggugcacaugaccgaagagucgagccccuccaacauccacaugguggcccacugucccgccaaggacagcugcgaagugucuagcugccuguucugcguacacggccugcuuaacuaccagugccacacccuguucuccgcucugcucaucagcaccaccgucauguccauccugacgcugcuccuacugcucguuaagggggcaaaagaccuggucaagcgccuguucuacuggcucauuaccccgcugugcuggcugucugucuucugcggcuggaugauuagguccuggaagaagcgcgugggaagcgcgaucucccgcaccaacgacaccauaggguggcgggacaacucccgccggggccaagacauagaacgggcccaguacaccgggggcgcccccggcgccaaguauucuuucuacggagugaugauccucggccugcuggggaacguacacagcugcuccgagucaauaaucgccgacuccaagaucaugcagugcacgaccagcgggucuuccacccucugcaaggcgagcgggacgguuaucaugaagcugggccccaucggcuccgagagcugccuaauccucaaggggcugaaggacuccgagaagcaauucaucagcaucaagaccaucuccagcgagcuaaccugccgggagggcgaguccuucuggaccacccucuacaccccggugugccuuagcucccgccguugccaccugaugggggagugcgucagcgaccgcugccuccguuggaagaccaacgaaacuuccgccgaguuuacgggcaaggcccacggggaagugaugcacgaaaaccgcugcuucgagcaaagcggaggcaucggguacggcugcuuuaacgugaacccaucgugcuuguacguccacagcuaccuaaaguccguguacaagaacggguucaaaaucuuccggugcguggccuggaaccacagaauccggcucgagguuaccacccacagccggaaguuccccauggugcugauggcgauguccacccagccuacggacuggggcagcaucgggcucauccuggacagcggcggcaucaccgggacuaacgccuacuccuucaugaagcacggccuggggagcuucgcuaucauugacgacccuuacucucccgagccccggaagggcuuccugggggaagugagaugccccaccgaggagacggccauccgggccagcccguccugcaagauggcgcccaaccucaucgaguaccagcccgagauggacaccgcagagugcaccaccaacaugaucgacccuauggccaucuucaaccgcgggucucugccgcagguccgggacggcaugacguucacgcaguccaucgagaagaauacugugcaggcccugacuacgggcgaggugcgcgccagcauccggcuaaccuuagacgacuacgacguuguguaccaaaauucccaguucgacuguagugcuacuuucaagaaucugaccggcugcuauuccugcgacgaggggagccgcaugugcuaccaggugaaagccgagggcgagaccaucuuccacuucgucaacgaggacgaguccaucaacgugaucaacaaagugucgcccgacgucuccgacuacugcacggugcuccacuuuagccgccccguuaucuccauagagggccgguacgauugcggccugagcaagaggcccauggucauaaagggaacccugauugccaccgccccucacgacgaccggaagcacgagggcggguccagcuuaguggucaacccaaagggcggaacgguggacuucuucggcuggguguccggguuaacguccuggcugggcgguccccucaagaccuucuugaccauccucggcuucuuagcccugggucuccuccuggucgugaucauaauuaucaucgcgcgcaccgggguggagcaggcccugaagaaaaagaacaaguga

SEQ ID NO: 16347 - RNA, 4014 nt, Artificial Sequence
  derived and/or modified CDS sequence (opt11) from TOSV(SI-39538)__EU003175.1__GP
auguucauagccaaacuacugcucauaucgugccuuguacaacaagccuaccuaaaguacaccaucaucagcgaaauaggcaacggcacaagaaccuccuucugcuacuccagucggacgucgcucggcucacuacuagaagccugggacaacaucaccgagagcaucgggcucaccagcggcacaugcaagguaggcucccuggaaaaccgggaauguaaaagagacauaaugagcaauuacguggccgaagugcacagcaaucugcacggacuuggcgcgaugaugcacaacuacggcgacgacaagcgaauagaagucuugaacgacguaaucccggacgaacuaaacccgggaagacacaacugcuccgaccuagacagaaagcccuucuggacagaguucauuaauguagccaaacccgcaaacgagauggccccgaugucagucauaccacccccuaucguaaagcccauacccgucgcggaaagcacaacaaagaaaacaauccccuucgacaaacuccuuagugaagcagaaaaggaacuaaaccaaacuaagauccgccucgagacggaaaggagaagcaacgccgaggaagcagcgaaggaacgcgcaaggaugagggaaaucgaagacaagcuccgcaaagacugggaacucgagcgggagcgaaaagacgccgucgcggaagacuuagcaaaagaaauagcccggcgacgcgagaucgaacgaaaggcccaugaguuggacaaaauguuaaagaagaaagagcgggaagaccucgucgcgagagaacgcguagacgaagacaugcgaaaccacguucgccgccccaacaccacaauagcccccacgaucauaaccacgcuguugauggcgagcgccgucauggccggaccccucgaaaaccgcgaaacaaaucaccuacucaacagacccggcaacggcgcauacacacucuccgacuucgccgaaaguaccugcacccuggcuuacggaagcgaauguaaaagcugggaacaccaacuagacgagcuauccuuccccuucuuccacucgaaccuagacaaauacucuaugcuugaagccgccacggagaccauaccaauacucaacaaaagcucagccgucugcacuaucucgcccucaacccacagcagcaacgcaugcggccgugaggcaucgcucauuaaaaagaaaugcgguagcgauaugagcgcguucuucuacgucaaccucgcgggucagauuaccguagucaaaugcgacaccaaccacguacuaucaaacgacugcggaaacuguaucuccaaaacgcucagcggccagaaaauauauacccccguccaagacauguucugccaaaaaggaugguccgaaagcaucccgagcacacgcuacuccaaagaccuuugcuccaucggacuacacacagucaaagaaugcaagauaggaaccaccaacuucgaacgaguaggguucaucguuguaaaaggcagaaaaauguacaucgagcagaugaaaaugcggagccgccaagaguucuccgaagaccaauuccucugcuacaaaucagaaggcagcucgggcucaagcguaaaacucaaaaaggucaaagucgaaagcuguaaagguguuacaacaucaucggcuucaaagugcagcggggacgaauacuucuguagccgcuacccaugcgaaaccgcgaacguugaagcccacuguauccuucgacgucauagugcuguaaucgaagugaacguaaacggcguaugggucguaccaagaugcaucggguacgaagaaguguugguaagacgcacaucacucaaaguagaagacaccucaagccgcgaaugcgacacaugccucugggaauguggcaagaacaaauuaaucgucaagacgcauggcccgaagauuguuuacgccacagccugcucacacggauccugcaaguccguaaugcagaaaccugcaacauucguauaucucccauaccccgguaacagcgaaaucguaggaggcgacauugggguccacaugacagaggaaagcucacccuccaauauacauauggucgcccacuguccagccaaagacagcugcgaagugucgagcugccuauuuugcguacacggucuacucaacuaccagugccacacacuuuucuccgcccuacuuauuagcacaaccgucauguccauucuaacauuguuacuucuccuaguaaaaggcgccaaagaccuagucaaacgacucuucuacuggcucaucaccccgcuaugcuggcuauccguguucugcggauggaugauccgauccuggaagaaacguguaggaagcgccauuagccgcaccaacgacacgauaggcuggcgggacaacaguagacgaggucaggacaucgaacgcgcccaguacaccggcggagcgcccggcgcaaaauauaguuucuacggugucaugauccucggccuacucggcaauguacacucauguuccgaauccaucauagcugacucgaagauaaugcagugcacaaccagcgggucguccacacucuguaaagcguccggcacaguuaucaugaaacuaggaccgauaggcucggaaucaugccugauccucaaagggcuaaaagacagugagaagcaguuuaucucuaucaaaaccauaucuucagaacuaacgugccgcgagggcgagagcuucuggacgacccuauacacaccggucugccuaagcucaagacggugccaucucaugggcgagugcguuagcgaccgaugucuacguuggaaaacaaacgaaacauccgccgaauuuaccgguaaagcccacggagaagucaugcaugaaaaccgcugcuucgaacaaagcggaggcaucggauaugggugcuucaacguuaacccaagcuguuuauacguccacagcuaucuaaaaucaguauacaaaaacggcuuuaaaaucuucagaugcgucgcguggaaccaucgaauccgccacgaagucaccacucacaguagaaaauucccaauggucuuaauggcuaugucgacccagccaaccgacuggggcucaauaggccugauccucgauuccggaggaauaacgggcacgaaugcauacagcuucaugaaacacggacugggcagcuucgcgauaaucgaugaccccuacucacccgaacccagaaaaggauuccuaggagagguccgaugccccacagaagaaacagccauccgcgccagucccagcugcaagauggcccccaaccuaaucgaauaccaaccugaaauggacacagccgagugcaccaccaacaugaucgaccccauggcaauuuuuaaccgcggaucacucccccaaguucgggacggaaugacguucacccaaucaaucgagaagaauacaguccaagcccugaccaccggagaaguuagggcaagcaucaggcucacacuagaugacuacgauguaguguaccaaaacucccaauucgacugcagcgcgaccuucaaaaauuugacgggauguuacucaugcgacgagggcagcaggaugugcuaccaagucaaagccgagggggaaacaaucuuccacuuugucaacgaggacgaaucuaucaaugucaucaacaaagucucaccggacguauccgacuacugcaccguacuccacuucucucgaccagucauuagcauagagggcagguacgacugcggccuuaguaagcgacccauggucaucaaaggcacacucaucgcaaccgcaccccacgacgaccgcaaacacgaaggcgguuccagccugguugucaauccaaaaggcggaacggucgacuucuucggaugggugagcggccuaacuucuuggcucgggggaccacuaaaaacuuuccugacgauccuaggcuuccucgcccucggccuccugcucguaguuaucaucaucaucaucgcccgcacaggugucgagcaagccuugaagaaaaagaauaaauga

SEQ ID NO: 16348 - RNA, 4014 nt, Artificial Sequence
  derived and/or modified CDS sequence (opt11) from TOSV(SI-40463)__EU003176.1__GP
auguucaucgccaagcuguuacugaucagcugccuggugcagcaggccuaccucaaguacaccaucaucuccgagauaggcaacgggacccgcacgucguucugcuacucuagccggaccucccugggcagcuugcucgaggcgugggacaacaucaccgaguccaucgggcugaccagcggcacgugcaaggucgggucccuggagaaccgcgagugcaagcgggacaucaugagcaacuauguggccgagguacacuccaaccuccacggccugggagccaugaugcauaacuacggggacgacaagcgcgucgaggugcugaacgacguaauccccgaugagcucaacccgggccggcacaacugcagcgaccuggaccgcaagcccuucuggacagaguucauaaacgucgccaagcccgugaacgagauggcccccauguccgugaucccgccgcccauugucaagcccauccccguugcggagagcacaaccaaaaagaccauccccuucgacaagcugcucagcgaggccgagaaggagcuuaaccaaaccaagauccggcuggaaaccgagcgcagaagcaacgccgaggaggccgcgaaggagagggcccggaugcgcgagaucgaggauaagcuccggaaggacugggagcuugagcgcgagcggaaggacgcuguugccgaggaccuugccaaggaaaucgcgcgccggagagagaucgagcggaaggcccacgagcuggacaagaugcugaagaagaaggagcgcgaggaccuggucgcccgggagcgcguggaugaggacaugcgcaaucaugugcggcgccccaacacgacgaucgcgcccacgaucaucacuacccuccuuauggccuccgcggugauggccgggccgcuggagaaccgggagacgaaccaccuccugaaccgccccggcaacggggccuacacucugucagacuucgccgaguccacgugcacccucgccuacggcagcgaaugcaagagcugggagcaccaguuggacgagcuguccuuccccuucuuucacagcaaccucgacaaguacuccaugcucgaggcggccacggagaccauccccauccugaacaagagcuccgccgugugcaccauaucaccguccacgcauagcuccaacgccugcggccgggaggccagccucaucaagaagaaaugcggguccgacauguccgcauucuucuacgugaaccuggccggccagauuacggucgugaagugcgacaccaaccaugugcuuuccaacgacugcgggaacugcaucagcaagacccucaguggccagaagaucuacacccccguccaggacauguucugccagaagggcuggagcgaguccauccccagcacucgcuacuccaaggaccuaugcagcaucgggcugcauaccgugaaggagugcaaaaucggcaccacuaacuucgagcgggugggguucaucgucgucaagggucgcaagauguacaucgagcagaugaagaugcggagccgccaggaguucuccgaggaccaguuccucugcuacaaguccgagggguccagcggaagcagcgucaagcugaagaaagugaagguugaguccugcaagggcgucacgaccagcuccgccagcaagugcuccggggacgaguacuucugcagccgguaccccugugagacggccaauguggaggcgcacugcauccuucgccggcacuccgccgugauagaagucaacgugaacggcguguggguggugccgcgcugcaucggguacgaggagguacucguccggcgcacaagccugaagguggaggacacguccagccgggagugcgacacgugccugugggagugcggcaagaacaagcucaucgugaagacccacggccccaagaucgucuacgcgaccgccugcucccacggcagcugcaagagugugaugcagaagcccgccaccuucguguacuugcccuacccgggcaauuccgagaucgucgggggcgacaucggcgugcacaugaccgaggagagcucccccucgaacauccacaugguugcgcacugccccgccaaggacuccugugaggucagcuccugccuguucugcgugcacggccugcucaacuaccagugccacacccuguucagcgcccugcucaucuccaccaccgugaugagcauccugacgcugcuccugcugcucgucaagggggcaaaggaccuggugaagcgccuguucuacuggcucaucacuccccugugcuggcuguccguguucugcggcuggaugauccggagcuggaagaagcgcgucggcuccgccaucagccgcaccaacgacaccaucggguggcgggacaacucccgccggggccaggauaucgagcgcgcgcaguacaccggcggcgcuccgggcgccaaguacagcuucuacggggugaugauccucggucugcuggggaacguacacuccugcagcgaguccaucaucgccgacuccaagauuaugcagugcacaacgagcggcuccagcacccucugcaaggccuccggcaccguaaucaugaagcugggccccaucggcagcgaguccugucugauccucaaggggcugaaggacagcgagaagcaguucaucuccaucaagaccaucucauccgagcugaccugccgggagggcgagagcuucuggaccacgcucuacacccccguaugccuguccucccgccggugccaccugaugggggagugcguguccgacagaugccuccgguggaaaaccaacgagaccagcgcggaguucacgggcaaggcacacggggaggucaugcacgagaaccgcugcuucgagcaguccggcggcaucggguauggcugcuucaacgugaacccgagcugucuguacgugcacuccuaccucaaaagcgucuacaagaacggguucaagaucuuccggugcguggccuggaaucaccgcauccgucuggaggugaccacccacucccgcaaguuccccaugguccuaauggccaugagcacccagcccacggacuggggcagcaucgggcugauccucgacuccggcggcauaacggggaccaacgcuuacagcuucaugaagcacggccugggguccuucgccaucauagacgacccguacagcccggagccccggaagggcuuccugggcgagguacgcugccccaccgaggagacugccauccgggccucccccagcugcaagauggccccgaacuugaucgaguaccaaccagagauggacaccgcggaaugcaccaccaacaugaucgaccccauggccauuuucaaucgcggcucccugccccaggugcgggacggcaugacguucacccagagcauagagaaaaacaccguccaggcccuuacaacgggggagguucgcgccaguauucggcuuacgcuggacgacuacgacguugucuaccagaacagccaauucgacugcuccgccacauucaagaaccugaccggcugcuacagcugcgacgaggggucccgcaugugcuaccaggugaaggcggagggcgagaccaucuuccauuuugugaaugaggacgagagcaucaacgucaucaacaagguguccccggacgugucugauuacugcacgguccuccacuucuccaggcccgugaucucgaucgagggccguuacgacugcgggcuguccaagcgccccauggucauaaagggcacguuaaucgccaccgcgccgcacgacgaccggaagcacgagggcgggagcagccucguugugaacccgaaaggcgggaccguggacuucuucggcuggguguccggacugacgagcuggcugggcgggccccuuaaaaccuuucugacuauccugggcuuccucgcccuggggcugcuccugguggucaucaucaucaucaucgcccgcaccggcguggagcaggcccugaagaagaagaacaaguga

SEQ ID NO: 16349 - RNA, 4020 nt, Artificial Sequence
  derived and/or modified CDS sequence (opt11) from TOSV(SI-40614)__EU003177.1__GP
auguucauugccaaguuacuccucaucagcugccuggugcagcaggccuaccucaaguacacaaucaucuccgaaaucgggaacgggacccgcacgagcuucugcuacuccagccguaccucccugggcagccugcucgaggcaugggacaacaucaccgaguccaucgggcugaccagcggcacaugcaagguagggucccucgaaaaccgcgacugcaagcgggacaucaugagcaacuauguggccgaggugcacuccaaccuccacggccugggcgccaugaugcacaacuacggggacgacaagcgcgucgaggugcugaacgacgugauccccgacgagcucaacccgggacggcacaauugcagcgaucucgaccgcaagcccuucuggaccgaguucaucaacgucgccaagcccgccaacaagaucgcgccaauauccgugaucccgccgcccaucgucaagcccauccccaucgccgagagcaccaucaagaagaccauccccuucgacaaguugcucuccgaggccgaaaaggaguuaaaucagacgaagauccggcuggagaccgagcgccggagcaacgcuggggaggcggcccgugagcgggcccgcaugcgggaaaucgaagacaagcuccgcaagaacugggaacuggagcgggagcgcaaggacgcuguagccgaugaucuggcgaaggagaucgcacggcgccgggagaucgagcgcaaggcccacgaguuggacaagaugcugaagaagaaagagcgggaggaccagguagccaucgagcgcgucuccgaggacaugcgcaaccacguccggcgccccaacaccaccaucgcccccgcgccgacgaucaucaccacccugcucauggccagcgccgugauggccggcccguuggagaaccgggagaccaaucaccuccugaaccgccccgggaacggcgccuacacucugucggacuucgcggagagcacaugcacucuggccuacggcagugagugcaaguccugggagcaucaguuggacgagcugagcuuccccuucuuccacuccaaccuagacaaguacagcaugcucgaggccgccaccgagaccauaccgaucuuaaacaagagcagcgccgugugcaccaucucccccagcacacacaguagcaacgcgugcgggcgggaggccucacuaaucaagaagaagugcgggaacaacaugagcgcguucuucuaugucaaucuugccgggcagaucaccguggugaagugcgacacgaaccacguccuguccaacgacugcggcaacugcaucagcaagacuuuauccgggcagaagaucuacacccccgugcaggauauguucugccaacgcggguggacagaaagcaucccauccacgcgguacagcaaggaccucugcuccaucggccugcacacagugaaggagugcaagaccggggcgaccaacuucgagcgcgucgguuucaucguggucaagagccgcaagauguacaucgagcagaugaagaugcgcagccggcaggaguucuccgaagaccaguuucuaugcuacaagucugagaguuccuccgggagcuccgugaaacuuaagaaagugaaggucgagagcugcaaaggcguaacgaccuccagcgccuccaagugcaguggcgacgaguacuucugcucacgguacccgugcgagaccgccaacguggaggcccauugcauccuucggcgccauagcgcgguaaucgaggugaacgugaacggggucuggguggugcccaggugcauuggcuacgaggagguccuggugcgccggaccucccucaagauggaagauacgagcucccgcgagugcgacacgugcuugugggagugcgggaaaaacaaacugaucgugaagacccacggccccaagaucgucuacgcgacggcuugcucucacggaagcugcaaguccguaaugcagaagcccgcuaccuucguguaucuaccauaccccggcaauagcgagaucgucggcggggacaucggcgugcacaugacagaggaguccucgccauccaacauccacaugguggcccacugcccugccaaggacagcugugaggucuccagcugccuguucugcgugcacgggcugcugaacuaucagugccacacccucuuuuccgcgcugcugaucagcacaaccgugaugucuauucucacccuucugcuccugcuggucaagggcgccaaggaucugguaaagaagcuguucuacugguugaucaccccgcucugcuggcugucaguguucugcggauggaugaucaaguccuggaagaagcgggucggcagcgccaucucccgcaccaaugacaccauaggcuggcgcgauaaccggcguuaugggcgggacguggagcgcgcccaguacacgggcggggugcccggagccauauacagcuucuacggcgucaugauccugggucuccuggguaacgugcacuccugcucagaguccgugauagcugacaguaaggucaugcaaugcaccaccagcggguccagcacccugugcaaggccuccggcacggugaucaugaaguuggggccuaucggcagcgaguccugcuugauucugaagggccucaaggacaacgagaagcaguucaucagcaucaaaacgaucuccucagaacugaccugccgggaaggggaguccuucuggaccacgcuguacaccccggugugcuuguccuccaggcgcugccacuugaugggcgagugcguuagcgaccggugccuaaaguggaagacuaacgagacaucccccgaguucacgggcaaggcccacggggaagugaugcacgagaaccgguguuucgagcaguccgggggcaucggcuacgggugcuucaacgugaaucccuccugccucuacguccacagcauccugaaguccguguacaagaacggcuucaagaucuuccgcugcguggcauggaaccaccggauccgccuggaggucaccacccacagccggaaguuccccauggugcucauggcgauguccacacagccgaccgacugggggucuaucggccugauacuggacagcgaggggauaaccggcaccaacgcuuacuccuucaugaagcacggcagcgguuccuucgcgaucauugaugaccccuacagccccgaaccccgaaaaggcuuccucggggaggugcggugcccgaccgaggagacggcgauccgcgccuccccuagcugcaagauggcgcccaaccugauugaguaccagccugagauggacaccgccgaaugcaccaccaacaugauugacccgauggccaucuucaaccgggggucuuuaccccagguccgcgaugggaugacauucacucagagcaucgagaagaacaccgugcaggcccucaccaccggagaggucagggcguccauccgccugacauuggacgacuacgacgucguguaccagaacagccagucagacugcagcgcgaccuuuaagaaccucaccggcugcuacuccugcgacgaggggagccggaugugcuaccaggugaaggccgagggcgagaccaucuuccauuucgucaacgaagacgagaguaucaacgugaucaacaagguaagccccgacgucuccgacuacugcacggugcugcacuucagucgccccgucaucuccaucgaggggcgcuacgacugcggacugagcaagcggccgaugguaaucaaggguacucuuaucgccacagcgccccacgacgaccgcaagcacgaaggcgggagcucccuggucguaaaccccaaaggcgggacgguggacuucuucgggugggugagcggccugacguccuggcucggcgggcccuuaaagaccuuccuuacaauucucggcuucuuagcccuggggcuccugcuggucguuauuaucaucaucaucgcacggaccggcguggagcaggcccucaagaaaaagaauaaguaa

SEQ ID NO: 16350 - RNA, 4014 nt, Artificial Sequence
  derived and/or modified CDS sequence (opt11) from TOSV(SI-51903)__EU003178.1__GP
auguucauagcaaaacuacuccuaaucuccugccucguccaacaagccuaccucaaauacacaauaaucagcgaaauagggaacggcacgcgaaccuccuucugcuacagcucgagaacuagccucgggucgcuguuggaagcgugggacaacaucaccgaaucaaucgggcugacaucagggaccugcaaagucggcuccuuagaaaaccgagaaugcaaacgagacaucauguccaacuacguagcagagguucauuccaaccuucacggucugggagccaugaugcacaacuacggcgacgacaaacggaucgaaguccuuaacgauguuauaccagacgaacugaaucccgggagacacaacugcucggauuuagaccggaaacccuucuggacagaguucauaaacguagcaaaaccggcaaacgaaauagcgccaauguccgugauucccccaccaaucgucaaaccaauaccggucgcagaaucgacgacgaagaaaacaaucccauucgacaaacuccucagcgaagccgaaaaagaacucaaucaaacaaaaauccgacucgaaacagaacgacgaucaaacgcugaggaggccgcgaaagaacgcgcucgaaugcgagaaaucgaagacaaacuccgaaaagauugggagcuggaacgagaaaagaaagacgcagucgcagaagaccuagcuaaagaaaucgcccgacgaagagagauugaacgaaaagcccacgaacucgauaaaaugcucaaaaagaaagaacgcgaagaccucguggcccgcgaacgcgucgacgaggacaugcgcaaucacgugcggcgccccaacgcaacgaucgcccccaccaucauaaccacacuucuaauggcgagcgcagugauggcgggcccccuagaaaaccgagaaaccaaucaccuacugaaucgccccggcaauggggcauauacacuaucggauuucgccgagagcacaugcacacucgcguacggaucugaauguaaauccugggagcaccaacuggacgaacucuccuucccauucuuccauucuaaccuugacaaauacuccaugcucgaagcagccacagagacaauccccauccuaaacaaguccagcgccgugugcacgauaucuccaucaacccacagcagcaacgcaugcggccgcgaagcaucacucauaaagaagaaauguggcagcgacaugucagccuucuucuacgucaacuuggcuggacaaaucacagucguuaaaugcgauaccaaccacguccuaucaaacgacugcggcaacugcauaagcaaaacccuauccgggcagaaaauauauacccccguccaagacauguucugccaaaagggauggucagaaucgauccccuccacucgcuacucgaaagaccucugcuccaucggacugcacacuguaaaagaaugcaaaauaggaaccaccaacuuugaacgaguaggcuucaucguaguaaaaggccgcaagauguauaucgaacaaaugaaaaugcgcuccagacaagaguucagugaagacgaauuucucuguuacaaauccgaaggauccucaggcucaagcgugaaacucaagaaagugaaaguagaaagcugcaaaggcguaacgacgagcagcgccucaaaaugcagcggcgacgaauacuucugcucccgauacccgugcgaaacagcgaacguggaggcacacugcaucuugcgcagacacucggccguuaucgagguaaacgucaacggaguuugggucgucccacggugcaucggauacgaagaaguccugguccgcaggaccucacugaaaguagaagacaccagcucccgcgaaugcgauaccugccugugggagugcggcaaaaacaaacucaucgucaagacccaugggcccaaaauaguauaugccacagcuugcagccacggaagcuguaaauccguaaugcaaaaaccggccaccuucguauaccugcccuacccggggaacucggaaaucgucggcggcgacauuggaguucacaugaccgaagaaagcucacccucaaacauacauaugguagcccacugccccgccaaagacucaugcgaaguaucaagcugccucuucuguguacacggacuccuuaacuaucaaugucauacucuauucagcgcgcuccucaucagcaccaccgucaugucgauacuuaccuugcuucuacuccuaguaaaaggagccaaagaccuggucaaacgacucuucuacuggcucaucacaccucucugcuggcuauccgucuucugcggauggaugauacgaucuuggaagaaacgcgucggcucugccaucucaaggacgaacgacaccaucggauggcgggacaacucuagaaggggccaagacguggagcgggcgcaauauaccggcggggcuccaggagccaaauacagcuucuacggugugaugauccuaggccuccucggaaauguacacucaugcucggaaucaaucaucgcagacagcaaaauaaugcaaugcacuacuuccggcagcucaacucuuugcaaagcauccggaacgguuaucaugaaacuaggccccauuggaucagaaagcugccugauccuaaaaggacuaaaggacucagaaaagcaauucauaucgaucaaaaccaucucguccgaacuaaccugccgagaaggugaguccuucuggacgaccuuauacaccccgguauguuugagcucgcggcgaugccaccucaugggagaaugcguaagcgaccgcugccuccgcuggaagacuaacgagacaagcgcagaauuuacugguaaagcccacggagaagucaugcacgaaaacagaugcuucgaacaaucgggaggaauuggcuacggcugcuucaacguaaacccguccugccucuauguacauagcuaccucaaaucagucuacaaaaacggcuucaaaauauuccgcugcgucgcuuggaaccaucguauacggcucgaagucacaacacacagcagaaaauucccuauggucuuaauggcaauguccacccaacccaccgacuggggcuccaucggccuaauacuagacagcggcgggaucaccgguaccaacgccuacuccuucaugaagcacggccuuggcaguuucgcaauaauagacgaccccuauagcccugaaccgcgcaaaggcuuccucggcgaaguaagguguccgacggaagaaaccgcgauacgggccuccccauccugcaaaauggccccaaaccuaauagaguaucaacccgagauggauaccgcggaaugcaccaccaacaugaucgaccccauggcgauuuucaacagaggcagccugccccagguacgggaugggaugacauucacacaaagcauugagaaaaauacuguacaggcccucaccaccggcgaaguucgcgcuagcauccgacuaacccuagacgacuacgacgucguauaucaaaacagccaauucgacuguuccgccacauucaagaaccucacaggauguuauucgugcgacgaagggcccaggaugugcuaccaaguaaaagccgaaggcgaaacuauauuccauuucguuaacgaagaugaguccaucaacguuaucaacaagguaagccccgaugugucugacuacuguaccgugcugcacuucucccgcccagucauauccaucgaaggccgauacgacugcggacuaagcaaaagaccaauggugaucaagggcacacucaucgccaccgccccacacgacgacagaaaacacgaaggcggaagcucacucgucguuaacccaaagggaggcaccgucgauuucuucgguugggucagcgggcugaccuccuggcuaggaggcccacucaaaaccuuccucacaauacuuggcuuccucgcccuaggccuccugcucgucgucaucauuauaaucaucgcgcguaccgguguagaacaagcccucaaaaagaaaaauaaauag

SEQ ID NO: 16351 - RNA, 4014 nt, Artificial Sequence
  derived and/or modified CDS sequence (opt11) from TOSV(SI-68809)__EU003179.1__GP
auguucaucgccaagcugcuccucaucagcugccuggugcaacaggccuaucucaaguauaccauuaucuccgagauuggcaacgggacccgcacgagcuucuguuacuccagccggaccucccugggcagccugcucgaggccugggacaacaucaccgaguccaucggacugaccagcggcacguguaagguugggucccuagagaaccgcgagugcaagcgggauaucaugagcaacuauguggccgaggugcacuccaaccuccacggccugggcgccaugaugcacaacuacggggacgacaagcgcauugagguccugaaugacgugauucccgacgagcuaaacccgggccggcacaacugcuccgauuuggaccgcaagcccuucuggacagaguucaucgacguggccaagccagcaaaugagaucgcgcccauguccguuaucccgccucccaucguuaagcccaucccuguggccgagagcacaaucaagaagaccauccccuucgacaagcugcucagcgaagccgaggaggaacugaaccagaccaagauccggcuggagaccgagcgccggagcaaugccgaggaggcggccaaggagcgcgcccggaugcgcgaaauagaggacaagcuccggaaggauugggagcuggagagggagcgcaaagacgccgucgccgaggaccuggcgaaggagaucgcccgccgacgcgagaucgagcggaaagcgcacgagcucgacaagaugcugaaaaagaaggagcgugaggaccugguagcccgcgaacgcgugaacgaagacaugcgcaaccacguccggcgccccaacaccaccauagccccgacuaucaucacuacccuccuaauggcguccgcggugauggccgggccgcuggagaaccgagagaccaaccaucuccugaaccgccccggcaacggggcguacacccugagugacuucgcugaguccacgugcacacucgcguacggaagcgagugcaagagcugggagcaccagcuggaugaacuguccuucccguucuuccacagcaaccucgacaaauacuccaugcuggaggccgccaccgagacgauccccauccugaacaagagcuccgccgugugcacaauuagcccguccacccauucauccaacgccuguggccgagaggcgagccucaucaagaagaagugcggguccaacaugagcgccuucuuuuacgucaaccuggccggccagaucacuguggugaagugcgacacgaaccacguccuguccaacgacugcgggaauugcaucagcaagacccucagcggccagaagaucuacacccccgugcaggacauguucugccagaagggcuggagcgaguccauccccagcaccagauacuccaaggaccugugcagcauugggcugcacacgguuaaggaaugcaagaccggcaccaccaacuucgagcgggucggcuuuauagugguuaaaggccgcaagauguacauagagcagaugaagaugcggagccgccaggaguucuccgaagaccaauucuugugcuacaagucugaaggguccagcggaucuagcguuaagcugaagaaagugaaagucgaguccugcaagggcgugacgaccagcuccgccuccaagugcucaggggacgaguacuucugcagccgguaccccugcgagaccgcaaacguggaggcccacugcauccugcgccggcacuccgccgucaucgaggugaacgugaacggcgucuggguggugccgcgcugcauaggguaugaggagguccucgugcggaggaccagccugaagguggaagacacgucaagccgggagugcgacacgugccugugggagugcggcaagaacaagcucaucgucaagacacacgguccuaagaucguguaugcgacugccugcucccacggcagcugcaagagcgugaugcagaagcccgcgaccuucguuuaccugcccuacccgggcaacuccgagaucgucgggggugacaucggggugcacaugaccgaggagagcucccccagcaacauccacaugguggcccacugucccgccaaagacuccugcgaggugagcuccugccuguucugcgugcacggacugcucaacuaccagugucauacccuguucagcgcauugcucaucuccaccaccgucaugagcauccugacacugcuccugcugcucgucaagggagccaaggaccuggugaagcgccuguucuacuggcucaucacgccccugugcuggcuguccgucuucugcggcuggaugauccggagcuggaagcgccgcgucggcuccgcgauuucccggaccaaugacaccauuggguggcgcgacaacucacggcgcggacaggacguggagcgggcccaguacaccgggggugccccgggcgcgaaguacagcuucuacggggucaugauccucggccugcugggggaggugcacuccugcagcgaguccaucaucgcagacagcaagauaaugcagugcaccaccucuggcuccagcacccucugcaaggccuccgggaccguaaucaugaaacugggccccaucgguucggaguccugcuugauccucaagggguuaaaagauuccgagaaacaguucaucuccaucaagaccauaagcuccgagcugacuugccgcgagggcgagagcuucuggaccacgcucuacacccccgucugccuguccagccggagaugccaccugaugggggagugcguguccgaccgaugccucaaauggaaaacuaacgagacaagcgccgaguucacgggcaaggcccacggagaggugaugcaugagaacagaugcuucgagcagucuggcggcaucggauacggcuguuucaacgucaaccccagcugccuguaugugcacuccuaccucaaaagcguguacaagaacggguucaagauuuuccggugugucgcuuggaaccaccgcauacggcuggaggugaccacccauucccgcaaguuccccaugguccugauggcgaugucgacccagccuacggacuggggcagcauagggcugauccucgacucuggcggcaucaccgggaccaacgccuacagcuucaugaaacacggccuggggagcuucgccauuaucgacgacccuuacagcccggagcccaggaagggcuuccugggggagguccgcugccccaccgaagagacugcuauccgggccucccccagcugcaagauggcgccgaaccucaucgaguaccaacccgagauggacaccgccgagugcaccacaaacaugaucgaccccauggccaucuucaaccgaggcucccugccccaggugcgggacggcaugacguucacccagucgaucgagaaaaauaccgugcaggcccucaccacgggggagguccgcgccuccauccggcucacccuggacgauuacgacguaguguaccagaacagccaguucgacugcuccgcgaccuuuaaaaaccuuaccggcuguuacagcugcgacgaagggucccgcauguguuaccagguaaaagccgagggcgagacgauauuccacuuugugaacgaggacgagagcaucaacgugaucaacaaggucuccccggacgugagcgacuauugcacgguacuccacuucaguaggcccguuaucagcaucgagggcagauacgacugcgggcuguccaagcgccccauggugaucaagggcacccugaucgccaccgcgccccacgacgacaggaagcacgagggcggguccucuuuagucgugaacccgaagggcgggacuguggacuucuucggcugggucuccgggcugacgagcuggcugggcgggccccucaagacauuccucaccaucuuaggcuucuuggcccuuggauuacuccuggugguaaucaucaucaucaucgcccgcaccggcgucgagcaagcccuaaagaagaagaacaaguga

SEQ ID NO: 16352 - RNA, 4014 nt, Artificial Sequence
  derived and/or modified CDS sequence (opt11) from TOSV(SI-76082)__EU003180.1__GP
auguucaucgccaagcugcuccugaucagcugccuggugcagcaggccuaccucaaguacaccaucaucuccgagaucggcaacgggacccgcacgagcuuuugcuacuccagccggaccucccugggcagccuguuagaggcgugggacaacaucaccgaguccaucgggcugaccagcggcacgugcaaggucgggucccucgaaaaccgcgagugcaagcgggacaucaugagcaauuacguugccgaggugcacagcaaccuccacggccugggcgccaugaugcacaacuacggggaugacaagcgcaucgagguccugaacgacgugauccccgacgaacucaacccgggccggcacaacugcagcgaccuggaccgcaagcccuucuggaccgaguucauaaacguggccaagcccgccaacgagauggcgcccauguccgucaucccgccucccaucgugaagcccauccccguggccgagagcaccaccaagaagacuauccccuucgacgagcugcucuccgaggccgagaaagagcugaaccagaccaagauccggcuggagaccgagcgccggagcaacgccgaggaggcggccaaggagcgcgcccggaugcgcgagaucgaagacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggaacgcgaagaccugguggcccgggagcgcguggacgaagacaugcgcaaccacguccggcgccccaacaccacgaucgcccccaccaucaucaccacccuccugauggcguccgccgugauggccggaccgcuggagaaccgggagacgaaucaccuccugaaccgccccggcaauggggccuacacgcugagcgacuucgccgaguccacgugcacccucgcguacggaagcgagugcaagaguugggagcaccaacuggacgagcuguccuuccccuucuuccacagcaaccucgacaaguacuccaugcuggaggcagccacggagaccauccccauccugaacaagagcuccgccgugugcaccaucagcccgucuacccacagcuccaacgcaugcggccgggaggcgagccucaucaagaagaagugcggguccgacaugagcgccuucuuuuacgucaaccuggccggccagaucacgguggugaagugcgacaccaaccacguccuguccaacgacugcgggaacugcaucagcaagacccucuccggccagaagaucuacacccccgugcaggacauguucugccagaagggcuggagcgaguccauccccagcacacgcuacaguaaggaccuguguagcaucgggcugcacaccgugaaggagugcaagaucggcaccaccaacuucgagcggguuggguucaucguggugaagggccguaagauguacaucgagcagaugaagaugcggagccgccaggaguucuccgaggaccaguucuugugcuacaagagcgagggguccagcgguuccagcgucaagcugaagaaggugaaggucgaguccugcaagggcguaacgaccagcuccgccagcaagugcuccggggacgaguacuucugcagccgguaucccugcgagaccgcgaacguggaggcccacugcauccugcgccggcacuccgccgucaucgaggugaacgugaacggcgucugggugguaccgcgaugcaucggguacgaggagguccucgugcggcgcaccagccugaagguggaggacacgucaagccgggagugcgacacgugccugugggagugcggcaagaacaagcucaucguuaagacccacgggcccaagaucguguaugccaccgccugcucccacggcagcugcaaaucagugaugcagaagcccgcgaccuucgucuaucugcccuacccgggcaacuccgagaucgucgggggcgacaucggggugcacaugaccgaggagagcucccccagcaacauccacaugguggcccacugccccgccaaggacuccugcgaggugagcuccugccuguucugcguccacggccugcucaacuaccagugccacacccuguucagcgcccugcucaucuccaccaccgucaugagcauacugacgcugcuccugcugcucgugaagggggccaaggaccuggugaagcgccuguucuacuggcucaugacaccccugugcugguuauccgucuucugcggcuggaugauccggagcuggaagaagcgcgugggcuccgcgaucagccgcaccaacgacaccauuggguggcgcgacaacucccgcagaggccaggacguggagcgcgcccaguacaccgggggcgccccgggcgcgaaguacagcuucuacggggucaugauccucggccugcugggcaacgugcacuccugcagcgagucgaucaucgccgacagcaagaucaugcagugcaccaccagcggcucaagcacccucuguaaagcguccgggaccgugaucaugaaacugggccccaucggcagcgagagcugccugauccucaaggggcugaaggacagcgagaagcaguuuaucuccaucaagaccaucagcuccgagcugaccugccgggagggcgagucauucuggaccacgcucuacacccccgucugccuguccagccgccggugccaccugaugggggagugcgugagugaccgcugccuccgguggaagaccaacgagaccagcgccgaguucacggguaaggcccacggggaagugaugcacgaaaaucgcugcuucgagcaguccggcggcaucggguacggcugcuucaacgucaacccgagcugccuguacguccacuccuaccucaagagcguguacaagaacggguucaagaucuuccggugcgucgccuggaaccaucgcauccggcuggaggugaccacccacucccgcaaguuucccauggugcugauggcgaugagcacccagccuacggacuggggcagcaucgggcugauccucgacuccggcggcaucaccgggacgaacgcauacagcuucaugaagcacggccugggguccuucgccaucaucgacgaccccuacagcccggagccccggaagggcuuccugggggagguccgcugccccacugaggagacggccauccgggccucucccagcugcaagauggcgccgaaccucaucgaguaccagcccgagauggacaccgccgaguguaccaccaacaugaucgaccccauggccaucuucaaccgcggcucguugccccaggugcgggacggcaugacguucacccagaguaucgagaagaacaccgugcaggcccugaccacgggggagguccgcgcguccauccggcucacccuggacgacuacgacguuguguaucagaacagccaguucgauugcuccgcgaccuucaagaaccugaccggcugcuacagcugcgacgaggggucccgcaugugcuaccagguaaaggccgagggcgagaccaucuuccacuucgugaacgaggacgagagcaucaacgugaucaacaaggucuccccggacgugagcgacuacugcacggugcuccacuucucccgccccgucaucagcauugagggccgguacgacugcgggcuguccaagcgccccauggugaucaagggcacccugaucgccaccgcgccccacgacgaccgaaagcacgagggcgggagcagccucgucgugaacccgaagggcgggacaguggacuucuucggcugggucuccgggcugacgagcuggcugggcgggccccucaagaccuuccugaccauccugggcuuucucgcccuggggcugcuccuaguggugaucaucauuauuaucgcccgcaccggcgucgagcaggcccugaagaagaagaacaaguga

SEQ ID NO: 16353 - RNA, 4020 nt, Artificial Sequence
  derived and/or modified CDS sequence (opt11) from TOSV(TOSV/Mantova.ITA/2013)__KM507329.1__GP
auguuuaucgccaagcugcuccugaucagcugccuggugcaacaggccuaccucaaguacaccaucaucuccgagaucggcaacgggacccgcacgagcuucugcuacuccagccggaccucccugggcagccugcucgaggcgugggacaacaucaccgaguccauagggcugaccagcggcacgugcaaggucggguccuuagagaaccgcgacugcaagcgggacaucaugagcaacuacguggccgaggugcacuccaaccuucacggccugggcgccaugaugcacaacuacggggacgacaaacgcgucgaggugcucaacgacgugauacccgacgagcucaacccgggccggcacaacugcagcgaccuggaccgcaagcccuucuggaccgaguucaucaacgucgcaaagcccgccaacaagaucgcgcccaucuccgugaucccgccgcccaucgugaagcccauccccaucgccgaguccaccaucaaggagaccauccccuucgagaaguuacucuccgaggccgaaaaggagcucaaccagacgaagauccggcuugagaccgagcgccggagcaaugccgaggaggcggcccgcgagcgggcccgcguccgggagaucgaggacaagcuccgcaagaacugggagcuggagcgggagcgcaaggacgccguggccgacgaccuggcgaaggagaucgcccggcgccgggagaucgagcgcaaggcccacgaacuugacaagaugcugaagaagaaggagcgggaggaccagguggccaucgagcgcgucucagaggacaugcgcaaccacgugcggaggcccaacaccaccaucgcccccgcgccgacgaucaucaccacccugcucauggccucagccgugauggccgggccccuggaaaaccgggagaccaaccacuugcugaaccgccccggcaacggggccuacacgcuguccgauuucgcggaaagcacgugcacccuagccuacggcagcgagugcaaguccugggaacaccagcuagacgagcugagcuuccccuucuuccacucgaaccuggacaaguacagcaugcucgaggccgccaccgagaccaucccgauccugaacaaguccagcgccguuugcaccaucucccccagcacccacuccagcaacgcgugcggccgggaggccucccugaucaagaagaagugcgggaacaacaugagcgccuucuucuacgugaaccucgcgggccagaucaccguggucaagugcgacacgaaccacgugcuguccaacgacugcgggaacugcuucagcaagaccuuguccggccagaagaucuacacccccgugcaggauauguucugccagcgcggcuggaccgagagcauccccucuacgcgguacagcaaggaccucugcuccaucgggcugcacaccgucaaggagugcaagaccggcaccacgaacuucgagcgcgugggguucaucguggucaagagccggaagauguacaucgagcagaugaagaugcgcagccggcaggaguucagcgaggaccaauuccugugcuacaagagcgaguccagcuccggcagcuccgugaaacucaagaaggucaagguggagagcugcaagggggugaccaccuccagcgcguccaagugcagcggcgacgaguacuucugcucccgcuacccaugcgagacggccaacgucgaggcccacugcauccugcggcgccacagcgccgugaucgaggugaacgucaacggcguguggguggucccccggugcaucggguacgaggaggugcuggugcgccggacgucccucaaaauggaggacacaagcucccgcgagugcgacacuugccugugggagugcggcaagaacaagcugaucgucaagacccacgggcccaagauaguguaugcgaccgccugcagccauggcagcugcaaguccgugaugcagaagcccgccaccuucgucuaccucccguaccccgggaacagcgagaucgugggcggcgacaucggggugcacaugaccgaggaguccucacccuccaacauccacauggucgcccacugccccgccaaggacagcugcgagguguccagcugccuguucugcgugcacggccugcugaacuaccagugccacacccucuucuccgcccuucugaucagcaccacggucauguccauccucacgcugcugcuccugcuggugaagggggcgaaggaccucgugaagaagcuguucuacuggcugaucaccccgcucugcuggcugagcgucuucugcggcuggaugaucaaguccuggaagaaacggguggggagcgccaucucccgcaccaacgacacgaucggcuggcgcgacaaccggagguacggccgggacguggagcgcgcccaguacaccgggggcgcccccggggccaaguacagcuucuacggcgucaugauccugggccuccuggggaacgugcacuccugcagcgaguccgugaucgcggacagcaaggucaugcagugcaccaccagcggcuccagcacgcugugcaaggccuccgggaccgugaucaugaagcucggccccaucgggagcgaguccugucugauccugaagggccucaaggauaacgagaagcaguucaucagcaucaagaccauauccagcgagcugaccugccgggagggcgagucguucuggaccacccuguacaccccggugugccucagcucccgccggugccaccugaugggggagugcgucagcgaccgcugccugaaguggaagaccaacgagacguccgcggaguucacaggcaaggcccacggggaggugaugcacgagaaccggugcuucgagcagagcggcgggaucggcuacggcugcuucaacgugaaccccuccugccucuacguccacagcuaccugaagucuguguacaagaacggguucaagaucuuccgcugcguggcguggaaccaccggauccgccuggaggucaccacccacagccggaaguuccccauggugcucauggccauguccacucagcccaccgacuggggcagcaucgggcugauccuggacagcgaggguaucaccgggaccaacgcuuacuccuucaugaagcacggcagcggcuccuucgccaucaucgacgacccguacagccccgagccccgcaagggguuucucggcgagguccgcugccccacggaggagaccgccauccgcgcguccccgagcugcaagauggcccccaaccugaucgaguaccagcccgagauggacaccgccgagugcaccacgaacaugaucgacccuauggccaucuucaaccgggggucccugccgcagguccgcgacggcaugaccuucacccagagcaucgagaagaacaccgugcaggccuuaacgaccggggaggugcgggcguccauccgccugacccuggacgacuacgacgugguguaccagaacagccagucugacuguagcgccacguucaagaaccucaccggcugcuacucuugcgacgagggcucacggaugugcuaccaggugaaggccgagggggagacgaucuuccacuucgucaacgaagacgaguccaucaacgugaucaacaaggugagccccgacgucuccgacuauugcaccgugcugcauuucucaagacccgucaucuccaucgagggccgcuacgacugcgggcugagcaagcggcccauggugaucaagggcacacucaucgccaccgccccucacgacgaccgcaagcacgagggcgggagcucccugguggucaaccccaagggcgggacgguggacuucuucggcugggugagcgggcugaccuccuggcucggaggcccccugaagaccuuccugaccauccucggguuccuggcccugggccuccugcuggucgugaucaucaucaucaucgcccggacgggggugcagcaggcccucaagaagaagaacaaguga

SEQ ID NO: 16354 - RNA, 4020 nt, Artificial Sequence
  derived and/or modified CDS sequence (opt11) from TOSV(TOSV/Phl.233/FR/2009)__HQ184337.1__GP
auguucaucgccaaguuacuccugauaagcugccugguucagcaagccuaccucaaguacaccaucaucuccgagaccggcaaugggacgcgcaccagcuucugcuacuccagccggacaucccugggcagccugcucgaggccugggacaaugucaccgaguccauagggcugacaagcgggaccugcaaggugggcucccuggagaaccgcgacugcaggaaagacaucaugagcaacuacguggccgaggugcacuccaaccuccacggccugggagccaugaugcacaacuacggggacgacaagcgcguggagaucuugaacgacgugauccccgacgagcucaacccgggccaccacaacugcagcgaccuggaccggaagcccuucuggacugaguucaucaacguggccaagccccugucagagaucgugcccaugagcgugaucccgccgcccgucgugaagccccagccgcccgccgagcccuccagcaagaaacacgugcccuucgacguucuccuguccgaggcggagaaggaguugaaccagaccaagauccgccucgaggacgagcgcaagagcaacgccgaggagacggccaaggagcgggcccggaugaaggagaucgaggacgagcuccgccgggagugggagcuggagaggaagcgaaaggacgcgauggccgacgaccucgccaaggagaccgcgcgccggagggagauugagcggaaggcccacgagcuggacaagaugcugaagaagaaggagcgcgagucccucaucgcgaaagagaaggcugacgaagauaugcggagccacgugcacaagcccaauaccacccgcgcgcccgcccccacgaucaucaccacccugcugauggccagugcggcauuggccgggccccuggagaaccgggaaaccaaccaucuccugaacaggccgggcaacggagccuacacgcuguccgauuucgccgagagcacgugcacccuggcguacggcuccgaaugcaagagcugggaacaccuguuaaacgaggaacuguuucccuucuuccauuccaaccucgacaaguacagcaugcuggaagccgccaccgagacgguucccauuuugaacaagagcucggccgucugcaccaucuccccuagcacccacuccagcaacgcaugcggccgcgaggcauccgugauccggaagaagugcuacagcaacauguccgccuucuucuacaucaaccucgccgggcagaucaccgugaucaagugcgagacgaaccacguccugagcuccgacugcggaaacugcaucagcaagucccuguccgggcagaaaguguacaccccggugcaggacgucuucugccagaagggcuggacccagucaauccccaguacccgcuacucgaaggauaucugcuccaucggccuccacacggugaaggagugcaagaucgggaccaccagcuucgagcgggugggguucaucgucgugaaagggcgcaagauguacaucgagcagaugaagaugcggucccgccaggaguacagcgaggaccaguuccugugcuacaaguccgagagcggcuccgggagcuccgucaaacuuaagaaguucaaggugcaguccugcaagggugugaccacguccagcgccuccaagugcagcggagacgaguacuucugcucccgguaccccugcgagacugcgaacgucgaggcccacugcauccuccgacgucacuccgccaucguggaggucaacgucaaugggguguggguggucccccgcugcaucggcuacgaggaggugcugguuaagcggaccagccugaaggucgaagacacuacggggcgcgagugcgacuccugccucugggagugcggcaagaacaagcugaucgucaagacccacgggccgaagguggucuacgccaccgccugcagccacgguagcugcaagucugugaugcagaagccugcgacuuucguguaccugcccuaccccggcaacuccgagaucgucggaggcgacauugggauccacaugaccgaggagagcuccccgagcaacauacaccugguggcccacugccccgcacgggacuccugcgacgugagugacugccucuucugcguccacggccugcugaacuaccagugccauacccucuucuccgcccugcugaucagcaccaccgugaugucgauccucacccugcugcuccugcuggugaagggggccaaggaccucgucaagaagcuguuccacuggcugaucacgccccucuguuggcugagcguguucugcugcuggguggucaaguccuggaagcgccgggugggcagcgcgaucucccgcaccaacgacaccaucggcuggagagagaaccgccgacacgcccaggacaucgagcgcgcccaguacaccgggggcgccccgggggccaaguacagcuucuacggcgugaugauccugggccugcuguccagcgcgcagagcugcuccgagagcgucaucgccgacuccaagaucaugcagugcaccaccagcggguccagcacccugugcaaggccuccgggaccgugaucaugcgacucgggccaauaggcucugaguccugccugauccugaaggggcucaaggacagcgagaagcaauucaucuccaucaagacgaucagcuccgaacugaccugccgggagggcgagagcuucuggaccacccuguacacgcccaucugccucuccagccgccggugccaccugaugggcgaaugcguguccgaccgcugcuuaaaguggaagaccaaccagacuagcgcggaguucaccggcaaagcgcacggcgacgucaugcacgagaaccggugcuucgagcaguccgggggcaucggguacggcugcuucaacgugaaccccucuugccucuacgugcacagcuaccuuaaguccgucuaccgcaacggcuucaagguguuccggugcguggccuggaaccaucgcauccggcuggaggucacgacccacagccgcaaguucccgauggugcucauggccauguccacccagcccaccgacuggggcagcaucggccugauccuggacuccgagggaauuacgggcaccaacagcuacuccuucaugaagcacgggagcggcuccuucgccaucaucgacgaccccuacagccccgagccucggaaggguuuccucggcgaggugcgcugccccaccgaggagaccgccaugcgggcgucccccagcugcaagauggcacccaaccugaucgaguaccagccggagauggacaccgccgagugcaccaccaacaugaucgaccccauggccaucuucaaccgcggaagucugccccagguccgggacgggaugaccuucacgcagagcaucgagaagaacacugugcaggcccucaccaccggagaagugaaggcguccauacgccugacgcuggacgacuacgacgucguguaucagaacucccaguccgacugcagcgccaccuucaagaaccucaccgggugcuacuccugcgacgagggcagccgacugugcuaccaggugaaggccgagggcgagaccauauuccacuucaucaacgaggaggagagcaucaacgucauuaacaaggugucccccggagugagcgacuacugcaccguccugcacuucucccgccccgugaucagcaucgaaggaacguacgacuguggacucuccaaacggcccauggucaucaagggcacccugauugccaccgcgccccacgacgaucgcaagcacgaaggugggagcucucugguggugaacccaaagggcgggagcgucgacuucuucggcuggcucuccgggcugaccagcuggcugggcggcccgcucaagacguuucugaccauucugggcuuccucgccgugggccugcugcucguggucaucaucauaaucaucauccggaccgggaugcagcaggcccugaagaagaagaucaaauga

SEQ ID NO: 16355 - RNA, 4020 nt, Artificial Sequence
  derived and/or modified CDS sequence (opt11) from TOSV(TOSV/Phl.51/FR/2009)__HQ184336.1__GP
auguuuaucgccaaacucuugcucaucucaugccugguccaacaagcauaccucaaauacacaaucaucagcgagauagguaacggaacgcgaaccagcuucugcuauagcucucgcaccucucuagguucccuccuagaagccugggacaaugugacugaaagcauaggacuaaccucggguacgugcaaaguaggcucacuagaaaaccgcgacugccggaaagacaucaugagcaacuacguugcagagguccacucuaaccuacauggcuugggcgcaaugaugcauaauuacggggacgacaaacgagucgaaauuuuaaaugacgucauucccgacgaacugaaccccggccaccacaacugcuccgaccucgaucguaaacccuucuggaccgaguucaucaaugucgccaagccccuaagcgaaauugucccuaugagugucauacccccacccgucgugaaauuacaaccucccgccgaacccuccucgaagaaacauguacccuucgacgugcuucucucagaagccgaaaaagaacuuaaccaaaccaaaauccgauuggaagacgaacgaaaaucaaacgccgaagaaaccgcaaaagaacgcgcgcgcaugaaagaaaucgaggacgaacugcgacgcgagugggaacuggagcguaagcgcaaggacgcaauggcagacgaccucgcgaaagaaacagcacgccgacgcgaaauagaccgaaaggcacacgagcucgaccguaugcucaaaaagaaggagagagaaagccuuauagccaaagagaaagccgacgaaaacaugcgcucgcacguccacgagcccaacaccacacgagcaccggcccccaccauaauaacgacccuacucauggcaucagccgcgcuagcgggcccgcuugaaaaccgagaaacaaaccaccuacuuaaccgcccaggaaacggcgcauacacccuuuccgacuucgcagagagcacaugcacgcucgccuauggguccgaaugcaagagcugggaacaccuacugaacgaggaacuguucccuuucuuucacagcaaccuagacaaauauucuaugcuagaagcagccacagaaaccgugcccauccuaaacaagagcucggccgucugcacaaucucaccgucaacgcacagcuccaacgcaugcggaagagaagccagcgucauccgcaagaaaugcuacuccaauauguccgccuucuuuuacauaaaccuggccggacaaauaaccgugguaaagugcgaaacuaaccacguccuaucauccgauugcggcaacugcaucuccaagucccucucaggccaaaaaguuuacacgccaguacaggacguauucugccagaaaggcuggacccaaagcauucccuccacacgcuacuccaaagacauaugcuccauaggccugcauaccguuaaagagugcaaaauuggcacuacaucuuucgaacgcguuggauuuauagucgugaaaggacguaaaauguacaucgagcaaaugaaaaugcgcagccgacaagaguauuccgaagaucaauuccuguguuacaaaucagaaucgggcucaggcuccagcguaaaacuaaagaaauucaaagucgaaucuugcaaaggagucacaaccucaagcgccagcaaaugcuccggcgaugaguacuucugcagcagauucccaugcgaaacggcgaacguagaagcccacugcaucuuacgccgccacagcgccaucguagaaguaaacgucaacggcgugugggugguaccgcgcuguaucggauacgaggaagugcuagucaaaagaacaucacucaaggucgaagacacaaccgaaagagagugcgacagcugccuaugggagugcgggaaaaacaaacucauaguaaaaacccacggcccgaaggucguguaugccacggccugcucacauggcucgugcaaaucagucaugcaaaaacccgccacguucguuuaccuacccuaccccggcaacucggaaaucgucggcggugauaucggcauccacaugaccgaagaaucaucccccuccaacauccaccuaguugcacacugucccgcccgagacagcugcgacguaucagacugucucuucugcguccacgggcuacucaacuaucagugucacacccucuucucggcccuccucaucagcaccaccgucauguccauccucaccuuacugcuacuacucgucaaaggcgcaaaggaucuaguuaaaaagcuauuccacuggcuaauaacaccccugugcuggcuguccguauucugcugcugggucgucaaauccuggaaacgccgcguaggguccgcaaucucccgaacaaacgacacaaucggauggcgagaaaaucgucgccacgcucaagauaucgaaagagcccaauacaccggcggggcccccggugcaaaguacagcuucuucggagucaugauccucgggcugcuaaguagcgcacaaagcugcucggagagcguaaucgcagacuccaagauaaugcaaugcaccacgucuggcucgucuacccuauguaaggccagcggaaccguuaucaugagacucggcccuauaggcagcgaauccugccuaaucuuaaagggccucaaagacucagaaaaacaauucauaagcaucaaaaccauaucaucagaacugaccugucgugaaggagagucuuucuggaccacucuauacacccccaucugccuuagcucccgacgaugccaccucaugggcgaaugcgucuccgauagaugucucaaguggaaaacaaaccaaacauccgcagaauuuacgggcaaagcucacggggacgucaugcacgaaaaccgcugcuucgaacaaagcggcgguauuggcuauggcugcuuuaacguuaacccguccugccuuuauguacacagcuaccuaaagagcguguacaggaacggguucaaagucuuucgaugcgucgccuggaaccaccggauacgccucgaggucaccacccacagucgaaaauucccuaugguccuuauggcuaugucaacucagccaacggauuggggcucgauaggccucauccuugacagcgaaggcaucaccggaaccaauucauacagcuucaugaaacacgggagcgguuccuuugcgauaaucgacgaccccuacucccccgaaccgcgcaaaggauuccucggggaagugaggugcccaaccgaggaaacggccaugagagcaagcccgagcuguaagauggccccaaaccugguagaguaucaaccggaaauggacaccgcagagugcacaacgaacaugaucgacccgauggccaucuuuaaccggggcagccuaccccaaguucgagacggaaugacauucacacaaucgaucgaaaagaacaccguacaagcacucaccacaggagaagugaaggcuagcauaagauuaacacuggacgacuacgaugucgucuaccaaaacucccaaagugacugcagcgcuacuuucaagaaccucacgggauguuacucaugcgaugaagggagcagacuaugcuaucaaguuaaagccgaaggcgagaccaucuuccacuucauaaacgaagaagaaucaaucaaugucaucaacaaagucucaccaagagucagugacuauugcaccgucuugcacuuuagucggccagucauaucaauagaaggaaccuacgacugcggccuuuccaagcgccccaugguaauuaaaggcacccuaaucgccacggcuccacacgaugaucgaaaacacgagggaggcucaucccucguaguaaacccaaaaggaggaucgguagacuucuuuggauggcuuucaggacuaacgucguggcugggcggcccccucaaaacguuccuaacuauacucggauuccuagcagugggcuuacuccuggucguuauuaucauuauaaucauccggacuggcaugcaacaagcgcugaaaaagaaaauuaaguag

SEQ ID NO: 16356 - RNA, 4020 nt, Artificial Sequence
  derived and/or modified CDS sequence (opt11) from TOSV(11368)__KU925897.1__GP
auguucaucgccaaacuguuacugaucagcugccugguacagcaggccuaccucaaguacaccaucaucuccgagaccggcaacggaacgcgcaccagcuucugcuacuccagccggacaucccucggcagccugcucgaggcgugggauaacgucaccgagagcaucgggcuaacgagcgggaccugcaaagugggcucccuggagaaccgcgacugccggaaggacaucaugagcaacuacguggccgaggugcacucgaaccuucauggcuuaggcgccaugaugcacaacuacggggacgacaagcgcguugagauccuuaacgacgugauacccgacgagcucaacccuggccaccacaacugcagcgaccuggaucggaagcccuucuggaccgaguucaucaacgucgccaagccccuauccgaaaugguacccaugagcgugaucccaccgcccgucgugaagcuccagccgcccgccgagcccuccagcaagaagcacgugcccuucgauguccugcugagcgaggcggagaaggagcucaaccagaccaagauccgccuggaggacgagcgcaaguccaacacggaggagaccgccaaggagcgggcccggaugaaggagaucgaggacgagcuccgcagggagugggagcucgagcgcaagcguaaggacgccauggcggacgaccuggccaaggagaccgcccgcagacgcgagaucgagcggaaggcacacgagcuggacaagaugcuuaagaaaaaggagcgcgaaucccugaucgcuaaggagaaggcggacgaggacaugagaagccauguucacaagcccaacaccacucgcgcccuggcccccaccaucaucaccacccuccugauggccucagccgcgcuggccgggccccucgagaaccgggagacgaaccaccuccuuaaccgccccggcaauggggccuacacccucuccgacuucgccgagagcacguguacccuggccuauggcuccgagugcaagagcugggagcaucugcucaacgaggagcuguuucccuucuuccacuccaaccuggacaaguacagcaugcucgaggccgccacggagaccguaccgauccucaacaagaguagcgccgucugcacaauuucccccagcacccacuccagcaacgccugcggccgcgaggcuuccgugauccggaagaagugcuacuccaacauguccgcuuucuucuacaucaaccuggccgggcagaucacagugaucaagugcgagaccaaccacguccucaguuccgacugcgguaacugcaucagcaagucccuuuccggacagaagguguacacacccgugcaggacgucuucugccagaagggcuggacccagucuauccccuccacgcgcuacagcaaggacaucuguuccauuggccugcacaccgugaaggagugcaaaaucgggaccaccucuuuugagcguguaggcuucaucgucguaaaggggcgcaagauguacaucgagcagaugaaaaugcggucccgccaggaguacagcgaggaccaguuuuuaugcuauaagucugagagcggcagcgggagcuccgucaagcugaaaaaguucaagguucagagcuguaagggcgucacgaccuccagcgcguccaagugcagcggcgacgaguacuucugcucccgguacccgugcgagaccgccaacgucgaggcacacuguauccugcgccggcacucggcuaucguggaggugaacguaaacggcguguggguggucccacgcugcaucggcuacgaggaggugcucgugaaacggaccagccugaagguggaagauacaaccgggcgggagugugacuccugccugugggaaugcggcaagaacaagcugauagugaagacccacgggcccaagguagucuacgcaaccgccuguagccacggcuccugcaagagcgugaugcagaagcccgcuaccuucguguaccuuccguacccaggcaacuccgagaucgucgggggcgacauugggauccacaugacggaggagagcuccccuucaaauauccaccugguggcucacugucccgcccgggacuccugugacgugagcgacugccuguucugcguccacggccuccugaacuaccagugucacacccuguucucggcccugcugaucagcaccaccguaaugaguauccugacgcuccugcugcuccuggugaagggggccaaggacuuagucaagaagcuguuccacuggcugaucaccccgcugugcuggcucagcguguucuguugcuggguggucaaaucauggaagcgccgggugggcagcgcgaucuccagaaccaacgauacuaucggcuggcgggaaaacagacgucaugcgcaagacaucgagcgcgcccaauacaccggcggcgcacccggggccaaguacagcuucuacggcgugaugauccuuggccugcucuccagcgcccagagcugcuccgagagcguaaucgcggacuccaagaucaugcagugcaccaccagcggguccaguacccugugcaaggccucuggcacggucaucaugcgacuuggacccauaggcagcgaguccugccucauccugaaggggcugaaggauagcgagaaacaguucaucuccaucaagaccaucagcuccgagcugaccugccgcgagggcgagagcuucuggaccacgcuguacaccccaauaugccuguccagccgucggugccaucugaugggcgagugcgugucagaccgcugccugaaguggaagaccaaccagaccagcgccgaguucacgggcaaggcccacggcgacguaaugcacgagaaccggugcuucgaacagagugggggcaucggguacggcugcuucaacgugaacccuagcugccuuuacgugcacagcuacuuaaaguccguauaucgcaacggauucaaaguguuucggugcguggcauggaaccaucgcauucggcuggagguuacgacccacagccgcaaguuccccauggugcugauggccauguccacacaacccacggauugggggagcaucggccucauccuggacuccgaggggaucaccgggacaaauagcuacuccuucaugaagcacggaagcggguccuucgccaucaucgaugaccccuacucacccgagccgcggaagggcuuccugggggaggugcgcugccccaccgaggagacggccaugcgggccuccccgagcugcaagauggcgcccaaccucaucgaguaccagcccgagauggacaccgccgaguguaccaccaauaugaucgacccuauggcgaucuucaaccgcggcucccugccgcagguccgggacgggaugacguucacccagagcaucgagaagaacaccgugcaggcccugaccacgggcgaggugaaggccuccauccgucucauccucgacgacuacgacgugguguaucagaacagccaguccgacugcagcgcaaccuucaagaaccuuaccgggugcuacuccugcgacgagggcagccggcucugcuaccagguaaaagcggaaggcgagaccaucuuccacuuuaucaacgaggaagagagcaucaacgucaucaacaagguguccccaggcgugucggauuacugcaccguccugcauuucagucgccccguaaucucaaucgagggcacguacgacugcggacuguccaagcgacccauggucauaaaggggacccucaucgccaccgccccacacgacgaccgcaagcaugagggcggguccuccuugguggugaaccccaagggugggagcguagacuucuuuggcugguugucaggguuaaccagcuggcugggcggcccccucaagacguuccucacgauccugggguuccuggccguaggccuccugcugguggucaucaucaucauaaucauccggaccgggaugcagcaagcgcucaagaagaagaucaaguga

SEQ ID NO: 16357 - RNA, 4020 nt, Artificial Sequence
  derived and/or modified CDS sequence (opt11) from TOSV(5904242804)__KU935737.1__GP
auguucauagcaaagcugcuccugaucuccugccuggugcagcaggccuacuuaaaguacaccaucaucuccgagaucggcaacgguacccgcacgagcuucugcuacucgagccggaccucccugggcagucugcucgaggcgugggauaacaucaccgaguccaucgggcugaccagcggcacgugcaagguuggcucccuggagaaccgcgacugcaagcgggacauaaugagcaacuauguggccgaggugcacuccaaccuccacggccugggugccaugaugcacaacuacggggacgacaagcgcguugaagugcugaacgacgugauccccgacgagcucaacccgggccgacacaacugcagcgaccucgaccgcaagcccuucuggacagaguucaucgacgucgccaagcccaccaacaaaaucgcaccaauguccgucaucccuccgccuauugugaagcccaucccggucgcggagagcaccaucaagaaguccauuccuuucgacaagcugcucagcgaggccgagaaggagcugaaccaaacgaagauccggcuggagaccgagcgccgguccaaugccgaggaggccgcgaaggagcgcgcccggaugcgcgagaucgaggacaagcuccggaaggauugggagcucgagcgcgagcggaaggacgccgucgccgacgaucuggccaaggagauagcgcgccggcgcgagaucgagcggaaggcccaugagcucgacaagaugcugaagaagaaggagcgcgaagaccugguggcccgggagcgcgucagcgaggacaugcgcaaucacgugcggaagcccaacaccaccaucgcccccgcgccgacgaucaucacaacccuccugauggcguccgccgugauggccggaccccuggaaaaccgcgagaccaaccaccuccugaaccggcccggcaacggugccuauacguuaagcgacuucgccgagagcacgugcacccucgcguacggcagcgagugcaagagcugggaacaccagcuggacgagcuguccuuccccuucuuccacagcaaccucgacaaguacuccaugcuggaggccgccaccgagaccaucccgauccugaacaagagcuccgccgucugcaccaucagccccuccacccacagcuccaacgccugcggccgcgaagcgagccucaucaagaagaagugcggguccaacaugagcgccuucuucuacgugaaccuggccggccagauuaccguggucaagugcgacaccaaccacgugcuauccaacgacugugggaacugcaucagcaaaacccucuccggccagaagaucuacaccccaguccaggacauguucugccagaagggcuggaccgagagcauccccaacacgcgguacuccaaggaccuaugcagcaucgggcugcacaccgucaaggagugcaagaccggaaccaccaacuucgaacggguggguuucaucgucgucgaggggcggaagauguauaucgagcagaugaagaugcgcucacggcaggaguucucggaggaccaguuccucuguuacaagagcgaguccagcuccgggagcagugugaagcugaagaaggucaagguggagucaugcaagggcgugaccacguccagcgccuccaagugcagcggcgaugaguacuucuguucccgcuacccgugcgagaccgcuaauguugaggcccacugcauccugcggcgccacagcgccgugaucgaggugaacguaaacgggguguggaucgugccccggugcaucggcuacgaggagguccuugugcgccggacgucccugaagguugaggacaccucuucccgcgagugcgacacgugccugugggagugugggaagaacaagcucauagucaagacacacggacccaagaucguguacgcaaccgccugcagccacgggagcugcaagucugugaugcagaaaccggcgaccuucgucuaucugccguaccccggcaacucugagaucgugggcggggacaucggcgugcacaugaccgaggaguccagccccagcaacauccacaugguagcccacugccccgccaaggacagcugcgaggugucuagcugccuguucugcgugcacgggcugcucaacuaccagugccacacccuguucuccgcccuccucauaagcaccacggucauguccauccugacccugcuccugcugcucgugaagggcgcaaaggaccuggugaaacggcuguucuacuggcucaucaccccgcuguguuggcugagcgucuucugcggcugggugaucaaauccuggaagaagcgcgugggaagugcgaucucccggaccaacgacacgaucggauggcgcgacaaccgccgguaccgccaagacgucgagcgggcccaguacaccgggggcgcccccggggccaaguauagcuucuacggcguuauggugcucggccugcuggggaacguccacuccugcagcgaguccaucaucgccgacagcaagaucaugcagugcacuaccagcggcuccagcacgcucugcaaggcguccgggaccgugaucaugaagcugggccccaucgggagcgagucuugccugauccucaagggacugaaggacagcgagaagcaguucaucuccauuaagaccauuagcagugagcugaccugucgcgaaggcgagucauucuggacgacccucuacaccccggugugccuguccagccggcgcugccaccugaugggggaaugcgucuccgaccggugccucaaguggaagaccaacgagacgagcgccgaguucaccggcaaggcccacggagaaguggugcacgagaaccgcugcuucgagcaguccggcgggaucggcuacggcugcuucaacgucaacccgagcugucuguacgugcacuccuaccucaagagcguguacaagaacggguucaagaucuuucggugcgucgccuggaaucacaggaucagacuggaggugaccacccacucccgcaaguucccaaugguacugauggcgaugagcacgcagcccaccgacuggggcagcaucggguugauccucgauuccgagggcaucaccgggaccaacgccuacucauucaugaagcacggcuccggcagcuucgccauaaucgaugacccguacucccccgagccccguaagggguucuuaggcgaaguccgcugccccacggaggagaccgccauccgggccagcccuucuuguaagauggcgcccaaccugaucgaguaccagcccgagauggacaccgccgagugcacuacgaacaugaucgaccccauggcgaucuucaaccgcgggagccucccccaggugcgggacggcaugaccuuuacccaguccaucgagaagaacaccgugcaagcccugacaaccggggagguccgcgccagcauccgguugacccucgaugacuacgacgugguguaccagaacucgcagagcgacugcagugcgaccuucaagaaccugacgggcugcuacagcugcgacgagggcucccgcaugugcuaccaggucaaggccgagggggagacgaucuuccacuucauaaacgaggacgagagcaucaacgugaucaacaaggugaacccagaugucuccgacuacugcaccgugcugcacuucagcaggcccgucaucucgaucgagggccgcuacgacugcgggcucagcaagcgccccauggugaucaagggcacccugaucgccaccgccccgcacgacgaccggaagcacgagggcgggagcucccuaauugugaaccccaagggcgggacagucgacuucuucggcugggugagcgggcucaccuccuggcugggaggcccucugaagaccuuccucaccauccugggguuccuggccuugggccugcugcuaguggucaucaucaucaucaucgcgcgcacgggggugcagcaggcccugaagaagaagaauaaguga

SEQ ID NO: 16358 - RNA, 4020 nt, Artificial Sequence
  derived and/or modified CDS sequence (opt11) from TOSV(5963930705)__KU935734.1__GP
auguucauugccaagcugcuccuuauauccugccucguccaacaggcguacuuaaaauacaccauaaucagcgagaucggcaauggaacccgcaccuccuucugcuacagcucgcgcacaagucugggcucgcuccucgaagccugggauaacgucacugaaucaauuggacuaaccagcggcacaugcaagguagggagcuuagaaaaccgagauugcaggaaggacaucaugagcaacuauguagcggaaguccacucaaaucugcauggacugggcgcgaugaugcacaacuacggggaugacaaacgcguugagauccuaaacgacgucauuccugacgaacugaaccccggccaccacaacuguucggaccuugaccggaaaccauuuuggacagaguucauaaauguggccaaaccccucggcgagaucguccccaugagcgugauaccgccacccguaguuaagcuacaaccacccgcugaacccucaucuaagaaacacguacccuucgacgugcuccuaucagaggccgaaaaagagcucaaccaaaccaaaauacgguuggaagaugaacgaaaaucuaaugccgaagagacagcaaaagaacgggccaggaugaaagaaaucgaggaggaacuaaggcgcgaaugggaacucgaacgcaagcggaaagacgccauggcagacgaccuugccaaagaaacugcccguaggcgcgaaaucgaacgcaaggcacacgaacucgaccgaaugcucaaaaagaaagagcgugaaagccugaucgcaaaagagaaggccgaugaagacaugcggucacacguacacaagcccaacaccacgcgagcuccagcucccaccauuauaaccacacugcucauggcauccgcggcacuugcaggcccccucgaaaaccgcgaaacaaaccaucuccucaaccgcccuggcaacggagccuacacccucucagacuucgccgaauccacuuguacucuagcguacggguccgaaugcaaaaguugggaacaccuccuuaacgaggaauuguucccauucuuccacucgaacuuagacaaguacuccaugcuggaagcugccaccgaaacaguacccauucugaacaagucauccgcagucugcacaaucuccccaucaacgcacagcucgaacgcaugcggccgagaggccagcgugauacgcaaaaagugcuacucgaacaugucagcauucuucuacaucaaccuagccggccaaaucaccgucgugaaaugcgaaaccaaccacguccuauccagugacugcggaaacuguaucucaaaaagccuaucgggacagaaagucuacacaccaguccaagauguauucugccaaaaaggauggacacaguccaucccauccacacgauacucaaaagacauuugcaguauaggacuacacaccguaaaggaauguaagaucggcaccacguccuuugaacgggucgguuucauagucguaaagggucgcaaaauguacauugagcaaaugaagaugcgcucccgacaagaauacagcgaagaucaauuccucugcuacaaaagugagucaggcuccggcucauccgucaaacugaagaaauucaaaguagaauccuguaaaggcgugacuacguccuccgccuccaaaugcagcggcgacgaguacuucugcagccgcuacccaugcgaagccgcaaacguggaggcgcacuguauccuucgccgccacagcgccauaguagagguaaaugugaacgggguaugggucguuccccgaugcauaggauacgaagaaguuuugguaaaaagaacaucucuaaaaguagaagacaccacagaacgcgaaugcgauucaugccuuugggaguguggcaaaaacaaacucaucgucaagacccacgggccaaagguagucuacgcuacagccugcucucacggaucgugcaaaucggucaugcagaaaccagcgaccuucgucuaccugcccuaccccgguaauucagagaucgucggaggagauauuggcauacacaugacagaagaaucgucacccucgaacauccaccuaguagcacacugcccggcccgcgacagcugcgacgucagcgacugccucuucugcguccacggcuuacucaauuaucagugccauacacucuucucggcccugcuaauuucaaccaccgucaugagcauccugacauuacuacuacuauuaguaaaaggagcaaaagaccucgugaagaaauuauuccacuggcuuauuacgccacucuguuggcuuuccguguuuugcugcuggaugguaaaaucauggaaacgacgugugggauccgcgauaucgcgcaccaacgacaccaucggauggcgcgagaaccggcgucacgcccaagacaucgagcgagcccagcacaccgggggcgccccaggagcaaaauacagcuucuacggaguaaugaucuugggucuccucuccuccgcccagagcugcucagaaucugucaucgccgacagcaaaauuaugcaaugcaccacauccggcucauccacccucugcaaagccucagguacgguuauaaugcgccuaggccccaucgguucagaaucaugccuaauauugaaaggccucaaagacucggagaaacaauucaucucaaucaaaaccauuucaucagaauuaaccugccgggaaggcgaauccuucuggaccacacucuacacgccuaucugccuaucgucccgccguugccaccuaaugggcgaaugugucuccgauagaugcuuaaaauggaaaaccaaccaaacaagcgccgaguucacaggcaaagcccacggugacgugaugcacgaaaaccgcugcuuugaacaaagcggcggaauaggauacgggugcuucaacgucaacccauccugccuauacgugcacuccuaccuaaaaagcgucuaccgaaacggauucaaagucuuccgcugugucgcguggaaccacagaauacgacuagaaguaacaacccauucaagaaaauuccccaugguacuaauggccaugucgacacaacccacugacuggggcagcaucggccuaauccuagacagcgagggcaucaccgggacgaacuccuacagcuucaugaaacacggauccggauccuucgcaauaauagacgacccauacucccccgagccaagaaaaggcuuccugggcgaggucagaugccccaccgaagaaacagccaugcgcgcaagccccagcugcaaaauggcccccaaccugauagaguaccaacccgaaauggacaccgcggaaugcaccacuaacaugaucgaccccauggccaucuucaaccgcgguucccucccucaaguacgcgacggaaugacauucacccaaucaaucgagaaaaauaccguccaagcacugaccacuggggaaguaaaagcuagcauucgacuaaccuuagacgauuacgauguagucuaccaaaauucgcaguccgacuguuccgcgaccuucaaaaaucuaaccggaugcuauagcugcgacgaaggcuccagacucugcuaccaggugaaagccgaaggcgaaaccaucuuucacuucauaaacgaagaagaaucaaucaaugugaucaauaaaguuucccccgguguauccgauuacugcaccgugcugcacuucucgagcccagucauuucaauagagggaacauaugacugcggauugaguaaacgaccaauggucaucaagggaacccucauagccacagcgccccacgaugacagaaaacacgaagggggaucgucccuagucgucaacccgaaaggcggaucagucgacuucuuuggcuggcuaucaggccucacauccuggcucggaggcccacugaagaccuuccuuacgauccucggguuccucgccgugggcuuacuccuagucguaaucaucaucauaaucauccgcaccggcaugcagcaagcccugaaaaagaaaaucaaauag

SEQ ID NO: 16359 - RNA, 4020 nt, Artificial Sequence
  derived and/or modified CDS sequence (opt11) from TOSV(H4906)__KU922125.1__GP
auguucaucgccaagcugcuccugaucagcugccuggugcagcaggccuaccucaaguacaccaucaucucggagaucgguaacgggacccgcacgagcuuuugcuacuccagccggacuucccugggcagccugcucgaggcgugggacaacgucaccgaauccaucgggcugaccagcgguacgugcaagguggggucccuugaaaaccgggacugucggaaggauaucaugagcaacuacguggcagagguccacucuaaccuccacggccugggcgccaugaugcacaacuacggggacgacaagcgcguggagauccugaacgacgugaucccugacgagcuaaacccgggucaccacaacugcagcgaccuugaccggaagcccuucuggaccgaguuuaucaaugucgccaagccccuguccgagaucguucccaugagcgugauaccgccucccgucgugaagccccagccgcccgccgagcccuccagcaagaagcacgugcccuucgacguccuccuguccgaagcggagaaagaguuaaaccagaccaagauccgccucgaggacgagcgaaagagcaacgccgaagagaccgccaaggagcgggcccggaugaaggagaucgaggacgagcugcgccgggagugggagcuggagcgcaagaggaaggacgcgauggccgacgaccucgcgaaggagacggcccgccggcgcgagaucgagcggaaagcccacgagcuggaccgcaugcugaagaagaaggagcgcgaaucccucauagcgaaggagaaggcagacgaggacaugcgcagccacgugcacaagcccaacacuacaagggccccugcccccaccauuaucacgacucuccugauggcaagcgcggcccucgccgggccauuggagaaccgcgagaccaaccaccuccugaaccgcccgggcaacggggccuacacccuauccgauuucgccgaguccacgugcacccucgcguacggcucggagugcaagagcugggagcaccuccugaacgaggagcuguucccguucuuccacuccaaccucgacaaguauucuaugcuggaggccgccaccgagaccgugcccauccugaacaaguccagcgccgucugcacgaucucccccagcacacacuccagcaacgccugcggccgggaggcguccgugauucgcaagaagugcuacagcaacauguccgcauucuucuacaucaaccucgccggucagaucaccguggucaagugcgaaaccaaccacguucugagcucggacugcggaaacugcaucagcaagagccugagcgggcagaagguguacacgccgguccaggacguguucugccagaagggcuggacccagucaauccccuccaccagguacagcaaggacaucugcuccaucggacuccacaccgucaaggagugcaagaucgggacgaccucauucgaacgcgucggcuucaucguugucaaggggcggaagauguacaucgagcagaugaagaugcgcucccggcaggaguacagcgaggaccaguuccugugcuacaaguccgagagcggcuccgggagcuccgugaagcugaagaaguucaaggucgagagcugcaaaggcgucaccaccuccagcgccuccaaaugcagcggugacgaguacuuuugcucccgcuuccccugcgagacagcgaacgucgaggcccacugcauccuccggcgccacagcgccaucguggaggucaacgugaacggggugugggucgugccccgaugcaucggcuacgaggaggugcuggucaagcgcaccagccugaagguggaggacaccaccgagcgggagugcgacuccugccucugggagugcgggaagaacaagcugaucgugaagacgcacggcccgaaagucguguacgccaccgccugcagccacgggaguugcaaaagcgugaugcagaagcccgcgaccuuugucuaccugcccuaccccggcaacagcgagaucgugggcggcgacaucgguauccacaugaccgaagaaagcuccccgagcaacauccaccugguggcccacugccccgcccgcgacuccugcgacguuucagacugccucuucugcgugcacgggcugcugaacuaccagugccacacccucuucuccgcccuacugaucagcacgaccgugauguccaucuugacccugcugcuccuguuagucaagggcgccaaagaccucgugaagaagcuguuccacuggcuuauuacgccucucugcuggcugagcguguucugcugcugggucgugaaguccuggaaacggcgcguggggagcgcgaucagccggaccaacgacacaaucggcuggcgcgagaaccggcgccacgcccaggacaucgagcgcgcccaguacaccggcggggccccuggcgccaaguacagcuucuacggugucaugaucuuaggccuccuguccagcgcgcaaagcugcuccgagagcgugaucgccgauaguaagaucaugcagugcaccacgagcgggucuagcacgcugugcaaggccuccgggaccgucaucaugcggcucggccccaucgggagcgaguccugccugaucuuaaagggccucaaggacagcgagaagcaguuuaucuccaucaagaccaucagcuccgagcugacgugccgugagggugagagcuucuggaccacccuguacacccccaucugccucuccagucgucgcugccaccugaugggcgaaugcgucuccgaccggugccugaaguggaagaccaaccagaccagcgccgaguucaccggcaaggcgcacggggacgugaugcacgaaaaccgaugcuucgaacaguccggcgggaucggguacggaugcuucaacgugaacccgagcugccucuacguccacagcuaccugaaguccguguaccggaacggcuucaagguguuccgcugcgucgccuggaaccaccguaucaggcuggagaugaccacccacagccggaaguucccgaugguguugauggccauguccacccagcccaccgauuggggcagcaucgggcugauccuggacuccgagggcaucaccggcacgaacagcuacaguuucaugaaacaugggagcggguccuucgccaucaucgaugaccccuacagcccggagccacgcaagggcuuccucggcgaggugcgcugccccaccgaggagaccgcuaugcgcgcgucucccagcugcaagauggccccgaaccugaucgaguaccagccggagauggauaccgccgagugcacgaccaacaugaucgaccccauggccaucuucaaccgggggucccugccccagguccgcgacggcaugaccuucacccagaguauagagaagaacacggugcaggcccucaccaccggggaggugaaggcauccauccggcugacccuggacgacuacgacgucguguaccagaacucacaguccgacugcucagccacguucaagaaccugaccggcugcuacuccugcgaugaggggagccgccugugcuaccaggugaaggccgaaggagagaccaucuuccacuucaucaacgaagaggaaagcauuaaugucaucaacaaggugaaccccggcguguccgacuacugcaccguucugcacuucagccggccggugaucuccaucgaggggacauacgacugcgggcucagcaagcggcccauggucauaaaggggacacugaucgccacugcgccccacgacgaccggaagcacgagggcggcuccagccugguggugaaccccaagggcggguccgucgacuucuucggguggcucagcggccugaccuccuggcucgggggcccguugaagaccuuccugaccauccugggcuucuuggccguggggcugcugcucgucgucaucaucaucaucaucauccgcaccggcaugcagcaggcccugaagaagaagaucaaauga

SEQ ID NO: 16360 - RNA, 4020 nt, Artificial Sequence
  derived and/or modified CDS sequence (opt11) from TOSV(MRS2010-4319501)__KC776215.1__GP
auguucaucgccaagcugcuccugaucagcugccuggugcagcaggccuaccucaaguacaccaucaucuccgagauaggcaacgggacccguacgagcuucugcuacuccagccggaccucccugggaagccugcucgaggcgugggacaacguuaccgaguccaucgggcugaucagcgggaccugcaagguggggucccuggagaacagagacugccggaaggacaucaugagcaacuacguggccgaaguccacuccaaccuccacggccucggcgccaugaugcacaacuacgccgacgacaagcgcguggagauccugaacgacgugauccccgaugagcucaacccgggacaccacaacugcagcgaccuggaccggaagcccuucuggacggaguucaucaacguugccaagccccuguccgagaucgugcccaugagcgugaucccgccgcccgucgugaaguugcagccucccgcggagcccuccagcaagaagcacgugcccuucgacguccugcugucugaggccgagaaggagcucaaccagacgaagauccgccuggaggacgagcgcaagaguaacgccgaggagaccgccaaggagcgggcgcggaugaaggagaucgaggacgagcugcgccgggagugggagcucgaacgcaagcggaaggacgccauggccgacgaccuggccaaggaaaccgcccgccggcgcgagaucgagcggaaggcgcacgagcuggaucgcaugcucaagaagaaggagcgggagucccugaucgccaaggagaaggccgacgaggacaugcgcagccacguguacaagcccaacacgacccgggcccccgcccccaccaucaucaccacguugcucauggcgucagccgcccuggccggcccccuggagaaccgcgagaccaaccaccuccugaaccgacccgggaacggagccuacacccuguccgacuucgcggagagcacgugcacccucgccuacggguccgagugcaagagcugggagcaccuccugaacgaggagcuguucccguucuuccacuccaaccuggacaaguacagcaugcuggaggccgccaccgagaccgugcccauccucaacaaguccagcgccgucugcaccaucucccccagcacgcacuccagcaacgcgugcggccgggaggccuccgugauccgcaagaagugcuacagcaacauguccgccuucuucuacaucaaccuggccggccagaucaccguggucaagugcgagaccaaccacgugcugagcuccgacugcgggaacugcaucagcaagucucucagcggccagaagguguacacccccguccaggacguguucugccaaaagggguggacgcagucaaucccguccaccaaguacagcaaggacaucugcuccaucggccugcacaccgugaaggagugcaagaucggcaucaccagcuucgagcgggucggguucaucguggucaagggccgcaagauguacaucgagcagaugaagaugcggucccgccaggaguacagugaggaccaguuccugugcuacaaguccgagagcuccagcggguccagcgugaagcucaagaaguucaagguggaguccugcaagggcgucacgaccagcuccgcgagcaagugcuccggagacgaguacuucuguagccgguaccccugcgagaccgccaacguggaggcccacugcauccugcgccggcacagcgccaucguggaggucaacgugaacggcgugugggucgugccccgcugcaucggcuacgaggaggugcuggucaagcggaccucccucaagguggaggacacgaccggucgagagugcgacagcugccugugggaguguggcaagaacaagcugaucgugaagacccacgggcccaaggucguguaugccaccgcgugcucccacggcagcugcaaguccgugaugcagaagccggccacguucgucuaccugcccuaccccgggaacagcgagaucguaggcggagacaucgggauccacaugaccgaggaguccagccccuccaacauccaccucguggcccacugcccggcccgggacagcugcgacgucuccgauugccuguucugcgugcacggccugcucaacuaccagugccacacccuguucagcgcccugcucaucuccacaaccgugaugagcauccugacgcugcuccugcugcucgucaagggggcgaaagacuuagugaagaagcuguuccauuggcucaucacgccccugugcuggcuguccguguucugcugcugggucgucaagucuuggaagcgccgggugggcuccgccaucagccgcaccaacgacaccaucggguggcgggagaaccgccggcacgcccaggacauugagcgcgcccaguacacaggcggcgcccccggggcgaaguacuccuucuacggcgugaugauccucgggcugcugagcagcgcccaguccugcagcgaguccgugaucgccgacagcaagaucaugcagugcaccacguccggcagcuccacccucugcaaggcaagcggcacggugaucaugagggucgggccgaucggcuccgagagcugccugauccugaaggggcucaaggacuccgagaagcaguucaucagcaucaagaccaucuccagcgagcugaccugccgggagggcgaguccuucuggaccacccuguacacucccaucugccucagcucccgccggugccaccuaaugggggagugcgugagcgaucgcugccugaaguggaagacgaaccagaccucggcggaguucacgggcaaggcccacggcgaugugaugcacgagaaccggugcuucgagcagagugggggcaucggguacggcugcuucaacgucaaccccagcugccucuacgugcacuccuaucucaagagcguguaccgcaacggguucaaggucuuccggugcguagccuggaaccaccgcauccggcuggaggugaccacccacucccgcaaguuccccaugguccugauggccaugaguacccagccgacggacuggggcuccaucggccugauccuggacagcgagggggugaccggcaccaacuccuauagcuucaugaaacacggguccggcagcuucgccaucaucgacgaccccuacuccccggagccccggaagggguuccucggcgaggugcgcugcccgaccgaggagacggcgaugcgggccagccccuccuguaagauggcccccaaccugaucgaguaccagcccgagauggacaccgccgaaugcacgaccaacaugaucgacccgauggccaucuucaaccgcggcagccugccccagguccgggacgggaugacguucacccaguccaucgagaagaacaccgugcaggcgcucaccacgggcgaggugaaggccagcauccgccugacccuggacgacuacgacgucguguaccagaacucccagagcgacugcuccgccaccuucaagaaccucaccgggugcuacagcugcgaugagggcucacggcugugcuaccaggugaaggccgagggggagacgaucuuccacuucaucaacgaggaggaguccaucaacgucaucaacaaggugagccccggcgucuccgacuacugcaccgugcugcacuucagccgccccgugaucuccaucgagggcaccuacgacugcgggcucagcaagcggccgauggucaucaagggcacccugaucgccaccgcgccccacgacgaccgcaagcacgagggcggcuccagccugguggugaaccccaagggcggcuccgucgacuucuucggcuggcucagcgggcugacguccuggcugggcgggccccucaagaccuuccugacaauccugggcuuucucgccgugggccugcugcuaguggucaucaucaucauuaucauccggaccgggaugcagcaggcccugaagaagaagaucaaguga

SEQ ID NO: 16361 - RNA, 4020 nt, Artificial Sequence
  derived and/or modified CDS sequence (opt11) from TOSV(Nice/113)__KU204982.1__GP
auguucaucgccaagcugcuccugaucagcugccuggugcagcaggccuaccucaaguauaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacuguggcaaagacaucaugagcaauuacguggccgagguccacuccaaccuccacggccugggggccaugaugcacaacuacggcgacgacaagcggguggagauccugaacgacgugauccccgacgagcuaaacccggggcaccacaacuguagcgaccuggaccgcaagcccuucuggaccgaguucaucaacgucgcccggcccuuguccgagaucgcccccaugucggucauacccccgcccguggucaagcuccagccgcccgcggagcccucuagcaagaagcacgugcccuuugacguccugcuguccgaggccgagaaggagcucaaccagaccaagauccgucuggaggacgagcgcaagagcaacgccgaggagaccgccaaggagcgggcgcggaugaaggagaucgaggacgagcugcgccgggaaugggaguuggagcgcaagcggaaggacgccauggccgacgaccuggccaaggagacagcccgccggcgcgagaucgagcggaaggcgcacgagcuggaccgcaugcucaagaagaaggagcgggagucccugaucgccaaggaaaaggccgacgaggacaugcgcagccauguccacaagcccaacaccacccgggcccccgcccccacaaucaucacgacccugcucauggcgagcgccgcccuggcaggcccccuggagaaccgcgagaccaaccaccuccugaaccgccccgggaacggugccuacacccuguccgacuucgcggagagcacgugcacccucgccuacggcuccgaaugcaagagcugggagcaccuccugaacgaggagcuguucccguucuuccacuccaaccuggacaaguacagcaugcuggaggccgccaccgagaccgugcccauccucaacaaguccagcgccgugugcacgaucucgcccucgacccacuccagcaacgcgugcgggcgggaggccuccgucauccgcaagaagugcuacagcaacauguccgccuucuucuacaucaaccuggccggccagaucaccguggugaagugcgagaccaaccacguccugagcucagacugcgggaacugcaucagcaagucgcucagcggccagaagguguacacgcccgugcaagacgucuucugccagaagggcuggacccagagcaucccguccacccgguacagcaaggacaucugcuccaucgggcugcacacugugaaggagugcaagaucggcacgaccagcuucgagcgcgugggguucaucgucgugggcgggcggaagauguacaucgagcagaugaagaugcgcucccggcaggaguacucugaggaccaguuccugugcuacaaguccgagagcggcuccggcagcuccgucaagcucaagaaguucaagguggaaagcugcaagggggugaccaccuccagcgcguccaagugcagcggcgacgaguacuucugcucccgcuaccccugcgagacggccaacgucgaggcccacugcauccugcggcgccacagcgccaucguggaggugaacgucaacgggguuuggguggucccccggugcaucggcuaugaggaggugcuggugaagcgcaccucacucaaggucgaggacaccaccgagcgggagugcgacuccugccuuugggagugcgggaagaacaaacugaucgugaagacgcacggccccaaaguggucuacgccaccgcgugcagccacggcuccugcaagagcguuaugcagaagccggccaccuucguguaccuucccuaccccgggaacuccgagaucgucggcggggacaucggcauucacaugacugaggagagcucccccagcaacauccaccucguggcccacugcccggccagggacuccugcgacgugagcgacugccuguucugcguccacgggcugcucaacuaccagugccacacccuguucuccgcccugcucaucagcacgacugugauguccauccugacccugcuccugcugcucgugaagggcgcgaaggaccuggucaagaaacuguucuacuggcucauaacgccccugugcuggcugagcguguucugcugcugggucaucaagucguggaagcggcgcgucggcagcgccaucucccggaccaacgacaccaucggguggcgcgaaaaccggagacaugcccaggacaucgagcgcgcccaguacaccggcggggccccaggcgcgaaguacagcuucuacggcgugaugauacucgggcugcuguccagcgcccagagcugcuccgagagcgugaucgccgacuccaagaucaugcaaugcaccacgagcggcuccagcacccucugcaaggccuccgggaccgucaucaugcggcugggcccgaucgggagcgaguccugccugauccucaagggccugaaggacagcgagaagcaauucaucucgaucaagaccaucagcuccgaacugacgugccgcgagggcgagagcuucuggaccacccucuacacacccaucugccuguccagccgacgcugccacuugaugggggagugcguguccgaccggugccugaaguggaagacgaaccagaccagcgcggaguuuaccggcaaggcccacggggacgugaugcacgagaaccgcugcuuugagcaguccggcgggaucggauacggcugcuucaacgucaaucccagcugccuguacgugcacagcuaccugaaguccguguaccgcaacggguucaagguguuccgcugcguggccuggaaccaccggauccgccucgaggugaccacucacucgcggaaguuccccaugguccugauggccauguccacccagccgaccgacuggggcagcaucgggcugauccucgacuccgagggcaucaccgggacgaacagcuacuccuucaugaagcacggcagcggcuccuucgccaucauugacgacccuuacagccccgagccccgcaagggguuccugggcgaggugcggugcccgaccgaggagaccgcgaugcgcgccucccccagcugcaagauggcccccaaccugaucgaguaccagcccgagauggauaccgccgagugcacgaccaacaugaucgacccaauggccaucuucaaccgggggucccucccccaggugcgcgacggcaugaccuucacccagagcaucgagaagaacacgguccaggcgcugacaaccggggaggugaaggccuccauccggcugacccucgacgacuacgacguggucuaccagaacagccaauccgacugcagcgccacguucaagaaccucaccggcugcuacuccugcgacgagggcagccgccugugcuaccagguaaaggccgagggggagaccaucuuccacuucaucaacgaggaggagagcaucaacgugaucaacaaggugucccccgaggugagcaacuacugcacagugcuccacuucucccggcccgucaucagcaucgagggcaccuacgacugcgggcuguccaaacgcccgauggugaucaagggaacgcugaucgccaccgcgccccacgacgacagaaagcacgagggcgggagcucccucgucgugaaccccaagggcgggagcguggacuucuucggcuggcuguccgggcugaccagcuggcucggcggcccccugaagaccuuccugacgauccucggguuccuggccgucggccugcucuugguggugaucaucaucaucaucauccgcaccgggaugcagcaggcccugaagaagaagaucaaguga

SEQ ID NO: 16362 - RNA, 4020 nt, Artificial Sequence
  derived and/or modified CDS sequence (opt11) from TOSV(P233)__KU204976.1__GP
auguucauugcgaaacuucuucucaucucaugccucguccaacaagccuaccuaaaguauaccauaauaagcgaaaucggcaacggaacccguacuuccuuuugcuacuccagccgcaccagccucggcucacuacucgaggcgugggacaaugucaccgagucuauaggccugacuuccgggaccugcaaggucggcucacucgagaaccgcgauugccgaaaagacauaaugaguaauuacguagcggagguccacuccaaucuccacggacuaggcgccaugaugcacaacuacggcgacgacaaacgagucgagauccucaacgacgucauccccgacgaacuaaaccccggacaccacaacuguucagaccuagaccgaaagccuuucuggaccgaguucaucaaugucgcuaaaccacuuucggagaucguuccaaugaguguaauaccgccucccguaguaaaaccgcaaccaccagccgaacccuccucgaagaaacacguucccuuugacguacuauuaagcgaggccgaaaaagaauuaaaccaaaccaaaauccgccuagaggaugaaaggaaauccaacgcagaagagacagcaaaagaaagagcacguaugaaagaaaucgaggacgaacuccgucgcgaaugggaacucgagcgaaaaagaaaagacgcuauggccgacgaccuagcgaaagaaaccgcgcgacgacgcgaaaucgagcgcaaggcccacgaacuggauaaaaugcucaaaaagaaagagcgcgagagccuaauugccaaggagaaggcggacgaagacaugcgaucacacguacacaagcccaacacaacgagagcaccagcaccaaccaucaucaccacgcugcuaauggccagcgccgcccuggccgguccccuagaaaaccgagagaccaaccaccuacuaaaccgccccggcaacggcgcguauacccuaucagacuucgccgaaucaacguguacgcuagcuuacggauccgagugcaaaucaugggaacaccuacuaaaugaagaacucuucccauucuuccacucaaaccucgacaaauauucaaugcucgaagccgccacagaaacaguaccgauccugaacaaguccuccgccguuugcacaauaucacccagcacccacuccagcaacgcgugcggacgggaagcauccguuauccgcaagaaauguuacuccaacauguccgcauucuucuacauaaaccuggcggggcaaaucaccgucaucaaaugcgaaacaaaccacguccugucaagcgacugcggaaacugcauaucaaaaucccuuucaggccaaaaagucuacacccccguucaggacgucuuuugccagaaaggauggacacagucaauuccaagcacacgauacaguaaagacauaugcuccaucggacuccacaccgucaaagaaugcaagaucgguaccaccagcuucgaaagggucggauucaucgucgugaaaggcagaaaaauguacaucgagcaaaugaagaugcgcucccgccaagaauacagcgaagaccaauuucuuugcuacaaaucagaaucggguucagggaguuccgucaaacuaaagaaauucaaaguuaaaagcugcaaaggagugacaaccuccagcgccagcaaauguucgggcgacgaauacuucugcagcagauacccaugcgagaccgcuaacguggaagcccacugcauccugcgccgucacucagccaucgucgaaguaaacgugaacggcguauggguugucccccgcuguaucggcuacgaagaagugcucgugaaacggacgucgcuuaaaguugaagacaccaccggacgcgaaugcgacuccugccucugggaaugcggcaagaacaaacuaaucguaaaaacgcacgggccgaaggucguuuacgcgacggcauguucacacggcuccugcaaaagcguaaugcaaaagccugcaacguucgucuaccuccccuaccccggaaacucagaaauaguaggcggggacauagggauacacaugacagaagagaguucuccgagcaacauucaucuagucgcacacugcccggcccgugacagcugugauguaagcgacugccucuucugcguccacggguugcuaaacuaucaaugccauacacucuuuucagcacugcugaucagcacaacagucauguccauccuuacccuccuacugcuccuaguuaaaggcgcuaaggaccuugucaagaaacucuuccacuggcucaucacaccccuauguuggcucaguguguucugcugcuggguaguaaaauccuggaaacggagagucgggagugcaauaagucguaccaacgauacuauaggcuggagagaaaaccgccgccacgcucaagacauagaacgagcacaauauacaggaggggccccaggugcgaaauacaguuuuuacggagugaugauccuaggacuauugucaagcgcccaaucgugcuccgaauccguaauugccgacagcaagaucaugcaauguacaacauccggaucuuccacguuaugcaaagcaagcggcacagucauaaugagacucgguccuauagggagcgaaaguugcuuaauucugaaaggccugaaagauuccgagaaacaguuuaucucgauaaaaacaaucagcucagaacucacaugccgcgagggcgaguccuucuggacgaccuuauacacacccauauguuuguccucccgccguugccaccucaugggcgaaugcgucagcgaccgaugccucaaguggaaaaccaaccaaacaagcgcugaguucacagggaaagcccacggagacguuaugcacgaaaacagaugcuucgaacagucgggagggauagguuacggcugcuucaaugugaacccaagcugucuauauguccacagcuaccuaaagucuguauaccggaacggguucaaagucuucagaugcguagcguggaaucaucgcaucagacucgaagucacgacccacagccgaaaguuccccaugguccucauggcgauguccacacaaccaacggacuggggaucgauagggcuaauacuagacuccgaaggaauaacaggaaccaauucauacagcuucaugaaacacgggucagggaguuuugcaaucaucgacgauccauacucccccgagccuaggaaaggauuccugggagaagucagaugcccaaccgaggaaacggcuaugcgagcaagcccauccugcaagauggccccaaacuuaaucgaauaccaaccagagauggacacagccgaguguaccacaaacaugauagaccccauggcuauauuuaaccgaggcucccuuccacaaguccgggacggaaugacguucacccaauccaucgagaaaaacacagugcaagcacucaccacuggggaaguaaaagcguccauccgacucacccucgaugacuacgaugucguauaucagaacagccagagcgacuguuccgccaccuucaagaaccucacggguugcuacucaugugacgaaggcagccgacucugcuaccaggugaaggccgaaggcgaaaccauauuccacuuuaucaacgaagaagaaucaauuaacgugaucaacaaaguuuccccggguguguccgacuauuguaccguacuccacuucucccgcccugucaucuccauagagggaaccuacgacugcgggcugagcaaacgcccaauggugaucaaaggcacacuaauagcaaccgcuccacacgaugaccgcaaacacgagggcggcuccucccugguggugaaccccaaaggcggguccguagacuucuucggguggcucucaggccucaccucuuggcuaggaggcccauuaaaaaccuuccugacaauccuaggauuccuugccgugggacuucuauuaguuguaauaaucaucaucauaauccggaccggaaugcaacaagcccucaaaaagaaaauaaaauag

SEQ ID NO: 16363 - RNA, 4020 nt, Artificial Sequence
  derived and/or modified CDS sequence (opt11) from TOSV(T152)__JX867535.1__GP
auguucaucgccaagcugcuccugauaagcugccuggugcagcaggccuaccucaaguacacaaucaucucggagaucggcaacgggacccgcacgagcaguugcuacagcucccggaccucacugggcucccugcucgaggcgugggacaacaucaccgagagcaucggucugaccucaggcacgugcaaggucgggagccuggagaaccgcgacugcaagcgggacaucauguccaacuacguggccgaggugcacagcaaccuccacggccugggcgccaugaugcacaacuacggggacgacaagcgcgucgaggugcugaacgacgugauccccgacgagcucaacccgggccggcacaacugcuccgaccuugaccgcaagcccuucuggaccgaguucaucaacgucgccaagcccaccaacaagaucgccccaaucagcgugaucccgccgcccaucgugaaacccauccccaucgcggagcccaccacgaagaagaacauccccuucgauaagcugcucuccgaggccgagaaggagcugaaccagaccaagauccgacuggagaccgagcgccggagcaacgccgaggaggccgcgaaggagcgcgcccggaugcgcgagaucgaggacaagcuccggaaggacugggagcuggagcgagagcggaaggacgccgucgccgacgaccuggccaaggagauagcgcgccggcgcgagaucgagagaaaggcccacgagcucgacaagaugcugaagaagaaggagcgcgaagacuuaguggccaucgagaagguguccgaggacaugcggaaccacguccgccggcccaacacaacgauagcccccgcccccaccaucaucaccacccuccugcucgcgagcgccgugauggccgggccccucgagaaccgggagacgaaccaccucuuaaacagacccggcaacggggccuacacccucuccgacuucgccgagagcacgugcaccuuggcguacggcagcgagugcaaguccugggagcaccagcuggacgagcucagcuucccguucuuccacuccaaccuggacaaguacagcaugcuggaggccgccaccgagacuauccccauccucaacaagagcagcgcugugugcaccaucucccccagcacccacucuagcaacgcaugcggccgggaggcgucccugaucaaaaagaaaugcgggagcaacauguccgccuucuucuacgucaaccuggccggccagaucacgguggugaagugcgacaccaaccacguccucagcaacgacugcgggaacugcauauccaagacccugagcggccagaagaucuacacccccgugcaggauauguuuugccagaagggcuggacggagucaaucccgagcacccgcuacuccaaggaccugugcagcaucgggcuccacaccgugaaggagugcaagaccggcacgaccaacuucgagcgggucggguucaucgugguggagagccgcaagauguacaucgagcagaugaagaugcggucccgccaggaguucucggaagaccaguuccugugcuacaaguccgagagcucgagcggcuccagcgucaagcugaagaaggugaaggucgaguccugcaagggggugaccaccagcuccgccaguaagugcuccggcgacgaguacuucugcagccgguaccccugcgagacggcgaacguggaggcccacugcauccuccgccggcacuccgccgucaucgaggugaacgugaacggcgucuggguggugccccgcugcaucggguacgaggagguccuggugcggcgcaccagccugaagguggaggauaccuccagccgggagugcgacacgugccucugggagugcggcaagaauaagcugaucgucaagacccacgggcccaagaucguguacgccaccgccugcagccacggcuccugcaagagcgugaugcagaagccggcgaccuucgucuuccugcccuaccccgggaacuccgagaucgugggcggcgacaucggggugcacaugaccgaggagagcucccccagcaacauccacauggucgcccacugcccggccaaggacuccugcgaggugucguccugcuuguucugcgugcacggccucuugaacuaucagugucacacccuguucagcgcccuccugaucuccaccaccgucaugucaaucuugacccuccugcugcuacuggugaagggggccaaggaccuggugaagcgccucuucuacuggcugaucacgccccugugcuggcucuccgucuucugcagcuggaugaucaaguccuggcggaagcgcgugggcagcgcgaucuccagaaccaacgacaccaucgguuggcgcgacaaccgccgguacggccaggacguggagcgcgcccaguacaccggaggggcccccggcaccaaguacagcuucuacggggucaugauccugggccugcucggcaacgugcacuccugcagcgagagcgugauugccgacuccaaggucaugcagugcacgaccagcggauccagcacccugugcaaagccuccggcaccgugaucaugaaacuggggccgaucggcagcgaguccugccucauccugaaggggcugaaggacagcgagaagcaguucaucuccaucaaaacgaucagcuccgagcugaccugccgggagggcgagagcuucuggaccacccuguacacgcccguuugccuguccagccgccggugccaccucaugggcgagugcgucuccgaccgcugccugaaguggaagacgaacgagaccagcgcggaguucaccgggaaggcccacggcgaggugaugcacgagaauaagugcuucgagcaguccgggggcaucggguauggcugcuucaacgugaaccccagcugccuguacguccacuccuaccucaagagcguguacaagaacggcuucaagaucuuccggugcguggccuggaaccaccgcauccggcuggaggucacgacccacagccgcaaguucccaauggugcugauggccauguccacccagccgaccgacugggggagcaucggccucauccuggacuccgaggggaucacgggcaccaacgcguacagcuucaugaagcacggguccggcagcuucgccaucaucgacgacccauacucccccgagcccaggaagggcuuccugggggaggugcgcugcccgaccgaggagaccgccauccgggcgagccccuccugcaagauggcccccaaccucaucgaguaccagcccgagauggauacggcggagugcaccaccaacaugaucgacccgauggccauuuucaaccgcggcagccugccccagguccgggacgggaugaccuucacgcaguccaucgagaagaacaccgugcaggcccugaccaccggcgaagugcgcgccuccauccggcucacccuggacgacuacgacgucguguaccagaacucccagagcgacugcuccgccacguucaagaaccugaccgggugcuacagcugcgacgagggcucccgcaugugcuaccaagugaaggcggagggcgagaccaucuuccacuucgucaacgaggacgagagcaucaacgugaucaacaaggugucccccgacgucagcgauuacugcaccguccuccacuucagccggcccgucaucuccaucgaggggcgcuacgacugcggccugagcaagcggccgauggugaucaaggggacgcuaaucgccaccgcgccccacgacgaccgcaagcacgagggcggcuccagccucguggucaaccccaagggcgggaccguggacuucuucggguggguguccggccugaccagcuggcucggcggcccguuaaagacguuccugaccauccugggcuuccucgcccuggggcugcuccuggucguggugaucaucaucaucgcccgcaccggcguccagcaggcccugaagaagaagaacaaguga

SEQ ID NO: 16364 - RNA, 4020 nt, Artificial Sequence
  derived and/or modified CDS sequence (opt11) from TOSV(TOSV/P51)__KU204979.1__GP
auguucaucgcuaaauugcuucucaucagcugccuaguccaacaagcauaccugaaauacacaauaauuucugaaaucgggaauggcacacguaccagcuucugcuacucaucacggaccagcuuaggaucgcuccuagaagcgugggauaacgugaccgaguccauaggccucaccucuggcacaugcaaggucggcucgcucgagaaccgcgacugccgaaaagacaucaugaguaacuacguagccgaggugcacuccaaccuccauggacucggagcgaugaugcacaacuacggcgaugauaaaaggguagaaauacuaaacgacguuaucccggacgaacuuaaucccggccaccauaauugcucagaccucgaccgcaaaccauucuggacugaauuuaucaacguagccaagccccucucagaaaucgucccaaugucuguaaucccaccgccaguagucaaauuacaaccacccgcggaacccagcagcaaaaagcacguacccuucgacguccuccuuagcgaggccgaaaaggaacucaaccaaacgaaaauaagacucgaagacgagcgaaaaagcaacgccgaagagacagcaaaagagcgagcgcgcaugaaagaaauagaggacgagcugcgacgcgaaugggagcucgaacgcaaacgaaaagacgcaauggcagaugaccuagccaaagaaacagcucgcagacgagagaucgauagaaaggcgcacgaacucgaccgaauguuaaagaagaaagagcgagagagccuaauagccaaagagaaagcagacgagaacaugcggucccacgugcaugagccuaacacaacacgugcaccagcacccacaauuauaacaacccuccugauggcgucagccgcacuugccggaccucucgagaauagagagaccaaucaucuccucaaccggccagggaacggcgccuacacacuaucggacuuugccgaauccacaugcacacucgcauauggaagcgaaugcaaaagcugggaacaccuccuaaacgaggaacucuucccauucuuucauuccaacuuagacaaauauagcaugcuagaagccgcaacagaaacaguccccauccuaaacaaguccucggcaguaugcacgaucucaccauccacgcacagcucaaacgcgugcggacgcgaagcgucgguaauccgcaaaaagugcuacagcaacaugagugcauuuuucuacaucaaccuugccggacaaaucaccguagugaaaugcgaaacaaaccacgugcuaucaagcgacugcgggaacugcauuucgaagucgcucucaggucaaaaaguguacaccccaguacaggacguauuuugccaaaaaggauggacgcaaucaauccccagcacucgauacucaaaggauauaugcucaaucggacuccacaccguaaaagaauguaaaauaggaaccaccuccuucgaacgggucgguuuuaucgucgucaaaggacgcaagauguacaucgaacagaugaagaugcgcucacgacaggaauacucggaagaccaauuucucugcuauaaauccgaaucaggcagcggcucguccgucaaacuaaagaaauucaaggucgaaagcugcaagggugucaccacgucuuccgcguccaagugcuccggcgacgaauacuuuugcagccgauaccccugcgaaaccgcgaacguggaagcccacugcauucuccgccggcacucagcaaucguagaaguuaacguaaacggcgucuggguaguuccacgcuguaucggcuacgaggaaguccucguaaaacgaaccagccucaaaguagaggacacgaccggccgggaaugcgacuccugccuaugggagugcggcaagaacaaacucauagucaagacccaugggccaaaaguagucuacgcaacagcuugcucucacgguucaugcaagagcgucaugcaaaaacccgcaaccuucgucuaccuucccuauccaggaaacuccgagaucgugggcggcgacaucgggauccacaugacagaagagagcucaccauccaacauccaccugguagcgcacuguccggcacgagacagcugcgacgucucggacugccuauucugcguucacggacugcugaauuaccaaugccacacccuauucuccgcgcuacucauuuccacaaccguaaugucaauacucacccuacugcugcucuuggucaaaggugcaaaagacuuaguaaagaaacucuuuuacuggcucaucacaccccucugcuggcuuagcguuuucuguugcuggguagucaaaucauggaaacgccgagucggaagcgcaauaucgcgaaccaacgacacaauaggauggcgcgaaaacagacgccacgcacaggacauagaaagggcgcaauacacggguggggccccuggcgcuaaauacagcuuuuacgggguaaugauccuuggccugcucucaagcgcacaaucgugcucggaaaguguaauagcggacucaaaaaucaugcaauguaccacaagcggaagcucaacccuaugcaaggcgucaggaaccguuaucaugcgacucggccccauuggaucagagucauguuuaauccucaagggccuuaaggacucagagaagcaguuuaucucgaucaagaccaucagcuccgaauuaaccugccgcgaaggagagagcuucuggacgacucuauauacgcccaucugccuaucaucacggcgaugccaccuaaugggcgaaugcgucucggaucguugccucaaguggaaaaccaaccaaacgagcgccgaguucacaggcaaagcccacggagacguaaugcacgaaaaucgcugcuucgaacaaucaggcggaauaggcuacggauguuucaacgucaaccccucaugccuuuacguacacagcuaccuaaaaagcguguacagaaacggauucaaaguauucagaugcgucgcguggaaccacaggaucagguuagaagucacgacgcacagccgaaaauuuccaaugguacucauggcaauguccacccaacccaccgauuggggcucuauaggauugauacucgauagcgagggcauaacaggcaccaacagcuacuccuuuaugaagcacggcuccggcucauucgcuaucaucgacgacccuuacucccccgaaccgagaaaaggcuuccugggcgagguacgcugccccaccgaagagacggcaaugcgagccuccccgaguugcaagauggcaccaaaccuagucgaguaccaaccggaaauggacaccgcagaaugcaccacaaacaugauagaccccauggcaauauucaaucgcgggagcuuaccucaaguccgcgacggaaugaccuucacgcaguccaucgagaaaaacaccguucaagcccuuacaaccggggaagucaaagcaagcauucggcuaacacucgacgacuacgaugucgucuaccaaaacagccaauccgacugcuccgcaacguucaaaaaccuuacuggaugcuacuccugugacgaaggcucccgacucugcuaccaaguaaaggcagaaggggaaaccauauuccacuuuaucaaugaagaagaaucaauaaaugugaucaacaaagucuccccacgcguauccgacuacuguacaguccuucauuuuucacgcccggucaucucaaucgaagggaccuacgacuguggccucaguaagcgaccgaugguaaucaagggcacccuaaucgccaccgccccacacgacgaccgaaagcacgaaggcggcucaucacuuguaguaaaccccaaaggaggcuccguggauuucuucggauggcuauccgggcuaacaucauggcuaggagguccucucaaaacguucuuaaccauacuaggcuuccuagcagucggacuucuccuagucgucaucauaaucauaaucauacgaacgggcaugcaacaggcacuaaagaaaaagauaaaguaa

SEQ ID NO: 16365 - RNA, 4020 nt, Artificial Sequence
  derived and/or modified CDS sequence (opt11) from TOSV(TOSV_Italy/BB8/2014/human)__KY626661.1__GP
auguucaucgccaagcuguugcugauaagcugucuggugcagcaggcauaccucaaguacaccaucauauccgagaucggcaacgggacccgcacgucuuucuguuacuccagccggaccuccuugggcagccugcucgaggcgugggauaauaucaccgaguccaucgggcugaccagcggcacgugcaaggucgggucacuggagaaccgcgacugcaagcgggacaucaugagcaacuacguggccgaggugcacuccaaccugcacggccugggggccaugaugcacaauuacggggacgacaagcgcguggaggugcugaacgacgugauccccgacgaacucaacccaggccggcacaacugcagcgaccuggaccgcaagcccuucuggaccgaguucaucgacgucgccaagcccaccaacaagaucgcccccauguccgugaucccaccgcccaucgugaagcccauccccgucgcggagagcaccauuaagaaguccauccccuuugacaagcugcucagcgaggcugagaaggagcugaaccaaacgaagauccggcuggagaccgagcgccgguccaacgccgaggaggcggcaaaggagcgcgcccggaugagggagaucgaggacaagcuccggaaggacugggaguuggagcgcgagcggaaagacgccguggccgacgaucuggccaaggagaucgcgaggcgucgcgagauagagcggaaagcccacgagcucgacaagaugcugaagaagaaagagcgagaggaccugguggcccgggagcgcgucuccgaagacaugcgcaaccacgugugcaagcccaacaccaccaucgcccccgccccgacgaucaucaccacccuccugauggcguccgccguaauggccgggccccuggagaaccgugaaaccaaccaccuccugaaccgucccggcaacggggcuuacacgcugagcgacuucgcggagucaacgugcacccucgcguacggcuccgagugcaaaagcugggagcaccagcuggacgagcuguccuuccccuucuuccacagcaaccucgacaaguauucuaugcuggaggccgccacugagacgauccccauccugaacaagagcuccgccgucugcaccaucucccccuccacccacagcuccaacgccuguggccgggaggcaagccuaaucaagaagaaaugcggaaguaacaugagcgccuuuuucuacgugaaccuggccggccaaauaaccguggucaagugcgacacgaaccacgugcuuaguaacgacugcggcaacugcaucagcaaaacccucuccggccagaaaaucuacaccccagugcaggacauguucugccaaaagggcuggaccgagagcauacccaacacgcgcuacuccaaggacuugugcagcaucgggcugcacagcgucaaggaaugcaaaaccggaacuaccaacuucgagcgggugggcuuuaucguggucaagggccgcaagauguauaucgagcagaugaagaugcggucgcgccaggaguucagcgaggaccaguuccucugcuauaaguccgagagcuccagcggguccagcgugaagcugaagaaggucaaggucgaauccugcaaaggcgugacuaccuccucagccagcaagugcuccggcgaugaguacuucugcagccgguacccgugcgagaccgcgaacgucgaggcccacugcauucugcgccggcacagugccgugaucgaggugaacgucaacgggguguggaucgugccgcgcugcaucggcuacgaggagguccucgugcggcgcaccagucugaagguggaggacacguccucucgggagugcgacacgugccugugggagugcgggaaggacaagcucauagucaagacccacggccccaagaucgucuacgccacugccuguagccacggcuccugcaagagcgugaugcagaagcccgcgacuuucgucuaccugccuuaccccggcaauucagagaucgugggcggggacaucggcgugcacaugaccgaggaaucaucccccagcaacauccauauggucgcccacugccccgcgaaggacuccugcgaggugagcuccugccuguucugcguucacgggcugcucaacuaucagugccacacccuguucagcgcccuucucaucuccaccaccgucaugagcauccugacgcugcuccuucuacucaugaaaggcgccaaggaucuggugaaacgccuguucuacuggcucauaaccccgcugugcuggcuguccguguucugcgggugggucaucaagagcuggaagaagcgggugggauccgcaaucagccgcaccaacgacaccaucggauggagggauaaccgccgcuaccggcaggacguggaaagagcccaguacaccggcggggcccccggggccaaauacaguuucuacggggucauggugcucggucugcuggggaacguucacagcugcagcgagagcgucaucgcugacagcaagaucaugcagugcacgaccuccggcucguccacccucugcaaggcgagcgggaccgugauaaugaaacugggccccauaggauccgagucuugccugauccuaaagggccugaaggacuccgaaaagcaguucaucagcaucaaaaccaucuccagcgagcugaccugccgggaaggcgaguccuucuggaccacgcucuacacccccgucugccugagcucccgcagaugccaccugaugggggagugcgucagcgaccgcugccucaaguggaagaccaacgaaacguccgccgaguucacaggcaaggcgcacggagaggugaugcacgagaaccggugcuucgagcagagcggcgggaucggcuacggcugcuucaacgugaacccgucaugccuguauguccacagcuaccugaaguccguguacaaaaacggguucaagaccuuucgcugugucgccuggaaccaccggauccgccucgagguuaccacccauagccggaaauuccccaugguucugauggcgaugagcacgcaacccacggacuggggcuccauaggccugauccucgacagcgaggggaucaccggcaccaacgccuacagcuucaugcgccacgguagcggcuccuucgccaucaucgacgacccguacagccccgagccccggaagggguuccugggcgaggugcgcugccccacggaggagaccgccauccgggccucgccgagcugcaaaauggcgcccaacuugaucgaguaccagcccgagauggacaccgccgagugcacuacgaacaugaucgaucccauggccaucuucaaccgcggcucccucccgcaggucagagacggcaugacuuucacccagagcaucgagaagaacaccgugcaagcccugacgaccggcgagguucgcgccagcauccggcuaacucucgacgacuacgacgugguauaccagaacagccagucugacuguucggcgaccuucaagaaccugacaggcugcuacuccugcgacgagggcagccgcauguguuaccaggugaaagcugaaggggagacuauauuccacuucauaaacgaggacgaguccaucaacgucaucagcaaggugaaccccgacguguccgacuacugcaccgucuugcacuuuucucggccggugaucagcaucgagggccgguacgacuguggguuguccaagcgccccauggucaucaagggcacccugauugccacggccccgcacgacgaccggaagcacgagggcggaagcucccugauugugaaccccaagggcgggacgguggacuucuuuggcugggugagcggguugaccucauggcucggcggcccucuuaagaccuucuuaaccauacugggauuccuggcccucggccugcugcucguggugauaaucaucauaaucgcgcggacuggggugcagcaggcccugaagaaaaagaacaaguag

SEQ ID NO: 16366 - RNA, 4020 nt, Artificial Sequence
  derived and/or modified CDS sequence (opt11) from TOSV(TOSV-54441132704)__KX010933.1__GP
auguuuaucgccaagcugcuacucaucagcugccugguccagcaggccuaucucaaguacaccaucaucucggagaucggcaacggcacccgcacgagcuucugcuauuccagccggacgucccugggcagccugcucgaggcgugggauaacgucaccgaguccaucgggcugacgagcggcacuugcaagguggggucucuggagaaccgcgacugcagaaaggacauuaugagcaacuacguggccgagguccauuccaaccuccacggccugggggccaugaugcacaacuacggggaugauaagcgcguggaaaucuugaacgacgugauccccgacgagcucaauccgggccaccauaacugcucagaccuggaccgcaagcccuucuggacugaguucauaaacgucgcaaaaccccuguccgaaaucgugcccaugagcgugaucccgccgccgguagucaaguuacagccgcccgcagagcccuccucuaagaagcacgugccuuucgacguccugcuguccgaggcggagaaagagcuaaaccagaccaaaauccgcuuagaagacgaacgcaagagcaacgcugaggagaccgccaaggagagagcccggaugaaagaaaucgaggacgagcugcggcgggaaugggagcucgagcgcaagagaaaggacgcgauggccgacgaucucgcaaaggagacggcccgccggcgggagaucgagcggaaggcucaugagcuggacaaaaugcugaagaaaaaggaacgcaaaucccuuauagcaaaggagaaggcagacguugacaugcggagccacgugcacaagcccaacaccaccagggcacccgcaccaacaaucauuacgacccugcucauggccuccgccgccuuagccgggccucuggagaaccgggagaccaaucaccuccugaaucgccccggcaacggggccuacacacuguccgacuuugccgagagcacgugcacccucgcguacggcuccgagugcaagagcugggagcaccuccuuaacgaggagcuguucccguucuuccacuccaaccuggacaaguacagcaugcuggaggccgccaccgagaccguccccauucucaacaaguccucagcaguuugcacaaucuccccaagcacacacuccagcaacgccugcggccgcgaggcguccgugauacggaagaagugcuacagcaacaugagugccuucuucuacaucaaccuggccggccaaaucaccguuaucaagugcgagaccaaccacguucugagcuccgauugcggcaacugcaucagcaagucccucagcggccagaagguguacacgccuguccaggacguguuuugccagaagggcuggacccagagcaucccguccacccgcuacagcaaagacaucuguuccauaggccugcacaccgugaaggaauguaagaucgggacgaccuccuucgaacgggucggcuucaucgucgucaaggggcgcaaaauguacauagagcagaugaagaugagaucccgccaagaguauagugaggaccaguuccugugcuacaaguccgagagcggcuccggguccuccgugaagcucaagaaauucaaaguggaaucgugcaagggcgucacaacauccagcgcuuccaaaugcagcggcgacgaauacuucugcagccgguaccccugcgagacggcaaacgucgaggcccacugcauccugcgccgccacagcgccaucguggaggucaacgugaacgggguaugggugguaccccgcugcaucggcuacgaagagguccuggucaaaaggaccucccucaagguggaggacaccaccgggcgcgagugcgacaguugccuaugggagugcggcaagaacaaacugaucgugaagacgcaugggcccaaggucguguacgcgaccgccugcagccacggcuccugcaagagcgugaugcagaagccagcgacguucgucuaccugcccuaccccggcaacuccgagauugucgggggcgauaucgggauccacaugacggaggagagcucccccagcaacauccaucuaguggcucacugcccagccagggacuccugcgacgugagcgacugccuguucugcgugcacggccuccucaauuaccagugccacacccuguucuccgcccugcugaucagcacgaccgugaugagcauccuuacccugcuccugcugcuugucaagggggcaaaggaucuggugaagaagcuguucuacuggcucauaacgccucuguguugguugagcguguucugcugcuggguggugaaauccuggaagcgccgggugggcagcgcgaucucgcgcacgaacgacacgauuggauggcgcgaaaaucgccggcaugcucaggacaucgagcgcgcccaguacaccgggggugcccccggggcgaaguauagcuucuacggcguaaugauccucggccugcuguccucggcucagagcugcuccgagagcgugaucgccgacuccaagaucaugcaguguaccacgagcggguccagcaccuuaugcaaggccuccggcacggugauaaugcgccuaggcccgaucggcuccgaguccugccugauucucaaggggcugaaggacagcgagaagcaguucaucuccaucaagaccaucagcuccgagcugacgugccgagagggcgagagcuucuggaccacacucuacacccccaucugccuauccagccgacggugucaccugaugggcgaauguguauccgaccgcugcuuaaaguggaagaccaaccagaccagcgccgaguucacggggaaagcacacggcgacgugaugcacgaaaaccgaugcuucgagcaguccggcggcaucggguacggcugcuucaacgugaaccccagcugccuguacguccacagcuaccugaaguccguguacagaaacggcuucaagguguucagaugcgucgccuggaaccaccgcauucggcucgaggugaccacucacagccgcaaguuucccauggugcugauggccaugagcacacagccuaccgacugggggagcauuggacuuauccucgacuccgaggggaucaccggcaccaauucguauucguucaugaagcacgguagcggcuccuucgccaucauugaugaucccuacagcccugagccccggaaggguuucuuaggagaaguccgcugcccgacggaggagaccgccaugagagcaucccccagcugcaagauggcccccaaucucauagaguaccagcccgagauggauacagccgaaugcaccaccaacaugauugacccgauggccaucuucaaccgcggcucccucccccaggugcgggacgggaugaccuucacccagagcaucgagaagaacacggugcaggcccugacgacuggcgagguaaaggcuucgauucgcuuaauccucgacgacuacgaugugguuuaccagaacagccaguccgacugcucggcgaccuucaagaaucugacggguuguuacucgugcgaugagggcagccggcugugcuaccaggucaaggccgagggcgaaaccauauuccacuucaucaacgaggaggagucgaucaacgucaucaacaaggugucccccggggucagcgacuacugcaccgugcuccauuucucccgcccugucaucucaaucgaaggcaccuacgacugcggacuguccaagcggccgaugguaaucaagggcacguuaaucgccacagcgccccacgacgaccgaaaacacgagggagggaguucccucguggugaaccccaagggcggguccgucgacuucuuuggcuggcucucagggcucaccagcuggcucggcggcccucugaagaccuuccugaccauccugggguuccuggccguaggccugcuccuggucgugaucaucaucaucaucaucaggacggggaugcagcaagcucugaagaaaaagaucaaauaa

SEQ ID NO: 16367 - RNA, 3222 nt, Artificial Sequence
  derived and/or modified CDS sequence (opt11) from SFTSV(HB29)__NC_018138.1__GP
augaugaaaguaauaugguucucuucccucauaugccuagucauccagugcagcggcgacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcguga

SEQ ID NO: 16368 - RNA, 3222 nt, Artificial Sequence
  derived and/or modified CDS sequence (opt11) from SFTSV(Jilin)__KT890281.1__GP
augaugaagguuauaugguucaguucgcuaauuugccuagucauccaaugcggaggggacacagggccgaucaucugugccggccccauacacagcaauaaauccgccaacaucccgcaccuacuaggcuacuccgagaaaauaugccaaaucgaccggcucauacacgugagcucguggcucagaaaccacucccaguuccaaggguacgucggacaacggggcggacggucccaaguaucguacuacccagcagaaaacuccuacagcagauggagcggacuacuaagcccuugcgacgcggacuggcucggcaugcucguaguuaaaaaggcaaagggcucugacaugaucguacccggcccaagcuacaaagggaagguauucuucgaacgcccgaccuucgacggauacguaggaugggguuguggaucaggaaagagccgcacggagagcggggaauuaugcucauccgacagcggcacaucaagcggccuucugccaucagacagaguauuauggaucggagacguagcaugccaaccaaugaccccaaucccagaggaaaccuuccucgaacuaaagagcuucagccagagcgaguucccagacaucugcaaaaucgacgggauaguauucaaccaaugcgaaggagaaucccuuccucagcccuucgacguagcauggauggauguagggcacucccacaaaauaauaaugagggaacacaaaacgaaguggguacaggaaucaagcucaaaagacuucgucuguuacaaagaaggcacaggacccuguuccgaaagugaagagaaaaccugcaagaccucgggguccugcaggggagacaugcaauucugcaaggucgcgggaugcgaacacggagaagaagccagcgaagcaaagugccgaugcagucuagugcacaaaccgggcgaagugguggucaguuacggcggaaugcgcguaagaccuaaguguuacggauucucgagaaugauggcgccacucgaaguaaauccgcccgaacagcggauuggacagugcaccggcugccaucuugagugcauaaacgggggcgugcgccucaucacacucacauccgaacuaaaaagugcgaccgucugcgccuaccauuucugcagcugcgccacaaguggcaaaaagagcaccgagauacaauuccacagcgguucccuagugggcaagacagcgauccacguaaagggcgcccuaguagacgggacagaguucaccuuugaaggcagaugcauguuuccggacggcugcgacgcuguggacugcacuuucugcagagaguuccucaaaaacccacaguguuaccccgcacaaaaauggcuauucaucaucauagucauauuacuaggcuacgcuggauuaaugcuacuaaccaacguccucaaagcuaugggaguguggggaagcuggguaauagcuccggucaagcuaguauucgcaaucaucaaaaagcucaugcgggcuguuucaugccucaugggaaaauuaauggaccgagggcgccaagucauacacgaagaaauaggcgaaaaccgagaaggcaaccaagaugacgucagaauagagauggcacgaccaaggaggguccgccacuggauguauucaccgguaauacagacaaucguggcuaucggacuagcagaaggaugcgacgaaauggugcacgccgacucaaaacuggugucaugcaggcaagggucagggaacaugaaggaaugcgucacgaccggacgagcacuauuaccagcagucaacccaggccaagaagccugccugcacuucacagcgccgggcagucccgacagcaagugucuaaaaauacgggugaaacgcauaaacuuaaaaugcaagaaaaguuccagcuacuuuguccccgaugcacgcucccggugcacgagcguaagacguugccggugggcaggagacugccaaagcgggugucccccacacuucacgaguaacucauucagugacgacugggcaggcaaaauggaucgcgcggggcuuggcuucucaggaugcagcgacggcugcgguggggcggcaugcggaugcuucaacgcggcaccaucaugcauauuuuggagaaaaugggucgaaaacccacacggcaucauauggaaaguauccccuugcgccgccugggugcccucggcaguaaucgagcugacaaugccgagcggcgagguacggacauuccaccccaugaguggaauaccaacccaaguauucaaaggaguaagcgucacguaccuaggcuccgacauggaaguaaguggccuaaccgaccucugcgaaaucgaagaacucaagagcaagaaacuagcgcuagcaccaugcaaccaagccggcaugggagucguaggaaaagucggcgaaauacaaugcuccagcgaagaaucagcgcggacgaucaagaaagacgggugcauauggaacgcagaccuagucggaauagaacucagaguagacgacgccgugugcuacuccaagauaaccuccgucgaagccgucgccaacuacucggccauccccacaaccauaggcgggcuaagauucgagcgcucccacgauucccaaggcaaaauaucaggaaguccccuagacauuacugcaaucaggggcuccuucuccgugaacuaccgugggcugcgccugagucucagugagaucaccgcuacaugcacgggggagguaacgaacguaagcggauguuacuccugcaugacuggugcgaaagucaguaucaaacugcacuccagcaagaacagcaccgcccacguccguugcaaaggagacgaaacugccuucagcguccuagaaggcguacacagcuacagcguaagccugagcuucgaccacgcaguaguagaugaacaaugccaguuaaacugcgggggccacgagagccaagugacccuucgcggaaaucucauauuccuagacguaccaaaauucgucgacggaucauacaugcaaacauaccacuccacagugccaaccggcgccaacauaccguccccgaccgauuggcuaaacgcacucuucggcaacggccuaaguagauggauacuaggaguaauaggagugcuccuaggcggacucgcacucuucuuccuaauaaugagccuguucaaacuaggcacgaagcaaauauuccgcagccggaccaagcuggcguag

SEQ ID NO: 16369 - RNA, 3222 nt, Artificial Sequence
  derived and/or modified CDS sequence (opt11) from SFTSV(05-Lu'an(CHN)-2015)__KX302597.1__GP
augaugaaggugaucugguucuccagccucauaugcuuugugauacaaugcucaggcgacucagggcccaucaucugcgcaggaccgauccacagcaacaaaagcgcugacauaccacaucugcuaggauacagcgagaaaaucugccaaauagacaggcuaauccacgucuccucauggcugcgcaaucacagccaauuccaaggcuacguaggccaaaggggcggaagaagccaagucaguuacuauccggccgaaaauucauacagccguugguccggacugcucagcccgugcgacgcagacuggcucgggaugcuaguagugaaaaaggcaaaaggcucagacaugauagucccaggaccaagcuacaaagggaaagucuucuucgaacgcccuaccuuugacggauacgugggaugggggugcgggucaggaaagucacgcacagaaucaggagaauuaugcaguuccgacagcgggaccuccaguggacuacuuccaucagaucggguacuauggaucggagacgucgccugccaaccaaugacccccauaccggaagaaacguuccuugaacucaagagcuucucacaaagcgaguucccggacauauguaaaaucgacgguauaguauucaaccaaugcgaaggagaaagucucccacaacccuucgacgucgcguggauggacguggggcacucgcacaaaaucauaaugagagaacacaaaaccaaauggguccaggaauccagcucaaaagacuucguaugcuacaaagaagggaccggccccugcucggaaucagaagagaaaacaugcaaaaccuccggaucaugcagaggagacaugcaauucugcaaaguagcaggcugcgaacacggcgaagaagccagcggagccaaauguaggugcagccucguccacaagccgggggaagucgucgucagcuacggcggcaugagaguccgccccaaaugcuacggcuuuagccgaaugauggcaacucucgaggucaaccagccagaacagagaaucggccaaugcacaggaugccaccuggaaugcaucaacggcggcguaagacucauaacacugacguccgaacucaaaucagccaccguaugcgcaucacauuucugcuccucggcaacaucugggaaaaaguccaccgaaauccaauuccacucaggaucccucguaggcaaaacagcgauccacguuaaaggggcauuagucgacggcacggaguucaccuucgaaggcagcugcauguuccccgacgggugcgacgcaguagacugcacguucugcagagaguuccugaaaaacccccaaugcuacccagccaaaaaguggcuauucauaauaaucgugauacuacuaggauacgcagggcuaaugcuacucacgaauguccucaaagccauuggcauaugggguucaugggucauagccccagucaagcucauguucgcaaucauaaagaaacugaugagaacagugagcuaucuaaugggcaaacucauggaccguggcaggcaagucauccacgaagaaauaggcgaaaaccgcgaaggcaaucaggaugacguccgcauagaaauggccagaccccgccgaguccgccacuggauguacagcccuguaauccuaacaauccucgccauaggacucgccgaaucaugcgacgaaaugguacacgcagacuccaagcuaguuuccugccgacaaggcucaggcaacaugaaagaaugcguaacgaccggaagggcccuacuaccugcggucaaccccggacaagaagccugccuacacuucaccgcacccggaagccccgacaguaaaugccucaaaauaaaaguaaaacggauaaauuuaaaaugcaagaaaaguuccucauauuucguacccgacgcacguucgcgaugcacaagcguccgacgaugccggugggccggcgacugccaaucaggaugucccccacacuucaccaguaauagcuucagcgacgacugggccggaaaaauggaccgagccgggcucggauucagcggcugcagugacggaugcggaggcgcagcgugcggaugcuucaacgccgcccccuccugcauauucuggaggaaaugggucgaaaacccacacggaauaaucuggaaagucuccccaugcgccgcaugggucccaagcgccguaaucgaacuaacaaugcccuccggcgaaguacgaacauuccacccgauguccggaaucccaacucaagucuucaaaggaguauccgucacuuaucugggcuccgauauggagguaagcggguuaaccgaccucugcgaaauagaggaacuaaaaucaaagaaacuagcacuagcacccugcaaccaagcggggaugggagucgucggcaaaguaggagaaauacagugcagcagcgaagagucagcacgcacgauaaagaaagacggaugcauauggaacgcugaccuaguaggcauugaacuacgaguugacgacgccgucugcuacagcaaaaucaccucaguggaggcuguugccaacuacagcgccauacccacgaccaucggcggucugagauucgagcgcagucacgacucacaaggcaaaaucagugggucgccacuagauaucacagccauaagaggaucauucuccgucaacuauaggggccuccgccucucacuauccgagaucacggcaaccugcacaggcgaggucaccaacguauccggaugcuacagcugcaugaccggcgcaaaaguauccauaaaacuccauagcagcaaaaacucaacagcccacguacgaugcaaaggagacgaaacagcguucuccguacuagaagguguucacagcuacacggucagccucuccuucgaucacgccgucguagacgagcaaugccaacuaaacugcgggggccacgaaagccaaguaacccucaaagggaaccuaaucuuccuagacguaccgaaguucgucgauggaagcuacaugcaaacauaucauagcacaguccccaccggcgcuaacauaccuuccccaacugacuggcucaacgcauuguucggaaacggucuaagccguuggauacuaggaguuaucggcguccuucugggaggacucgcacuauucuucaugaucaugagccuauucaagcuaggcacaaaacagguguuccgaucgagaaccaaguuggcguaa

SEQ ID NO: 16370 - RNA, 3222 nt, Artificial Sequence
  derived and/or modified CDS sequence (opt11) from SFTSV(07-Lu'an(CHN)-2015)__KX302598.1__GP
augaugaaaguuauaugguucucaucccuaauaugccucguaauacaaugcagcggcgacagcggcccaauaauaugugccggaccgauacacagcaacaaaucagcagggauaccccaccuacucggguacucagagaaaauaugccaaauagacagacugauacauguuagcagcuggcuucguaaccacucacaauuccaaggguacgugggacaacgcggugggaggucccaagucucguauuaccccgcagaaaacucauacagcagauggagcggcuuacugucacccugcgacgccgacuggcuaggaaugcuagucguaaagaaagcuaaagaaucagacaugauaguaccagggcccuccuacaaaggaaaaguauucuucgaaaggcccacauucgauggauaugucggcuggggcugcggcagcggaaagagccgcaccgaaaguggcgaacucugcucaagcgacagcggcacaagcagcgggcuacuaccuucggacagagugcuauggaucggcgacgucgccugccagccaaugacacccauccccgaagaaacauuccucgagcuuaagucguucagccaaagcgaguucccugacauaugcaagauagacggcaucguguucaaccaaugcgaaggcgaaucauugccacagcccuucgacguggccuggauggacguaggacacagccacaaaauaaucaugagggaacacaagaccaaauggguacaggagucgagcuccaaagacuuugucugcuacaaagaaggaacaggcccaugcucggagucagaagaaaaagcaugcaagacaagcggcagcugcagaggcgacaugcaauuuuguaaagucgccggaugcgaacacggcgaagaagccucagaggccaaaugccgcuguagccucguacacaagcccggagaggugguggucaguuacggcggcaugcgcgugagacccaaaugcuacggguucagccguaugauggccacauuagaagucaaucccccggagcaaaggauuggucaaugcacaggaugccaccucgaguguaucaacggcggcgugcgauuaauaacacucaccagugaacuacgguccgcaacugucugcgccagccacuucuguucaagcgcaaccucaggcaagaaaucaacagaaauacacuuccauucagguagccuaguuggcaaaacugcuauccacgucaaaggugcacuuguugacgguacagaguucaccuucgaaggaagcugcauguucccggacggcugcgaugcaguggacugcacauucugcagagaguuccuuaaaaacccccaaugcuaccccgcgaagaaauggcuguucaucaucaucguaauccuucucggauacgcgggucuaaugcuucucacaaacguccugaaagcaaucggagucuggggauccugggucaucgccccagucaagcucauguucgcgauaaucaaaaagcucaugcgcacaguaagcugccugguaggaaaacuaauggacagaggcagacaaguaauccaugaagaaaucggcgaaaacggggaaggaaaccaggacgacguccgcauagaaauggcacgaccgcgacgcguuagacacuggauguacucgccaguaauccucacaauccuagcaauaggucucgccgaaggaugugacgaaaugguccaugccgacucgaaacuggugaguugccgacagggaaguggcaacaugaaagagugcauaacaacaggccgcgcacuauugccagcagugaacccaggccaagaggccugccuacacuucacugcaccuggaagcccagacucaaaaugccucaagaucaaaguaaaacgcauuaaccugaagugcaagaaaaguagcagcuauuucguaccugacgcaagaagucggugcacaagcguacgccggugccggugggcaggagacugccaaagcggcugcccaccccacuucacuagcaauagcuucuccgacgacugggcaggaaaaauggaccgggccggacucggcuuuucggguugcagugacggcugcggaggagcagcaugcgguugcuucaacgcggccccgagcugcauauucuggagaaaaugggucgaaaacccccacggaauaauauggaaagucucgcccugcgcggcgugggucccaucggccgugauagagcucacaaugccaagcggagaaguaagaacauuccauccgaugucagggauaccaacacaagucuucaaaggagucucagugaccuaccuaggcagcgacauggaagucagcggacucaccgaccuaugcgaaauagaagaacucaaaagcaagaaacuggcacucgcgcccugcaaccaagccggcaugggcgucguuggcaaagucggggaaauccaaugcuccuccgaggaaagcgcccgcaccaucaagaaagacggcugcaucuggaacgcagaccuggucggaaucgaacucagagucgacgacgccgugugcuacagcaaaaucaccucaguagaggccguagccaacuauagcgcaauaccuacaacgaucggcgggcuccgcuucgagcgcucccacgauagccaaggaaaaauaagcggaucaccguuagacauaaccgcaauacgagggagcuucuccguaaacuacagggggcuccggcuaucgcuauccgaaaucaccgcaaccugcacaggagaggucacgaacguauccggcugcuacagcugcaugacaggagccaaaguaagcauaaaauuacacuccagcaaaaacuccacggcccacguacggugcaaaggcgacgaaacagccuucucaguccuagaaggugugcacagcuacaucgucucgcugagcuucgaccacgcaguagucgacgaacaaugccagcugaacugcggaggacacgagucgcaaguaacccucaaaggaaaccucaucuuccuugacguccccaaauuuguugacggguccuacaugcaaacauaccacagcacaguacccaccggcgcuaacaucccaagccccacugacuggcugaaugcccuuuucggcaacggcuuaucacguuggauacuaggcguaaucggaguacuccuaggagggcuagcccuauucuuccucaucauguuccuccuuaaacugggcaccaaacaaguguuccggagcagaacaaaacucgccuaa

SEQ ID NO: 16371 - RNA, 3222 nt, Artificial Sequence
  derived and/or modified CDS sequence (opt11) from SFTSV(12-Lu'an(CHN)-2014)__KX302595.1__GP
augaugaaaguuaucugguucaguagcuuaaucugccucgucauucaaugcuccggcgacacuggcccgauuaucugcgccggcccaauccacagcaauaaauccgccaauauaccgcacuuacugggguacagcgaaaagauaugccaaaucgacagguuaauccacgucucaucauggcuaagaaaccacucccaauuccagggguacgucggacaaagaggaggacgcucccaagucucauauuauccggcagaaaacuccuacucaagguggagcggccuacucucaccuugcgacgcagacuggcuaggaaugcuagucgucaaaaaggccaagggaucggacaugaucguacccgggcccucguacaaaggcaaaguauucuucgaaagaccgaccuuugacggauacguaggauggggcugcggcucaggcaagucacgaaccgaaagcggcgaacuaugcagcagcgacuccggaacuagcuccgggcuccuucccucagaccgaguccuauggaucggcgacgucgccugccaaccaaugaccccuauccccgaagagacauuccuagaacugaaaaguuucagccagagcgaguuccccgacauaugcaaaguggacgggaucgucuucaaccagugcgauuccgaaucgcuaccgcagcccauagaugucgccuggauggacguagggcacagccacaaaauaauaaugcgggaacauaaaacgaaauggguccaggaaagcagcuccaaagacuucgucuguuacaaggaaggaacaggccccugcagcgagagugaagagaaaaccugcaaaaccucaggguccugcagaggugacaugcaauucugcaaaguggcaggcugcgaacacggggaggaagccagugaagcaaagugccgcugcucccucguccacaaaccaggcgaaguagucgucucauacggcggcaugcgcguacgcccaaaaugcuauggcuucagccgcaugauggcgacccuugaaguaaauccacccgaacaaagaaucgggcaaugcacaggcugccaccucgaaugcaucaacggaggcguuagacucauaacccucacauccgaguugaaaagcgccaccgucugcgcgucccacuucugcagcucagccacaagcggcaagaaaagcaccgaaauccaauuccacuccggcucccuagugggcaaggccgcaauacacguaaaaggcgcccucguggacggaacugaguucacauucgaaggcuccugcauguuccccgacggaugcgacgccguagacugcacauucuguagggaguuccuaaagaacccacaguguuacccagcuaagaaauggcucuuuauaaucauaguaauccuccuuggguacgccggccucaugcuacucacgaacguccucaaggccauaggaguaugggggucuuggguaauggcaccugucaagcucauguucgcaaucaugaagaaacugaugcgauccgucucgugccugaugggaaaacuaauggaccgcggacgccaagucauccacgaagaaaucggagaaaaccgagaagguaaccaagacgacgucagaaucgaaauggcccgcccgcgacgaguccgacacuggauguacagcccggucauacuaaccauccuagcaauaggccuggccgaaggcugcgacgaaaugguacacgcagauucaaagcuagucucaugccgccaaggaucgggaaacaugaaagaaugcguaacuacaggacgcgcccuacuccccgcggucaacccaggccaggaagccugccuccacuucacagcccccggcucccccgacucaaaaugccuaaaaauaaaagucaagcgaaucaaccugaaauguaagaaaagcagcuccuacuucguacccgacgcaagaucacgaugcaccagcgucaggcgcugccgaugggcgggggacugccaaagcgggugcccaaguuacuucacgucaaacagcuucagcgacgacugggcagggaaaauggaucgagccggccucggcuucucuggaugcuccgauggcugcggaggggccgcaugcgggugcuucaaugcggcccccaguugcauauucuggcgaaaaugggucgaaaacccacacggcauaauauggaaagugucaccuugcgccgcauggguccccagcgcggucaucgaacuaacaaugccuucaggggaaguacgaaccuuccaccccaugagcggcaucccaacucaggucuuuaaagguguaucaguaacauaccuuggcuccgacauggaaguauccggacuaacagaucucugcgaaauagaggaacuaaaaagcaagaaacucgcccucgcacccugcaaccaagcgggaaugggcgucguaggcaaagucggagaaauacaaugcagcucggaggaaucagcucgcacaaucaagaaagacggcugcauauggaacgcagaccuugucggaauagaacugagaguggacgaugcggucugcuacuccaaaauaacauccgucgaggcagucgccaacuacucagccauccccacuacaauaggcggacuacgauucgaacgaucacacgacucccaaggcaaaauauccgguucaccauuggacaucacagcaauucgaggcucuuucagcgucaauuacagaggccuacgccuuagccucuccgaaauaacagcgacaugcacgggcgaagucacgaacgucucagggugcuacucaugcaugaccggagcgaaaguaucuauaaaauugcacucaagcaaaaauucaaccgcacauguacguugccgaggcgacgaaaccgcauucucgguccuagagggaguacacagcuacacagugucccuaucauuugaccaugcagugguagaugagcaaugccaacucaacugcggcggccacgagucucaagucacacucaaagggaaccucaucuuccucgacgucccaaaauuugucgacgggucguacaugcaaaccuaccauagcagcguaccaaccggagcaaacauaccuaguccaacggacuggcucaacgcccuguucggcaauggccugagcagauggauccuagggguaaucggagugcuacugggaguccucgcccuuuucuuccugauaaugagccucuucaaacucgggaccaaacaagucauaagaucaaggaccaaacucgcauaa

SEQ ID NO: 16372 - RNA, 3222 nt, Artificial Sequence
  derived and/or modified CDS sequence (opt11) from SFTSV(14-Lu'an(CHN)-2014)__KX302596.1__GP
augaugaagguuaucugguucuccucgcuaaucugccucguaauccaaugcagcggcgacacaggaccgaucauaugcgccggacccauccacucaaauaaaucagccaacauaccacaccuacucggcuacagcgaaaagaucugccagaucgauaggcuaauacauguuaguucgugguuacgcaaccacucccaauuccaagguuacguaggccaacgcgggggacggucacaggucucauacuauccagcggagaacuccuacaguaggugguccggcuuacugucccccugcgacgcagacuggcuagggaugcucguagugaaaaaggccaaaggcuccgacaugaucguaccaggccccagcuacaaaggaaagguauucuucgagcgaccaaccuucgacggcuacgugggauggggcuguggcagcggcaaaagucgcacggagagcggcgaacuaugcagcagcgacagcgggaccagcucuggacuacuaccaucggacaggguauuauggauaggagacgucgcgugccaacccaugacaccaaucccagaagaaacauuccuagaacucaagagcuucucacaaagcgaguucccagacaucugcaaaguugacggcauagucuucaaccagugcgacagcgaaagccucccgcagccgauagacguggcauggauggacgucgggcauagccacaaaauaauaaugagagaacacaaaaccaaauggguccaggaauccaguucaaaagacuucguaugcuacaaagagggcaccggaccgugcucggaaucggaggagaaaacaugcaaaacauccggaagcugccgaggggacaugcaauucugcaaaguggccggcugcgaacacggggaagaagccagcgaagccaagugucgcugcucccucguacacaaaccaggcgaggucguuguaagcuacgguggcaugcguguacgcccgaaaugcuauggauucagccggaugauggcaaccuuagaagugaauccaccggagcagaggaucggacaaugcaccgguugccaccucgagugcaucaacggaggcgucagacuaaucacacucaccucagagcugaaauccgcgacagucugcgccagccacuucugcagcuccgccacaagcggaaagaaauccacagagauacaauuccacagcggcagccuagugggaaaagcagcaauacacguaaaaggggcgcuaguagacggaaccgaguucacguucgaaggaagcugcauguuuccagacgggugcgaugccgucgacugcaccuucugccgcgaguuccucaaaaacccccaaugcuacccagcgaaaaaguggcuauuuaucauaaucgucauccuccucggcuacgcagggcucauguuacuaacgaacguacucaaagcuauaggcguguggggaagcugggucauggcgccaguaaaacucauguucgcaaucaugaaaaagcuaaugcgaucaguuaguugccuaaugggaaaacugauggaccgcggccgacaggugauccacgaagaaauuggcgaaaauagagaaggaaaccaagacgaugucaggauagaaauggcccgcccacgccgcguacgccacuggauguacagcccgguaauucuaacaaucuuagcaaucggccuugccgaaggcugcgaugaaauggugcacgcugacaguaagcuaguaucaugcagacagggaagugguaacaugaaagaaugcgucacaacagggcgcgccuugcucccagcuguaaacccaggccaagaggcaugccuccacuucacagcaccuggguccccggacuccaaaugccuuaagaucaaggugaaacggaucaaccuaaaaugcaaaaagagcagcucauacuucgucccagacgcccgcucccgcugcacaagcguccgccgaugcagaugggccggugacugccagucuggcuguccgucucauuucacaagcaauuccuucagcgaugauugggccggcaaaauggacagagccgggcucggguuuucaggcugcagcgacggcugcgggggugcagcgugcggcugcuucaacgcggcaccaagcugcaucuuuuggcgcaaaugggucgaaaacccacacggaauaaucuggaaggucagcccuugcgccgcauggguaccaagcgcagugauagaacuaacuaugccgagcggggaaguacgcacauuccacccaaugucaggcauuccgacccaaguauucaagggagugagcguaacguaccugggauccgacauggaaguaagcgggcucaccgaccuaugcgaaaucgaggaacuaaagucaaagaaacuugcccucgcaccgugcaaucaagcuggcaugggcguggugggcaaagucggugagauccaaugcagcucagaggaauccgcgagaacgauaaagaaagacggaugcaucuggaacgcugaccucgugggcaucgaacuccgcguagacgacgcggucugcuacucaaaaaucacaucaguagaagccguggcgaacuacagcgcaauaccuacaacaauagguggucucagauucgaaagaucacacgacucucagggaaaaauuucgggcucgccccuagacaucaccgcaaucagaggcucauucucggucaacuaccggggccuaagacuaucacugagcgaaauaacggccacaugcacuggagaaguaacaaauguaagcgguugcuacagcugcaugacgggcgcgaaggucaguauaaaauuacacagcagcaaaaacucgaccgcgcacguccgcugccggggcgacgagacggccuucucaguacuggaaggcguucacagcuacacagugagucucagcuucgaccacgccgugguagacgaacagugccaacucaacugcgguggccacgaaucacaagucacccugaaagguaaccugauauuccucgacguaccgaaauuugucgacggaaguuacaugcaaacguaccacucuagcguaccaacaggggccaacaucccgagcccaacugacuggcuaaacgcgcuauucggcaauggccucagccgauggauccucggggucauagggguacugcuaggcguacuggcacuuuucuuccuaaucaugagccuauuuaaacucggcacuaagcaagucuucagaagccgaacaaaacucgcguga

SEQ ID NO: 16373 - RNA, 3222 nt, Artificial Sequence
  derived and/or modified CDS sequence (opt11) from SFTSV(18-Lu'an(CHN)-2015)__KX302599.1__GP
augaugaagguuauaugguuuuucucacuaauaugcuucguaauacaaugcucaggugacucagggccaaucauaugugcaggccccauccacuccaauaaaucagccgacaucccgcaccuccuaggauacucagagaaaaucugccagaucgacagacuuauccacgucaguucauggcugcgcaaccacagucaauuccaaggguacgugggccaaagagggggccggucccaaguaucguacuaccccgcagaaaacagcuacucccgguggagcggccugcucucaccaugugacgcggacuggcucggaaugcucgucgucaagaaagcgaaaggcagugauaugaucgugcccggccccagcuauaaaggcaaagucuucuucgaacgaccaaccuucgacggcuacgugggauggggcugcggaucgggcaaaucacgcacagagucuggggaacuaugcaguuccgacagcgggaccucaagcggucuccuacccucugacaggguacucuggauaggugacguugcgugucaaccaaugaccccgaucccggaagaaaccuuccuagagcucaagagcuucagccaaagugaguucccggacauaugcaaaaucgacggaauuguauuuaaccaaugcgagggcgaaagccucccccaacccuucgacguagcauggauggacguuggacacucccacaaaauaauaaugagggagcacaaaacaaaaugggugcaagaaagcagcagcaaagacuuugugugcuacaaagaaggaaccggaccaugcagcgaauccgaagagaaaacaugcaagacaagcggcucgugccggggcgacaugcaauucugcaaaguagcagggugcgaacacggcgaagaagccuccgaagcgaagugccggugcucccuuguccacaaacccggcgaagucguaguaucguacagaggcaugcgaauccgcccaaaauguuacgguuucucacgaaugauggcgacccucgaagucaaccagccagaacaacgaaucgggcaaugcaccgggugucaccucgaaugcauaaacggcggaguaagauuaaucacacucacaucagaacuaaagucggccaccguaugcgcaagccauuuuugcagcagcgcaaccagcgggaagaaaucaacagaaauacaauuccacucaggcucgcuuguagggaaaacggcaauccacgucaaaggagcccuggucgacggcaccgaguucaccuucgaaggcuccuguauguuccccgacgggugcgaugcagucgacugcaccuucuguagagaguuccucaagaauccacaaugcuauccagccaaaaaguggcuguucauaaucaucgucauccuacuaggcuacgcaggccugaugcuacuaacgaacguacuaaaagccauaggaauauggggcaguugggucauagccccagucaagcugauauucgcaauaaucaagaaacucaugcgcacaguaaguugccugaugggaaaacuuauggacagaggacgccaagucauacacgaagaaauaggcgagaacagagaagggaaccaagacgacgucagaaucgagauggcgcgaccacgaagaguuaggcacuggauguacagcccagucauacucacgauauuggcaauagggcuugccgagggaugcgacgagaugguacaugcggacagcaaacucgucagcugccggcaaggcagcggaaacguaaaagaaugcgugacaaccggcagagcccugcuaccagccgugaacccaggccaggaagccugcuuacacuucacagcacccggcucacccgacagcaaaugccuaaagauacgcgucaaacgcaucaaccugaaaugcaagaaauccaguuccuacuucgugccagacgcccgcagccgcugcacgagcguacgaagaugcagaugggcaggggacugccaaagcggaugcccuccccauuucacaaguaacuccuucagcgacgacugggcaggcaaaauggaccgcgccggccucggauuuucgggcugcagugacggaugcggcggcgcggcuugugggugcuucaacgcggcacccagcugcaucuucuggagaaaauggguagaaaacccacacggcaucauauggaaaguaucaccaugcgccgcuuggguacccucagccgucaucgagcuaaccaugcccuccggugaagucaggacauuccauccuaugaguggaaucccgacccaagucuucaaggggguaucgaucaccuaccuagguucggacauggaagucagcggacugacagaccuaugugaaaucgaagaguugaaaucaaagaaacucgcacuagcgccaugcaaccaggccggaaugggaguggugggcaaagucggagaaauccaauguucaucagaagagagcgcacguacaaucaagaaagacggcugcaucuggaacgccgaccuagugggcaucgaacucagggucgacgacgcagucugcuacucgaaaauaaccucggucgaagcgguagccaacuacucagcaauacccacuacaauagggggccuaagauucgaacgcucacacgacucccaaggcaaaaucucgggaucaccccuagacauaacugccauaagaggguccuucuccgucaauuaccgcggacuccgccugucccuguccgagaucacggcaaccugcacaggcgaaguuacgaacgugagcggaugcuacagcugcaugacgggcgcgaaaguaagcaucaaacuccacuccaacaagaacagcaccgcccacgugcgcugcaaaggagacgaaacagcguuuuccguacuggaagggguacacagcuacacaguaucccuaucauucgaccacgccguaguagacgagcaaugccaacucaacugcggaggccacgaaucacaaguaacucuaaagggcaaccugaucuuccucgacguacccaaguucguagauggcuccuacaugcaaacguaccauuccacaguaccaaccggagcaaauaucccaagccccaccgacuggcugaacgcacucuucggcaacggacucagcagauggauacuagggguaauaggagugcuccuaggagggcuagcccuauucuucaugaucaugagccucuucaagcuaggcacaaagcaagucuucagaucgcgaaccaaacuagccuaa

SEQ ID NO: 16374 - RNA, 3222 nt, Artificial Sequence
  derived and/or modified CDS sequence (opt11) from SFTSV(27-Lu'an(CHN)-2015)__KX302600.1__GP
augaugaaagucaucugguucuccagccucaucugcuuuguaauccaguguuccggcgacucaggccccaucauaugcgcaggcccaauccacucaaacaaaucagcugacauaccacaccuacucggcuacuccgagaaaaucugucaaauagaccgacuaauccacguaucaucauggcuacgaaaccacucacaauuccagggauacgucggccaacgagguggcaggagucaaguaucguacuacccagccgaaaacagcuacaguagauggucaggacuacuuucacccugcgacgcagauuggcucggaaugcugguaguaaagaaagcgaaaggcagcgacaugauaguaccgggaccauccuauaaaggcaaagucuucuucgagaggccgacauucgacggcuacgucggcuggggcugugguagcgguaaaagccggacagaaagcggggaauugugcuccuccgacucgggcacaagcucaggacuucuaccauccgacagaguccuauggauaggcgacgucgccugccaaccaaugacaccaaucccagaagaaaccuuccuagagcuaaaaucauucagccaaagcgaguucccugacauaugcaagauagaugggauagucuucaaccaaugcgaaggugaaucacucccacagcccuucgacguagccuggauggacgucggccacagccacaaaaucauuaugcgggaacacaagaccaaauggguccaagaaagcuccuccaaagacuucguaugcuacaaagaagggacaggcccaugcuccgaauccgaagagaaaaccugcaaaacaagcggcagcugcaggggcgacaugcaguuuuguaaaguugcaggaugcgaacacggcgaagaggccagcgaggccaaguguaggugcagccuagugcauaagccaggcgaaguaguagucuccuacggcggcaugcgcauacgccccaaaugcuacggauuuucgcgaaugauggccacccuagaagucaaccagccggaacaaagaauaggucaaugcaccggcugccaccucgaaugcauaaacggaggagucagacuaaucacacucacgagugaacucaaauccgccaccgucugugccucacacuucugcucauccgccaccuccggaaagaaauccaccgaaauccaauuccacucgggaucccuuguaggcaaaacagccauacaugucaaaggagcacucguggacgggaccgaguucaccuucgaaggcuccugcauguucccugacggcugcgacgccgucgacugcacguucugccgcgaguuccugaaaaacccccagugcuacccagccaagaaauggcucuuuaucaucaucguaauacuucuuggauaugcgggcuuaauguugcucacaaacgugcucaaagccaucggaauauggggaucauggguaaucgccccaguaaaacucauuuucgcgauaaucaaaaagcuaaugagaaccguauccugccugaugggaaaacucauggaccgaggccgacaagucauacacgaagaaaucggcgaaaaccgggaaggcaaccaagacgauguccguaucgagauggcacgcccacgcagagucaggcacuggauguacucccccguaauacuuacaauacuagcaaucggccuggcugaaucaugugacgaaaugguccacgcugacaguaaacucguuagcugccgccaaggaucagguaacaugaaagaaugcgucaccacgggacgagcacuccuuccggccgucaaccccggccaagaagcaugucuacacuucacggcccccgggagcccggacagcaagugccuaaaaaucaaggugaagcguaucaaccuaaagugcaagaaaagcucaagcuacuucgucccagacgcccggucccgaugcaccucaguacgucgcugcagaugggcgggcgacugccaauccggaugcccaccccauuucaccucaaacagcuucagcgacgacugggcgggaaaaauggacagagcagggcuaggcuuuucaggaugcuccgauggaugcggaggagccgccuguggcuguuucaacgcugcacccucuugcaucuucuggcgaaaguggguagaaaacccccacggcauaaucuggaagguaucccccugcgcggccugggucccguccgcaguuaucgaacucacaaugcccagcggcgaggugcggacauuccaccccaugucaggaauccccacccaggucuucaaaggcguauccguaacguaccucggcucagacauggaagucaguggacucacagacuuaugcgagaucgaagaacuaaagagcaagaaacucgcccucgcgcccugcaaccaggcgggaaugggaguagucggaaaagucggcgaaauccagugcagcucggaagaaagcgcccgcacaauaaagaaagacggcugcauauggaaugcggaccuaguaggcauagagcugagaguagacgacgcagucugcuacuccaaaauaacaagcguugaagccgucgccaacuacucggcaaucccgaccacuauaggcggccugcgauuugagagaucccacgacucacaaggcaaaauauccggcuccccucuagacaucaccgccauucgcggcuccuucuccguaaacuacagaggccuacgccuaucccuauccgagaucacagccacaugcaccggcgaagucaccaacguaucaggaugcuacuccuguaugacgggcgccaaggugucgauuaaacuacauucauccaaaaacucaaccgcccacguccgaugcaaaggcgacgaaacagcauuuagcguacuggaaggcguccacucauacaccguaagucuauccuucgaucaugccguaguggacgaacaaugccaauugaacugcggaggacacgagucccaagucacacuuaaaggaaaccucaucuuccuagacgucccuaaauucgucgacggcucauacaugcagacauaucauagcaccguuccaaccggcgccaacauccccucgcccacggacuggcucaacgcacucuucggcaacgggcugucccgguggauacuaggcguaaucgguguacuauugggaggccuagcucucuucuucaugaucaugucacuauucaaauuaggaacaaagcaagucuuccgcagcagaaccaaacuagcauaa

SEQ ID NO: 16375 - RNA, 3222 nt, Artificial Sequence
  derived and/or modified CDS sequence (opt11) from SFTSV(36-Lu'an(CHN)-2015)__KX302601.1__GP
augaugaaaguaaucugguuuuccucgcucauaugcuucgucauacaaugcagcggagacucgggacccaucaucugcgccggaccuauccacagcaacaaguccgccgauaucccacaccuacugggauacucggagaaaauaugccaaaucgacagacuaauacaugucagcuccuggcucagaaaccauucacaauuccagggguauguaggacagcggggaggcaggagccaaguaucauacuacccagccgaaaacagcuacagccgguggucaggccuccuaucccccugcgacgccgacuggcucggaaugcuaguggugaaaaaggcaaaggguuccgacaugauaguaccugggcccucauauaaaggcaaggucuucuucgaacgcccaacguucgacggauacgucggguggggaugcggauccggaaaaagccgaacagaaucaggcgaacuguguucgucggacucagggaccucaucaggacuccuacccucagacagaguacuguggaucggcgacgucgcaugccagccgaugacgccaaucccugaagaaacguuccucgaacuaaaaucauucucccaaagugaauuuccagacauaugcaagaucgaugguauagucuuuaaccagugcgaaggagaaagccugccacaaccauucgauguggcauggauggacguagggcacagccacaaaauuauaaugagggaacacaaaacgaaauggguccaagaaucgagcagcaaagacuucgucugcuauaaagaagggacaggaccgugcucagagagcgaagagaaaaccugcaagacgucaggcucaugcaggggagacaugcaauucuguaaaguagcaggcugcgaacacggggaagaagcgucggaagcgaaaugccgcuguucccucguacauaaaccaggagaagucgugguaagcuaugggggaaugcgcguacgaccaaagugcuacggauucagccgcaugauggcgaccuuggaagugaaccagccagagcagaggauaggucagugcaccggaugccaucuggagugcauaaacggcggcguacgccucauaacacucaccagcgagcucaaaagugcaaccguaugcgcgagccacuucugcuccucugccacauccggaaagaaaagcacagaaauccaguuccacuccgggagucucguaggcaaaaccgccauccacguaaagggagcacugguggacggaacugaguucacauuugaaggcucgugcauguucccagacgggugcgacgccguugacugcacauucugcagggaguuccuaaagaacccacaaugcuacccagccaagaaauggcuguucaucauuauaguaauacuccucggguacgcaggacucaugcuccugacgaauguccugaaagccaucggcauuugggggagcuggguaauagccccaguaaagcucauguucgcaaucauuaagaaacucaugcgcacaguauccugccuaaugggcaaacucauggaccgcggacgccaagucauacacgaagagauaggcgaaaacagagagggcaaccaggacgacguaaggaucgaaauggcgcguccacgcagaguaagacauuggauguacuccccggucguccucacaauccuagcgauaggcuuagcggaauccugugaugagaugguucacgcggacagcaaacucguauccugcaggcaaggcagcgguaacaugaaagaaugcgugaccacaggcagagcccugcucccugcggucaaccccggccaggaagcgugccuacacuuuaccgcacccgggucacccgacagcaaaugucucaaaauaaaaguaaagcggauaaacuuaaaaugcaagaaaucaucaagcuacuuugugcccgacgcaaggagcagaugcacgagcguccgcagauguagaugggcgggcgacugccagagugggugcccuccccacuucacauccaauagcuucagugacgauugggcagggaaaauggaccgggccggacucggguucucggggugcucagauggaugcggcggugcggcaugcgguugcuucaacgcggcaccuagcugcauauucuggcgaaaaugggucgagaacccgcacggcauuauauggaaagugaguccaugugccgcauggguacccucugcugucaucgaacuuaccaugccaagcggagaaguacgcacguuucaccccauguccggaauccccacccaggucuucaaaggggucagcgucacuuaccuagggucggacauggaagugagcgguuuaacagaccugugcgaaaucgaggaacugaaaucgaagaaacuggcacuagcgccaugcaaccaggcaggcaugggcguuguggggaaaguaggugaaauccaaugcuccucggaagaauccgcgcgcacgauaaagaaagacggcugcauauggaacgccgaccucgucgggaucgaacuccggguagacgacgccguuugcuacuccaaaauaacaagcgucgaagcugucgcaaauuauucggcaauucccacgacaaucggagggcuacgguucgagcguucgcacgauagucagggaaaaauaaguggaucaccacuggacaucacagcaaucagagggagcuucucagucaacuaucgcggacuccgacuguccuugagugaaauaacagcaaccugcacaggcgaaguaacaaacguaagcgggugcuacagcugcaugaccggagccaaagugagcauaaaacugcacagcuccaaaaacucuaccgcccacguccgcugcaaaggagacgaaaccgcauucucaguccucgaaggaguacacucuuacacagucagccucucauucgaucacgcaguggucgacgagcagugccaacucaacugcggcggacaugagagccagguaacucucaaaggcaaccuaauauuccuagacgugccgaaauucgucgacgggucuuauaugcaaacguaccacagcacaguuccgaccggagccaacauaccgagcccgaccgauuggcugaacgcgcuauucggcaacggacucagccgcuggauccuaggaguaauaggcguccuacuaggcggacucgcgcuauucuuuaugaucaugagcuuguucaaacuagggacgaagcaaguauuccggagccgaacaaaacuagcauaa

SEQ ID NO: 16376 - RNA, 3222 nt, Artificial Sequence
  derived and/or modified CDS sequence (opt11) from SFTSV(42-Lu'an(CHN)-2015)__KX302602.1__GP
augaugaaaguaauaugguucagcagccucaucugcuuuguaauccaaugcucaggcgacuccggcccgauaauaugcgccggccccauacacagcaauaaaucagccgauauaccacaucugcugggguucucagagaagauaugccaaauagaccgacuaauccacgugagcuccuggcuacgaaaccacucgcaguuucagggguacgugggacagcgcggaggcaggagccaggucagcuacuaccccgcggagaacagcuauucacgcuggucgggccuacuuagcccuugcgacgccgauuggcucggcaugcuagucguaaagaaagccaaaggaagcgauaugauagugccagggccaucguacaaaggaaaaguuuucuucgagcgucccaccuucgauggguacguaggcuggggcugcgggucagggaaaucaagaacagaaucaggggagcucugcagcagcgacagcggcacaucaagcggucuacuccccagcgacaggguacuauggauaggagacguagccugccaaccgaugacucccaucccagaagaaacguuccucgaacucaagagcuucagccaaagugaauuuccugacauaugcaaaauagacggcauagucuucaaccagugcgaaggggagagccuaccccagcccuucgacguagcauggauggauguaggacacagccacaagauaauaaugcgggaacacaaaacaaaauggguacaagaaagcuccagcaaagauuucgucugcuacaaagagggcacagggccaugcucagagucggaagagaaaacgugcaagaccagcggcaguugcagaggcgacaugcaauucuguaaaguagccggaugcgaacacggggaggaagccucagaagccaagugucgauguagcuuaguccacaagccgggagaggucguugucuccuacggacgaaugagaguccgacccaaaugcuacggguucucgcgcaugauggcaacacuagaagugaaccaaccagagcaaagaauaggacaauguaccggcugucaccucgaaugcauaaacgguggaguaagacuaauaacgcuaaccucagagcucaagagcgcaaccgucugcgcaagccacuucugcaguuccgccacauccggaaagaaaagcacagaaauccaauuccacucaggaucgcuagucggaaaaaccgccauacacgucaaaggugcccucguagacgggacugaguucacguucgaaggaaguugcauguucccugacggaugcgacgcgguggauugcaccuucugccgugaauuucugaaaaacccccaaugcuacccagccaagaaguggcuauucauaauuaucguaauacuacucggauacgcaggacuaaugcuacuaacaaacguacucaaagccauaggaaucugggggagcugggucaucgcaccagucaaacuaaucuuugcaaucauaaagaaacuaaugagaaccguaagcugucucaugggaaaacuuauggacaggggaagacaagucauucacgaagaaauaggagaaaaccgagaagggaaccaagacgacguccgaaucgagauggcacguccacgaagagucagacacuggauguacagccccguaauacuaacgauccuagccaucggccuagcagaaaguugugacgaaaugguacacgccgacucgaaacugguaucuugccgccaagggagcgguaacaugaaagagugcgucaccacagggcgagcccuacucccggcagugaacccgggacaagaagcaugccugcacuucacagccccggggagucccgacagcaaaugccuaaagauaaagguaaaacgaaucaaccucaaaugcaaaaagaguucaaguuacuucguacccgacgcccggucccgcuguacaagcgugcgacgcugccgaugggcgggcgacugccaaagcggaugcccaccacauuucacaagcaacagcuucagugacgacugggcgggcaaaauggaccgggcaggccucggauucucgggcugcagcgacggaugcggcggggccgcaugcggcugcuucaacgccgcacccuccuguaucuucuggcgcaaauggguagaaaacccccaugggaucauauggaagguuuccccaugcgcggcauggguaccaagcgcagucauagaacuaacgaugcccagcggcgaaguacgcacauuccaccccauguccggaauccccacacaaguauucaaaggaguauccgucaccuaccuaggaagugacauggaaguuagcggccuaacagaccucugcgagaucgaggaacucaagaguaaaaagcucgccuuggcgccaugcaaccaagccgggaugggugugguaggaaaaguaggggaaauacagugcagcagcgaggagagcgccagaacaaucaaaaaggacggcugcauauggaaugcagaccuagucggaauagaacuacgagucgaugacgcugucugcuauagcaaaaucacauccgucgaggccguuagcaacuacuccgcaauuccaacgaccauaggaggacuccgauucgaacgaagccacgacagccaagggaaaauaucagggucaccccuggacaucaccgcaaucagaggcagcuucuccgucaacuacagaggccuuagacuaagccuguccgaaauaaccgcaacguguaccggcgaagucacaaacguaagcggaugcuacucaugcaugaccggagccaagguuucuauaaagcuacacucaagcaagaacucgacagcgcacguaagaugcaaaggugacgagaccgccuuuucggucuuggaaggaguccacaguuacaccgucagucucagcuuugaccaugcagugguagacgaacaaugccagcugaacugcggaggccacgaaucgcaaguaacacuaaaagggaaucucauauuccucgaugucccaaaauucguugacggaucguacaugcaaacauaucacucaacaguaccgacaggagccaacauaccgaguccuaccgacuggcucaacgcccuauucggcaacggccucagccgcuggauacucggcgucauuggaguacuauugggcggacuagccuuauucuucaugaucaugucacuauucaaacuugggaccaaacagguauucagaagcaggacaaaacuagcauga

SEQ ID NO: 16377 - RNA, 3222 nt, Artificial Sequence
  derived and/or modified CDS sequence (opt11) from SFTSV(44-Lu'an(CHN)-2015)__KX302603.1__GP
augaugaagguaaucugguucagcagccugauaugcuucgucauacaaugcagcggggauucgggccccaucaucugcgccggcccaauccacagcaacaaaucagcagauaucccacaccuccuuggauucucggagaaaauaugccaaauagaccggcuaauacacgucagcucuuggcuacgcaaccacagccaauuucaaggauacguaggacaaagaggaggaaggagccagguaagcuauuauccagccgaaaacucguacagccgguggucgggauuacucucaccaugcgacgcggacuggcucggcaugcucguagucaaaaaggccaagggaagcgacaugauagugcccggacccuccuacaaaggcaagguuuucuuugaacgcccaacuuucgacggcuacguaggauggggaugcgggucaggcaaaagccgaacagaaucgggcgaacucugcagcagcgacagcggaaccucgagcgggcuacuaccaucagaccgugugcuauggauaggggacguagcaugucagcccaugaccccaauucccgaggagaccuuccuggaacuaaaguccuuuagccaguccgaauuuccggacauauguaagauagacggcauuguauucaaccaaugcgagggagaaagccucccacaacccuucgacguggccuggauggacguaggacacucgcacaaaauaauaaugagagaacauaagacaaaguggguccaggaauccagcucgaaagacuucgugugcuacaaagagggcacaggaccgugcagcgaaucggaagagaaaacaugcaaaaccucaggcagcugccggggcgacaugcaguucugcaaagucgccggcugcgaacacggagaagaagcaucggaggcaaaauguaggugcagucuggugcacaaaccaggugaaguaguagugucauacgggggcaugaggguccgaccaaaaugcuacggauucucgcgcaugauggcuacccucgaaguaaaccagccggagcagaggaucgggcaaugcaccggaugccaccucgaaugcauaaacggaggggucagauuaaucacacuuacaagcgaacugaaauccgcgaccguaugcgcaagucacuuuugcagcagugccacguccgggaaaaagucgacggaaauucaauuccacucggggucgcucgugggaaaaacagcgauccaugucaagggcgcccuaguggacggaaccgaguucacguucgagggcagcugcauguucccggacggaugcgaugccguggacugcaccuucugccgggaguuccucaaaaacccacaaugcuacccggccaagaaguggcuauucauuauaaucguuauccuccucggauacgcaggccuaauguugcucaccaacgugcucaaagccauaggcauaugggggaguugggucaucgcacccgucaaauuaaucuucgccaucaucaagaaacucaugcgcacaguaagcugccuaaugggcaaauuaauggaucgcggaaggcaagucauacacgaagaaaucggagaaaaccgagaaggcaaucaggacgacguccgaaucgaaauggcgcgcccucgacgaguacggcacuggauguauagcccaguaauacugacaauacucgcaauaggacuggcagagagcugugacgaaauggugcaugcggacuccaagcuagucaguugucgacaaggguccgggaacaugaaagaaugcguaaccacaggacgggcgcugcucccagcaguaaaucccgggcaagaagcaugccuccacuucaccgcgccaggcagcccggacaguaaaugucucaaaaucaaagucaaacguauaaaccuaaaaugcaaaaagagcuccagcuacuuugugcccgacgcacggucacgaugcacaagcgugcgacgcuguaggugggcaggagacugccagagcggaugcccaccacacuucaccuccaacagcuuuucggaugacugggccgggaaaauggacagggcaggacuaggauucagugggugcagcgauggcugcggcggcgcagcaugcgggugcuucaacgcugccccgagcugcaucuucuggcgaaaauggguagaaaacccacacggcaucauuuggaaggucucgccaugcgccgcauggguacccuccgcaguaaucgagcuaacaaugccaagcggagaggugcgcacguuccaccccauguccggaauaccaacacaagucuucaaaggcgucucgguuacauacuugggaucggacauggaagucagcggccuaacagaucuaugcgagaucgaggaacuuaagagcaagaaacuagcacuagcgcccuguaaucaggcaggcaugggagucguaggcaaagucggggaaauucagugcagcuccgaagagagcgcacgcacgauaaagaaagauggcugcauauggaacgcagaccuagucgggauagaacugagggucgaugacgccguuugcuacuccaaaauaacaagcgucgaggcggugagcaacuacucggcgaucccaaccaccauaggaggacugagguucgagagaagccacgacagccaggggaaaaucucggggucgccacuagacauaaccgcgaucagagguagcuucucggugaacuaccgcggccuaagacugagucuaagugagaucacggcgacaugcacgggcgaggucacaaacguaaguggaugcuacagcuguaugacgggcgccaaagugagcauuaaacuucacuccagcaagaacucgacagcacacguccgauguaaaggagacgaaacagccuucuccguccuagaagggguacauaguuacacggucagcuugagcuucgaucacgcagucguagacgaacagugccagcucaauugcgggggccacgaaagccaaguuacacucaaagguaaccuaaucuuucuagacgucccaaaauucgucgacgggagcuacaugcaaacauaccacaguacgguaccgaccggcgcaaacauaccgagcccgaccgauuggcuaaacgcacucuucggcaacggucuaagccguuggauacuaggggugauaggaguguuacuaggaggacuagcgcuuuucuucaugauaaugagccuguucaagcugggcacgaagcaaguguuccgcagcagaaccaagcuagcauaa

SEQ ID NO: 16378 - RNA, 3222 nt, Artificial Sequence
  derived and/or modified CDS sequence (opt11) from SFTSV(52-Lu'an(CHN)-2015)__KX302604.1__GP
augaugaaaguuaucugguucagcucacuaauaugcuucgucauccagugcucuggggacucagguccaauaaucugcgcaggaccaauccacagcaauaaaagcgccgauauaccucauuuacucggcuacucagaaaagaucugccaaauagaccgccuaauccacguauccuccuggcuacgcaaccacucacaauuccaaggauacguaggccaaagaggcggcagaucucaaguaagcuacuacccagcagaaaacuccuauagccgguggucaggccuucuaagccccugugaugcggacuggcuaggcaugcuagucgugaagaaagcuaaaggaagcgacaugauaguaccaggaccaucauacaaaggcaaaguauucuucgaacgccccacauucgauggcuacgugggcuggggguguggauccggcaaaagccgcacagagucaggcgaacuaugcucaagugacucaggaacuucaagcggccuccugccaucagaccggguccuguggaucggcgacguagcaugccaacccaugacaccaauaccagaagaaaccuuccuggaacucaagagcuuuagucaaagcgaguucccagacaucuguaaaaucgauggcaucgucuucaaccaaugcgaaggagagucacucccacaaccauuugacguagccuggauggaugucgggcacucccauaaaauaauaaugcgcgaacacaaaaccaaauggguccaagaauccagcucaaaagacuucguaugcuacaaagaaggaaccggccccugcuccgaguccgaagagaaaacgugcaagacaucgggcucaugccgaggcgacaugcaguucugcaaaguggcaggcugcgaacacggagaagaagccucagaagcuaaaugucgcugcagccucgugcacaagccaggugaagucguaguuuccuacgggggcaugcgcguccgccccaaaugcuacggauucucgcgaaugauggccacccucgaaguuaaccagccagaacaacgaaucgggcaaugcacaggcugccaccuagagugcauaaacgggggaguacgacugaucacacuaacaucugagcucaaaagcgcgacaguaugcgcaucccacuucuguagcuccgcaaccuccggcaaaaagucuaccgaaauccaauuccacuccggaucacugguaggcaagacagcaauccacguaaaaggggcgcuagucgacggcaccgaguucacauucgagggcuccugcauguucccggauggaugcgaugccguugacuguaccuucugccgagaguuccuuaaaaacccccaaugcuaccccgccaagaaauggcuuuucauaaucauagucauccuccucggauacgcuggccuaauguuacuaaccaacguccuaaaagccaucggcaucugggggagcugggugauugccccagucaaacucauauucgcuaucaucaagaaacugaugcgaacagucagcugccucaugggcaaacucauggaccgcggacgccaggucauccacgaagaaauaggagaaaacagagagggaaaccaagacgacgucagaauagagauggcgagaccaagacgagugcgacacuggauguacagcccgguaauccugaccauccuagcaauuggccuggccgaaaguugcgacgaaaugguccacgcggacucaaaacuggucucuugccggcagggauccggaaacaugaaagagugcgugacaacgggccgagcccugcucccagccguaaacccgggacaagaagccugcuugcacuucaccgcaccuggcagcccagauucgaaaugccucaaaaucaaagugaaacgcaucaaccuaaaaugcaaacgaagcuccagcuacuucguacccgacgcacguucacgcugcacaagcgucaggcguugcagaugggcaggcgacugccaaagcggaugcccaccccacuucaccucaaauuccuucucagaugacugggccgggaaaauggacagagccggucuaggcuucuccggauguucagacggcugcggcggggccgccugcgggugcuucaacgccgcccccucgugcaucuucuggcgaaaauggguagaaaauccccacgggaucaucuggaaggucucaccgugcgcagcguggguacccucagccguaauagagcuaacaaugcccaguggcgaggucagaacauuucaccccauguccgggauaccaacgcaaguguuuaaaggagucagcgucacauaccugggcuccgacauggaaguaucaggacucacggaccucugcgaaauagaagaacugaagucaaagaaacucgcgcucgcaccaugcaaccaagccgggaugggagucguagguaaaguaggcgagauacaauguagcagcgaggagagcgcacgcaccaucaagaaagacggcugcauuuggaacgccgaucucguaggaaucgaacuccgcgucgacgacgcagucugcuacagcaaaaucacaucggucgaagccgucgccaauuacagcgcaauacccacaacaauaggaggacugagauucgagcgcagccacgacucacaagguaaaauuagcggcucaccccuagacaucacugcaauccggggauccuucuccgucaacuaccguggacugagacuaagucucuccgagaucaccgcaacuuguacgggugaggucacuaauguaaguggaugcuacagcugcaugacgggagcaaaaguuagcauaaaacuacacagcagcaaaaauagcaccgcccacguacguugcaagggagacgaaaccgcuuucucaguacuggaaggcguccacagcuacaccguaagccuguccuucgaucacgccguuguagacgagcaaugccaacucaauugcggaggacaugaaucccaaguaacccucaaagggaaccugauauucuuagacguacccaaauuugucgacggcucauacaugcaaacauaccacagcaccguaccgaccggggccaacauccccagcccaaccgacuggcuaaacgcacuauucggcaacggccucagcagauggauacuuggggugaucggcguccuccugggcggucucgcccucuuuuucaugaucaugagucuuuucaagcuaggcacaaaacagguauuccgaucccgaaccaaacuggcguaa

SEQ ID NO: 16379 - RNA, 3222 nt, Artificial Sequence
  derived and/or modified CDS sequence (opt11) from SFTSV(HL/Injected)__KF791953.1__GP
augaugaaagucauaugguucaguagcuuaauaugccuggucauacaauguggcggcgacacaggacccaucaucugcgcgggacccauacacuccaacaaaagugcagacaucccccaucugcugggauacucagagaagaucugccaaaucgaucgacucauacacgucuccagcuggcuuaggaaccacucccaauuccagggauacguaggccaacgcggcggaagaagucaaguaucguacuaccccgcggaaaacaguuacagccgauggagcgggcuacugucgcccugcgacgccgacuggcugggcaugcuuguugucaagaaggcaaaaggaagcgacaugaucgucccggggccaucguauaaagggaagguuuucuucgagcgccccacuuucgacggcuacguaggaugggguugcggcuccggaaaaagcaggacagaauccggggaacucugcagcagcgacucgggcacgaguuccgggcugcucccaagcgaccgaguccuauggaucggggacguggcaugccaaccaaugacacccauccccgaagaaacguuccuggagcuaaagagcuucagccagagugaguucccagacauaugcaaaaucgacggcaucgucuucaaccagugcgagggagagagccucccccaaccauuugacguggcauggauggacguaggccacucccacaaaaucaucaugcgagaacacaaaacgaaguggguacaagaaagcagcagcaaagacuucguaugcuacaaggaaggcacaggaccaugcagcgaguccgaagagaaaaccugcaaaacgucgggaagcugcagaggcgauaugcaauucugcaaaguagccggaugcgaacacggagaagaagccagcgaggccaaauguagaugcagccuagugcacaagccaggcgaaguaguuguaucauauggcggaaugcgagucaggccgaaaugcuacggauucagccgcaugauggcgacacuggaagucucccaaccugagcaacgcaucggccaaugcacaggcugccaccucgaaugcauaaacggcggaguacgacuaaucacccucaccucagaacuaaaaagcgccacggucugcgcgucacacuuuugcagcagcgcaacgucggggaaaaaguccacagaaauccaguuccacuccggaagccuggugggaaaaacagcaauccacguaaagggagcacucguugacggaacggaguucacauuugaaggcuccugcauguucccagacggaugcgacgcagucgacugcacauuuugcagggaguuccuaaagaacccccagugcuacccagccaaaaaguggcuauucauaauaauaguaauacuacugggauacgccggccucaugcugcucacuaacguacucaaagccaucggggucuggggcucauggguaaucgcaccaguaaagcuagucuuugcgauaauaaagaaacucaugcgagcaguuucaugccuaaugggaaaacucauggaccggggacgccaaguaauacacgaagaaauaggcgaaaaccgcgaagggaaucaagacgacguacgcaucgaaauggcaagaccuagacgggucaggcacuggauguacaguccggucauacugacaauacucgcaauaggccucgcggaaggcugcgacgaaaugguccacgcggacucgaaacucguaucuugccgccagggcucaggcaacaugaaagaaugcguaaccacaggccgcgcacuccucccagcgguuaacccaggccaagaagcaugucuucacuucacggcaccggguagccccgauuccaaaugccuuaaaaucaaagugaaacgaauaaaccucaaauguaagaaaaguucuaguuacuuugugccagacgcccgaucuagaugcacaucaguaaggcgcugccgaugggcaggagacugccaaucaggaugcccaccccacuucacaagcaauagcuuuagugacgacugggcgggaaaaauggaccgagcgggacuaggauucagcgggugcuccgauggaugcggaggcgccgcgugcgggugcuucaacgcagcuccaagcugcauauucuggcggaaauggguagaaaacccccacgggauaaucuggaaagucagcccaugcgccgcauggguccccagcgcugugaucgaacuaacgaugccauccggcgaaguccgaacguuccauccaauguccggaaucccaacacaagucuucaagggaguaagcgucacauaccucgggagcgacauggaaguuucaggacuaacagaccucugugaaaucgaagaacucaagagcaagaaauuagccuuagcaccaugcaaccaggccggaaugggcguagucggaaaagugggcgagauccaaugcaguagcgaagaauccgccaggacgauuaagaaagauggcuguaucuggaacgcagacuuaguaggcaucgaacuccgcguggaugacgcggucuguuacagcaaaaucaccucagucgaagcaguagccaacuacucggccauucccaccacaaucgggggacuacgcuucgaacgcucccacgacucacaaggaaaaauuagcggcucaccacuagacaucacagcgauccgaggauccuucuccguaaacuaucgcggacuccgacucucccucucagaaaucaccgcaacgugcacaggagagguaaccaacgucagcgggugcuacuccugcaugacaggagcgaaagucagcaucaaauuacacuccagcaaaaacucaacagcccacguacgaugcaagggggacgagaccgcauucagcguacucgaaggaguacacuccuacucagucagucucagcuucgaccacgcaguggucgacgagcaaugccaacuuaauugcggaggucacgagagucaaguaacauuaagaggcaaccuaauauuucuggacguaccuaaauucguagacggaucguauaugcagacauaucacuccacggugcccaccggagcgaauauaccaucuccuaccgauuggcuaaacgcccucuucgggaacggacuaagccgcuggauccugggcgugaucggcguccuacuuggaggacuggcacucuucuuccugauuaugucauuauucaaacucgggacaaaacaaauauuccgcucacgcaccaaacucgcauag

SEQ ID NO: 16380 - RNA, 3222 nt, Artificial Sequence
  derived and/or modified CDS sequence (opt11) from SFTSV(HL/Larvae/G2)__KF791955.1__GP
augaugaaaguaauaugguuuuccucacucaucugucuggucauccaaugcggcggagacacaggacccauaauaugcgcaggcccaauccacagcaacaagagcgcugacauaccacaccuacucggguacucggagaaaaucugccaaauagacagguuaauacacgugagcuccuggcucagaaaucacucgcaauuccagggguacguagggcaacgagggggccggagccaagucucauacuaccccgccgaaaacagcuacagccgcuggucgggcuugcuaaguccaugcgacgccgauugguuagguaugcugguaguaaagaaggccaagggaagugacaugauugugcccgggccaaguuacaaaggcaaagucuucuuugaaagacccaccuuugacggauacgucggcuggggguguggcucuggcaagagccguaccgaaucaggcgaacuaugcucaucagacagcagaacaucaagcgggcuccuccccagcgacaggguccucuggauaggcgacguagcaugccaaccaaugacccccaucccggaagaaaccuuccuugaacuuaagagcuucagccaaagugaguucccagauaucugcaaaaucgacggaauagucuucaaccagugcgaaggcgaaagccugccccaaccauucgacguagccuggauggacguaggccacucacacaaaauaaucaugcgugaacacaaaacaaaauggguucaggaauccagcuccaaagacuucgucugcuacaaagagggcaccggcccaugcucugagagcgaagagaaaaccugcaaaaccuccggcagcugccggggcgacaugcaauucugcaaaguagccgggugcgaacauggcgaagaagcauccgaagccaaauguaggugcagucugguacacaaacccggagaagucgugguaagcuacggaggaaugagggugcgccccaaaugcuacggcuucucacgcaugauggccacacuagaagugagccagccagaacaacggaucgggcaauguacaggaugccaucucgaaugcauaaacggcggagugcgccucauaacccuaacauccgaacuaaaaagcgcaacaguaugcgcaagccacuucugcuccagcgccacauccgggaagaaaagcacggaaauacaauuccacuccggcucccucguaggcaaaaccgcaauccacgucaaaggcgcccucguagaugguacagaguucacguucgaaggguccugcauguucccugacggcugcgacgcgguagacugcaccuuuugucgagaguuccugaaaaacccccaaugcuacccagccaagaaauggcuauucauaauaaucgucauacuccuaggauacgcggggcucaugcuccucacgaacguccuaaaggcuauaggaguuuggggcuccugggugauagcgcccguaaaauuaguauucgcaaucauaaagaaacucaugcgggcaguaucaugccuaauggguaaacuaauggacagaggacgacaggugauacacgaagaaauaggagaaaaccgggaaggcaaccaagaugacguacgaaucgaaauggcucgcccgagacgaguacgacacuggauguacagcccggugauacuaacaauacucgcaauagggcuagcggaaggcugcgacgaaauggugcacgcggacuccaaacuuguaucgugccgacaaggaaguggaaacaugaaagaaugcguaaccacaggaagggcauuacuaccggcuguuaacccaggccaagaagccugucuacacuucacagcccccggaagucccgacucaaaaugccuaaaaauaaaagucaagcgaaucaaccuaaaaugcaaaaagagcucauccuacuucguccccgacgcccggagccggugcacaucaguccguagauguaggugggcaggcgacugccaaagcggaugcccuccacacuucaccuccaauuccuucucagaugacugggccggaaaaauggacagagcaggacuaggguuuagcggaugcagugauggaugcgggggagccgcaugcggaugcuucaaugcggcgccuucgugcauauucuggcggaaaugggucgaaaauccacauggcaucauauggaaaguauccccaugcgcagccugggucccaucagccgucauagaacucaccaugccguccggggaaguacgaacauuccaccccaugagcgggauacccacccaaguauucaaaggaguaagcgucacuuaccugggcuccgacauggaaguaagcggccuaacagaccugugcgaaauagaagaacuaaaaagcaagaaacuugcacucgcuccaugcaaccaggcuggcaugggggucgugggaaaaguaggcgagauccaaugcagcucagaagaaagcgcucgaaccaucaagaaagacgggugcaucuggaaugcagaucuaguggggaucgaacuaagagucgacgacgcagucugcuacuccaaaaucaccuccguagaggcagucgccaacuacucagcaauccccacaacaauuggagggcuccgguucgaacgcucacacgauucccaagguaaaaucuccggaucacccuuggacauaacagcaaucagggguagcuucagcgucaauuaucggggccugcgucucucacuaucagaaaucacagcaacaugcacaggcgaagugacaaacguaagcggcuguuacagcugcaugaccggcgcaaaaguaagcaucaaacuccacaguagcaaaaacucaaccgcucacguacgcugcaaaggagacgaaaccgcauuuaguguacuagaaggaguccauagcuacagcgucagccuaaguuucgaccacgcaguaguagacgaacagugccagcucaacugcggcgggcaugaaagccaagucacuuuacgaggcaaccuuaucuuccucgacgucccaaaauucguagacggauccuacaugcaaaccuaucacagcaccgucccaaccggagccaauaucccaagcccgacagacuggcugaacgccuuauucgggaacggccuaagccgauggauacuaggggucaucggcguucuccuaggcggacuagcgcuuuucuuccucaucaugagccucuucaagcugggcacaaaacaaauauuuagaagccguaccaaacuggcauag

SEQ ID NO: 16381 - RNA, 3222 nt, Artificial Sequence
  derived and/or modified CDS sequence (opt11) from SFTSV(JS2011-004)__KC505124.1__GP
augaugaaagucauaugguuuagcagccuaauaugccuagucauacaaugcggcggcgacacgggaccgaucaucugcgcgggaccgauccacagcaacaaauccgccgacauaccacaccuacucggauacucagaaaagauuugccaaauagauagauugauccacguguccaguuggcuacguaaucacucgcaauuccaaggguacguaggccaacgcggcggacggagccaagucagcuacuaccccgcggaaaacaguuacagucgguggagcggccugcuaucccccugcgacgcagacuggcuaggaaugcuagucguaaagaaagccaagggcucagacaugaucgugcccggccccuccuacaaaggaaaaguauucuucgaacggccaaccuucgauggauacgucggaugggguugcggaagcggaaaaaguagaaccgaauccggcgagcugugcuccagcgauuccggcacgagcagcggacuacuaccaagcgacaggguccuguggauuggagacgucgccugccagcccaugacccccaucccagaagaaaccuuccuagagcucaaguccuucucccaaucagaguucccggacaucugcaaaaucgacggcauaguauuuaaccaaugcggaggagaaucauugccacagccauuugacguagccuggauggacgucgggcacucgcacaagaucaucaugcgugaacacaaaaccaaguggguacaagaaagcucaaguaaagacuucguaugcuauaaggaagggacaggcccaugcucagaaagcgaagagaaaacaugcaaaacgaguggauccugccgcggugacaugcaauucugcaaaguagcggggugcgaacacggggaagaggcauccgaagccaagugccgcuguucacucguacacaaaccgggggaaguggucguauccuacggcggcaugcggguaagacccaaaugcuacggguucucacggaugauggcaacucucgaaguaaaccaacccgaacaacgcaucggccaauguacgggcugccaccuagaaugcaucaacggagguguaagacugauaacgcugaccuccgaguuaaaaagcgcgaccgucugcgcaagucacuucugcagcuccgccaccagcggcaagaaaagcaccgaaauacaauuccacucaggcucucuggucggaaaaacugcaauccaugucaaaggcgcacucguugacggcaccgaguucacauuugagggcuccugcauguucccggacgggugcgacgcaguggacugcaccuucuguagagaguuccucaaaaacccacaaugcuaccccgccaagaaauggcucuuuaucauaaucgugauccuacuaggauacgccggccuaaugcuccuaacaaacguacucaaagcaaucggcguauggggaucgugggugauagcaccagucaaacuuguguucgcgaucaugaagaaacucaugagagcgguuuccugccugaugggcaaacucauggauagaggacggcaagucauacacgaagaaauaggagagaacagggaaggcaaccaggacgacgugaggaucgagauggcacgccccagacgcguaagacacuggauguacagcccaguaauccuaaccauauuggcaauaggccucgccgaaggaugcgacgaaaugguacacgccgauucgaagcuaguaagcugcagacaaggcagcggcaacaugaaagaaugcgugacuaccggcagagcucuccuaccagcagucaaccccggacaggaggcaugccugcacuucaccgcccccggaagcccagacaguaaaugucucaaaaucaaagucaaacgaauaaaucuaaaguguaagaaauccucaagcuacuucgugcccgacgccaggagccgaugcaccagcguacgacggugucgcugggccggagacugccaguccggcugucccccacacuucacuucaaauucguuuagcgacgacugggccggcaaaauggacagagcaggucuuggauuuucggggugcuccgauggcugcggcggggcggcaugcgggugcuucaacgcagcaccaucuuguaucuucuggcgcaaauggguagaaaacccccacggaaucauuuggaaaguaucuccaugcgccgccuggguaccauccgccguaauagaacucacuaugccauccggagaaguccgcacauuccacccaaugaguggcauaccgacccaagucuuuaaaggcguaucagucacguaccucggaagugacauggaaguuaguggccucaccgaccuaugcgaaaucgaagaauuaaaauccaagaaauuagcccuagcaccaugcaaucaagcgggcaugggagucguaggaaaaguaggagaaauucagugcuccagcgaagagagcgcccgcacaauaaagaaagauggcugcaucuggaacgcggaccuagucggaaucgaacucaggguggacgacgcggugugcuacucgaaaauaaccucaguagaagcaguggcaaauuacucagccauccccaccacaauaggcggccuaagguucgaacguucacacgauucccaaggcaaaaucucaggcucaccgcuagacaucaccgcgaucagggguucauucagcgucaauuacagaggcuuacgccuuagccugagcgaaaucaccgcgacaugcacgggcgaagucacaaacgucuccgggugcuacucaugcaugacgggagcaaaaguaucaaucaaacuacauucaaguaaaaacagcaccgcgcacguaagaugcaagggcgacgagacugccuucagcgugcuagagggcguccacagcuacucagucagccugucauucgaccacgccguagucgacgagcagugccaacuaaacugcggaggacacgaaucacacguaacacuuaaaggaaaccugaucuuccucgacguacccaaauucgucgauggcuccuacaugcaaacauaccacagcaccguaccaacaggagcaaauauaccuucaccgaccgacuggcugaaugcgcuguucggaaacggacuaucuagguggauucuagggguaaucggcguccuccucggcgggcucgcacuauucuucuuaauaaugagcuuguucaagcugggaacaaagcaaguguuccggucccgaacaaaacucgccuaa

SEQ ID NO: 16382 - RNA, 3222 nt, Artificial Sequence
  derived and/or modified CDS sequence (opt11) from SFTSV(JS2011-013-1)__KC505127.1__GP
augaugaaaguuauaugguucagcagccucauaugcuucgucauacagugcucaggagacucaggacccaucauaugcgccggcccaauccacagcaacaaaucagccgacauaccacaucuccucgguuacucggagaagauaugccaaauagaccgacucauucaugucagcagcuggcuaagaaaccacagccaauuucaaggauacguaggucaacgcggaggaaggagccaagucagcuauuacccagccgaaaacucauauagcagauggucgggccuacucagccccugcgacgcagacuggcuaggaaugcugguaguaaaaaaagcuaaaggaagcgacaugauuguacccgggcccuccuacaaaggcaaaguuuuuuucgaacgaccaacauucgacggauacgucggcuggggaugcgggucagggaaaagccgcaccgagagcggcgaacuaugcagcagcgacagcggaacaagcaguggccuccugcccuccgaccgaguacuauggaucggagaugucgccugccagccaaugaccccaauucccgaagaaacguuucucgaacugaaaagcuucucacagagcgaauuccccgacauaugcaagauagacggcauugucuucaaccagugcgaaggagagagccuuccacaacccuucgacguggccuggauggacguaggccacucccauaagaucauaaugagagagcacaagacuaaguggguacaagagucaaguucaaaagauuucguauguuacaaagaaggaacgggacccugcucagaauccgaagaaaaaacaugcaaaacuucggggagcugccggggugacaugcaauucugcaagguagcaggcugcgaacacggggaagaagccucagaagcaaaaugcagaugcucgcuaguccacaaaccaggcgaggucgucgucucguacgggggcaugagaguccgccccaaaugcuacggcuucagucgcaugauggccacccucgaagucaaccagccagaacagcgccuaggacaaugcacaggaugccaucucgaguguauaaacggaggagugcgacuaaucacccucaccucagagcuuaaaagcgcgacagugugcgcaucacacuucuguagcagcgccacaucggggaagaagagcaccgaaauccaauuccacaguggcagccucguaggaaaaaccgccauacaugucaagggcgcgcucguagacgggaccgaauucacuuucgaggggucaugcauguucccagacgguugcgacgccguagauugcaccuucugcagggaguucuuaaaaaacccccaaugcuaccccgccaagaaauggcuauucaucaucaucgucauccuccuaggguacgcaggccucaugcuacuuacaaacguccuuaaagccaucggaauauggggcucauggguaaucgccccagucaaacucauguucgccaucauuaaaaagcuaaugcgcacagucagcugccucaugcggaaacuaauggaccgcgggcgccaagucauacacgaagaaaucggcgaaaacagagaaggaaaccaagacgacguccguaucgagauggcucgaccacgccgcguacgacacuggauguacucacccgucauacuaacaauacuagccauagggcuugcagaaagcugugacgaaaugguccacgccgacagcaaacucgucucgugccgacaaggaagcggaaacaugaaggaaugcgugacaacaggaagggcccuccuccccgcaguaaaccccggccaggaagcaugccuacacuucaccgccccaggcagcccagacucaaaaugccucaagaucaaagucaaacgaaucaaccucaagugcaaaaaaagcucauccuacuucguccccgacgcaagaagccgcugcacgagcguccgcagaugcagaugggcgggagauugccagucuggcugccccccgcauuuuacgaguaacagcuucuccgacgacugggccggcaagauggacagagcaggacucggguucagcggcuguagcgaugggugcggcggugccgcaugcggaugcuucaacgcagcgccaaguugcauauucuggcgaaagugggucgaaaacccacacggcauuaucuggaaaguaagucccugcgccgcauggguacccuccgcgguaauugagcuaacaaugccgucaggagagguacgcaccuuucacccaaugagcggcauccccacacaggucuucaaggggguaagcguaacuuaccucggaagcgacauggagguaaguggacugaccgaccucugcgaaaucgaagaauuaaaauccaagaaacuagcccuugcacccugcaaccaggccggaaugggugucgucggaaaagucggcgagauacagugcaguucagaggaguccgcacgaacaaucaagaaagacggcugcaucuggaacgcagaccuaguaggaauagaacucaggguggaugacgcggucugcuacucgaaaaucaccagugucgaggcgguagccaacuacucagcaauacccacaaccauaggaggauuaagguucgagcgcucacacgauucacaaggcaaaauuucugguagcccccuagacaucacagccauacgcggaagcuucagcgucaaguaccgaggauugcgccuaagccuaucagaaauuacggccaccugcacaggagaaguaacaaaugugagcggaugcuacucauguaugaccggcgccaaaguuaguauaaaacuacacagcagcaagaacucgacugcacacguccgaugcaaaggagacgaaacagcauuuucaguccuugaggggggccacagcuacacagugucauuaagcuucgaccacgccguaguggacgaacagugccagcugaauugcggcggccacgaaagccaagugacccuaaaaggaaaccucauauuucucgacguucccaaauucguagacggaucauauaugcagacauaccauucaacugucccaacaggagcuaacaucccguccccaacagauuggcucaaugcacuauucggaaacggccuaagcagauggauucuaggagucaucggcguacuacuaggaggacucgcacucuucuucaugaucaugagccuguucaagcuaggaacaaagcaaguuuucagguccaggaccaagcuagcauga

SEQ ID NO: 16383 - RNA, 3222 nt, Artificial Sequence
  derived and/or modified CDS sequence (opt11) from SFTSV(JS2011-027)__KC505130.1__GP
augaugaaaguaaucugguucuccucacucaucugccucguaauacagugcgggggagacacaggaccgaucaucugcgcgggcccaauacacagcaacaaaucggcagacaucccacaccuccuagguuacucggaaaagauaugucaaaucgaccgccucauacacguaucgucuuggcugaggaaccacucgcaauuccaaggauacguaggacaacgaggagggcgaucgcaagucuccuacuaucccgcggaaaauaguuacagccgaugguccggacuacucuccccaugugaugccgauuggcucggcaugcucgucgugaaaaaggcaaaaggcucggacaugaucguacccgggcccucguauaaaggaaaagucuucuucgagcgaccaacauuugacggauacgugggguggggcugugguuccggaaaaucccgaacagagagcggggaauugugcucguccgacagcggcaccaguagcggacuccugccguccgaccgaguccucuggauaggcgacguagccugccagccgaugacuccgauacccgaggaaacuuuccuagaacucaagagcuuuucacaaagcgaguucccggacaucugcaagauagacggaauaguuuucaaccaaugcgaaggugaaagccugccgcaaccauucgacguggcauggauggacguuggccacucacacaagaucauaaugcgcgaacacaaaacgaaauggguccaagaaucaucaagcaaagauuuuguaugcuacaaggaaggcacagguccaugcucagaaagcgaagagaagacgugcaaaacaagcggaucuugccggggagacaugcaauucuguaaaguggccggcugcgaacacggagaagaagccagcgaagcgaaguguaggugcagccuaguacacaagccaggagaaguaguaguaucauacggcggaaugagaguccggccgaagugcuacggauucucgcguaugauggcgacacucgaagucaacgaaccagaacaacggauaggacagugcaccggaugccaccuagagugcaucagcggaggaguacgccucaucacacuaacgagcgagcucaagagcgcgacaguaugcgccucacacuucuguuccucagccacguccggaaagaaaagcacagaaauccaauuccacucaggaucacucgucggcaaaaccgcuauacacgucaaaggagcgcucguagacggaacagaauuuaccuucgaaggauccugcauguucccugacggaugcgacgccguggacuguaccuucugcagagaguuccuaaagaacccacaauguuacccagccaagaaauggcuauucaucauaaucguaauccuccucggguaugcaggccucaugcugcucacgaacguucucaaagccauagguguuuggggaagcugggugauagccccaguaaaacucguauucgcgaucauaaagaaacuaaugcgcgccgucuccugcuuaaugggaaaauuaauggaccgcggaagacaagugauccacgaagaaaucggagaaaacagagaagggaaccaagacgacguaagaauugaaauggcuaggccccgcaggguccgccacuggauguacuccccaguaauccucaccauauuagccaugggccuggccgaaggaugcgaugagauggugcaugccgacuccaaacuggucuccugucgacaaggaagcggcaacaugaaagagugcgucaccacuggacgggcucuacucccggcaguaaacccagggcaggaagccugccuccacuuuacagcacccggcagccccgacagcaaaugccugaaaaucaaagucaaacgaauaaaccucaaaugcaaaaagucguccucauacuucgucccagacgccagaagccgaugcacgagcguaagaagaugcagaugggcgggcgacugccaaagcggcuguccaccccauuucacaucaaacucauucucagacgacugggcgggcaaaauggaccgcgccgggcucggauucagcggaugcagcgauggaugcggcggagcagcuugcggaugcuucaacgcagcgcccagcuguauauucuggagaaaguggguagaaaacccucacggaauaauauggaagguaucaccaugugcagcauggguccccuccgcagucauugagcucacgaugccgucaggcgagguacgaacuuuccauccgaugagcgguauaccaacccagguauucaagggagucagcgucacguaucugggaagcgacauggaaguaagcggacucacggaccuaugcgagauagaggagcuaaaaucgaagaagcuggcacucgccccaugcaaccaagcaggcaugggaguaguaggcaaaguaggagaaauccaaugcuccagcgaagaaagcgcacgcacaaucaagaaagacggaugcaucuggaacgcagaccuugucgggaucgagcuccgagucgaugaugcagucugcuacucuaaaauaacaucgguagaagcuguggcgaacuacuccgcaauccccacgacaaucggcgggcuacgauucgagcgaagucacgacagccaaggaaaaauaagcggcucaccacuagacaucacagccauccgcgggagcuucucaauuaacuaccgcggccuaaggcuuagccuaagcgaaaucaccgcaaccugcacgggagaagucaccaacguaucagggugcuauagcugcaugacaggcgccaaaguauccaucaaacuccacuccagcaaaaacuccacagcacauguacgcugcaagggagacgagacggcauuuucaguccucgaaggcguccacagcuacagcguaagccuaucauucgaccacgccguaguggacgagcaaugccagcucaacugcggagggcaugaaucacaaguaacccuacgaggaaaccuaaucuuucuagacgugccaaaauucgucgacggcuccuacaugcaaacauaucacagcacaguaccgaccggggcaaauauccccagcccaaccgacuggcuaaacgccuuauucggaaacggacugagccgauggauacucggcguaaucgggguacugcuaggcggccucgcacucuucuuccucaucaugucgcuguucaagcucgguaccaaacaaguauucagaucucgaacgaagcuggcauga

SEQ ID NO: 16384 - RNA, 3222 nt, Artificial Sequence
  derived and/or modified CDS sequence (opt11) from SFTSV(JS2011-034)__KC505133.1__GP
augaugaaaguaauaugguucaguucucucauaugcuucgucauccagugcagcggcgacucaggcccgauaaucugcgcaggaccuauacacuccaacaaaagcgcugacaucccccaccuccuaggguacucagagaaaauuugccaaaucgauagacuuauccacguauccagcuggcuccgcaaccacucccaauuccaaggguacguugggcaacgaggaggccguucacaagucucauacuaccccgcugaaaacagcuauagcagauggucgggacuacuuuccccaugcgacgcggacuggcucggcaugcucgucgugaagaaggccaaaggcucagauaugauaguaccggggccaaguuacaaaggcaaagucuucuucgagcguccaaccuuugacgguuacgucggaugggggugcggcagcggcaagagccgcaccgagagcggcgagcugugcucauccgacuccggaacaucaagcggucuccugcccagugaccgcguccuauggauuggggauguagcgugucagcccaugacaccgauaccggaagaaaccuuccucgagcucaagaguuucagccaaagcgaguuccccgacauaugcaaaaucgauggcauuguauucaaucaaugcgaaggcgaaucccucccgcagcccuucgacguggccuggauggacguagggcacagccacaagauaaucaugcgcgagcacaagaccaaguggguacaagaaucguccucaaaagauuucguaugcuauaaagaaggcaccggcccaugcucggaaucagaagagaaaacguguaaaacgagcgggaguugcagaggagacaugcaguucugcaagguagcugggugugaacauggggaagaagccucggaagcaaaaugcagaugcagccuaguccauaaaccaggcgaagucguagucucguacgggggcaugcggauucgcccaaaaugcuacgguuucucacgaaugauggccacccuggaagucaaccagccggaacaacgcaucgggcaaugcacaggaugccaccuagagugcauaaacggaggcguaagacuaaucacucugacgucagaacucaaaucagcaacgguuugcgcaagccauuucugcagcagcgcaacguccgggaaaaagucaacagaaauccaauuucacuccggaagccuaguaggcaagaccgcaauccacguaaaaggcgcccugguggacggaacggaguucacauucgaagggucaugcauguucccugacggcugcgacgccguggacugcacguucugcagagaguuccucaagaacccccaaugcuaccccgccaagaaauggcuguucauaaucauagucauacuccucggcuacgcaggauuaaugcuguugacuaacguccucaaagcaauaggaaucuggggaucaugggucauugccccaguaaaacugauguucgcaauaaucaagaaacucaugcgaacaguaucgugccuaaugggaaaacucauggaccgagggagacagguaauacacgaagaaauaggcgaaaacagagaaggaaaccaagacgacguaaggauugagauggcccggccacgcagagugagacacuggauguacuccccagugauacugacauuccucgccauaggauuggcugagagcugcgacgaaaugguccacgcagacucaaaacuugucaguugcagacagggcagcggaaacaugaaagaaugcguaacgacaggaagggcccuacugccggccguaaacccaggacaggaggcaugccuacauuuuacagcacccggcuccccagauagcaaaugcuugaagaucaaggucaagcggauaaaccugaaaugcaagaaaucaaguagcuacuucguaccugacgcccgcagccgaugcaccuccguacgccgcugccggugggcgggcgauugccaauccggaugcccaccccauuucacaaguaacagcuucagcgacgacugggccggcaaaauggaccgcgccgggcuuggcuucuccugcugcagcgauggaugcggaggggcagccuguggaugcuucaacgcagcccccagcugcaucuuuuggcguaaaugggucgaaaacccacacggcaucauauggaaagucaguccgugcgccgccuggguacccuccgccgucaucgaacuaacuaugccgucaggagaaguccgaacguuccacccgaugagcggaauaccgacccagguauucaaaggggugagcgucaccuaccucggcucggacauggaagucagugggcucacagaccuaugcgagaucgaggaacugaaaagcaagaaacucgcccucgccccauguaaccaggcuggaaugggcguaguuggcaaagucggggaaauccaaugcagcuccgaagaaagcgcacgcacaauaaagaaagacggaugcaucuggaacgcagaccuugucggaaucgaacuaagagucgacgacgcagucuguuacucaaaaauaaccuccgucgaggccguagccaacuacucagccaucccaacaaccaucggaggacuccguuuugagcgcucgcacgacagccagggcaaaauuuccggaagccccuuagacaucacagcaaucagaggcuccuucucaguaaacuaccggggacuccgccucagccucagcgagaucacagccacgugcacaggagaggucaccaacguguccgggugcuacagcugcaugaccggcgcaaaaguguccaucaaacuacacucuucuaagaacuccacagcccacguccgaugcaaaggggacgaaacggcuuucagcguacuagaagggguccacaguuauaccguaucauugucguucgaccacgcggucguagacgaacaaugccaacucaacugcgggggacacgagucacaaguaacccuuaaaggaaaucuaaucuuccuugaugucccaaaguucguggacggcagcuacaugcaaacauaccacagcaccguccccaccggagcaaacaucccaagucccaccgacuggcucaacgcacuauucggcaacggccuaagucgauggauacucggagucauaggugugcuccuaggcggacuagcccucuucuuuaugaucaugagcuugcuaaagcuaggaaccaaacaagucuacaggucccgcacaaagcuagcuuga

SEQ ID NO: 16385 - RNA, 3222 nt, Artificial Sequence
  derived and/or modified CDS sequence (opt11) from SFTSV(JS2011-062)__KC505136.1__GP
augaugaaggugaucugguucagcagccuaaucugcuuagucauacaguguagcggugacucaggcccgaucauaugcgcuggaccaauacauagcaacaaaucagcagacaucccccaccuacucggguacucggaaaagaucugucaaauagaccgacucauucacgucuccucauggcuacggaaccacucgcaauuccaaggauacgucggacaacgcggaggaagaucacaagugucguacuaccccgccguaaauuccuauuccagguggucaggcuugcucucacccugcgacgccgacuggcuuggaaugcuaguagucaaaaaggccaaaggaagcgacaugauagucccggggcccucauacaaggguaaagucuucuucgaacgcccaaccuucgauggauacgugggauggggguguggcucgggaaaaagccgaacagaaagcggagaacugugcaguagcgacagugggacgucguccggacugcuacccagcaaucgcguccucuggaucggagacguugcgugccaacccaugacacccaucccagaagaaacauuccuagaacucaaaagcuucagccaaagcgaauucccagacauaugcaaaauagacgggauaguguucaaccaaugcgaaggagagagccuaccccaaccauucgacgucgccuggauggacgucggacacagccauaaaauaauaaugcgagaacauaaaacuaaauggguacaagaauccucaucgaaagacuuuguauguuacaaagaaggaacaggaccaugcucagagucggaagagaaagccuguaagacauccggauccugccgaggcgauaugcaauucugcaaagucgcaggaugcgaacacggagaagaagccucagaagcuaaaugucgaugcagucuaguccauaaacccggggaaguaguaguauccuauggcggcaugagaguacgcccaaaaugcuacggcuucucccgaaugauggcaacacucgagguuaacccgccagagcagcgcauaggacaaugcacaggaugccaccuagaauguauaaacggaggcguacgccuuauaacgcuaaccucagagcuuaaaagcgcgaccgucugcgccucccacuucugcucgucagccaccaguggcaagaaguccacagagauacaguuccacucaggaucacucgugggaaaaacggccauccacguaaaaggcgcccugguagacggaaccgaguucacauucgaaggaucauguauguucccagacgggugcgacgcuguagacugcacguucugcagagaauucuuaaaaaacccacaaugcuacccugcgaaaaaauggcuauucauuaucauugucauacuccuuggauacgcaggacuaaugcugcucacaaacguacugaaagccauaggcguguggggcagcuggguaauagcaccugucaagcucauguucgcgauaaugaaaaagcucaugagaacagucuccugccucaugggaaaacucauagaccgcggccgacaagucauucacgaagagauaggugaaaacggcgaaggcaaccgggacgacgucaggaucgaaauggcccgaccgcggcgggugcgccacuggauguacucccccgucauacucacaauacucgccaucggcuuggcugaaggcugugacgaaaugguccaugcagacucaaaacucguauccugucgccagggauccggcaacaugaaggaaugcgucaccacgggccgagcacuccuacccgcaguaaaccccggccaggaggcaugcuuacacuucacagcacccggaagccccgacucaaaaugccuaaaaaucaaggugaagcgcauuaaccuaaaguguaaaaaaagcagcagcuacuucguccccgacgcuaggagcagauguaccagcguccgacgcugcagaugggccggcgacugccagagugguugcccaccccacuucaccagcaacagcuucuccgacgacugggccggcaaaauggacagagccggccucggguucagcggcugcuccgacggcugcggcggagcagccugcggaugcuucaacgcagccccaagcugcaucuuuuggcgcaaguggguggaaaacccccauggcauaauauggaaggucucacccugcgccgccugggugcccucagcagugauugagcucacaaugccaucuggggagguccgcaccuuccaucccaugaguggcauaccaacgcaagucuucaaaggagucucagucacauaccugggaucagacauggaggugaguggacuaacggaccuaugcgagaucgaggaacuuaaaagcaaaaaacuagcacuugcaccaugcaaccaggcaggaaugggagucguagguaaaguuggagaaauacaaugcucguccgaagaaagcgcacgaacaauaaagaaagauggcugcauauggaacgccgaccuagucgggaucgaacucagaguagacgacgccgugugcuacaguaagauaacauccguagaagccgucgccaauuacucagcaauaccaaccacaauuggcggccuacgcuuugaacgcucacacgacagccagggcaaaauaagcggcucaccccuagacaucaccgcaauaaggggaagcuucagcgucaauuacaggggacucaggcucucacuaagcgaaauaacagccacaugcacaggagaaguaacgaacgugagcggcugcuauagcugcaugacaggagccaaaguguccaucaagcuacacucgagcaaaaacucgaccgcacacguccggugcaaaggagacgaaacagcauucagcguccucgaaggcguacacagcuacacagucagucuauccuucgaccacgcaguaguugacgaacaaugucagcucaacugcggaggacacgaaagccaagucacccugaaaggcaacuugaucuuucucgacguaccaaaauuugucgauggcucauacaugcaaacguaucauagcacggucccaacaggggcaaacauaccaucccccacggacuggcucaacgcacuguuuggaaacggacucagccgauggauacucggacucauaggcguccuacuagggggacuagcgcuuuucuuccuaauaaugagccuguuuaaacucggcacaaaacaaguauuccggagccgcacgaagcucgcguga

SEQ ID NO: 16386 - RNA, 3222 nt, Artificial Sequence
  derived and/or modified CDS sequence (opt11) from SFTSV(JS2011-109)__KC505139.1__GP
augaugaaaguuauaugguuuagcucgcugauaugccuugucauccagugcggcggagauacuggcccaauuauaugcgcgggaccaauacacaguaacaagucagcagacaucccccaccuccucggauacucggagaaaauaugccaaauagacagacucauccauguaagcagcuggcuccggaaccacucacaauuccaaggcuacgugggccaaagagguggccgcagccaagucucguauuauccagccgaaaauucauauagcagaugguccggacucuuaagccccugcgacgccgacuggcucgggaugcuaguagucaagaaagccaaaggcagugacaugauugucccggggcccucauacaaaggcaaagucuucuucgaaagaccaacauucgacggauacgucggguggggcugugguuccggcaaaucccgcaccgaaagcggggaacuaugcucgucagacuccggaaccucgagcggacuccuacccagcgacagagucuuguggauaggagacguagccugccaaccgaugacccccauaccggaagaaacauuccuagaauuaaagagcuucagccaguccgaguucccagauauaugcaaaaucgauggaaucguauucaaccagugugaaggcgaaucacucccgcagccauucgacguugccuggauggacguaggacacagccacaagauaaucaugcgagagcacaaaacgaaguggguccaagaaaguagcagcaaagacuucgucuguuacaaagaaggcaccgguccaugcagcgaaagcgaggagaaaacgugcaagacaagugggucgugcagaggcgacaugcaauucugcaaaguagccggaugcgaacacggagaagaagcaagcgaagcaaagugccgaugcagucucguccacaaaccgggcgaaguagucguauccuacgggggcaugcgaguccgccccaaaugcuacggauucucccgcaugauggccacccuagaagugaaucaacccgaacaacgcaucgggcaaugcacgggaugccaccuagagugcaucaacggcggcgugcgucucaucacccugaccagcgaacugaagucagcaacaguuugcgcaucucacuucugcagcucggcaaccagcggaaagaaaagcaccgagauccaauuccacuccggcucacuggucggaaaaacagcaauacacgucaaaggcgcgcuaguggacggaacugaguucacuuucgaaggcucaugcauguucccggacggcugcgaugcagucgacugcaccuuuugccgcgaguuccucaaaaacccgcaaugcuacccggccaaaaaguggcuuuucaucauaaucgucauacuccuaggcuacgcaggccucaugcugcucacaaacguccuaaaggcaaucgguguauggggaagcuggguaauagcgcccgucaaacuggucuucgcaauaaucaagaaacucaugcgagcagucagcugccuaaugggaaaacucauggaccgcggacgacagguaauccacgaagaaaucggugaaaauagagaaggaaaccaggacgacguacgaauagaaauggcgcgaccccgccgaguacgacauuggauguacagcccaguuauacuaacaauacucgcaauagggcucgccgaaggcugcgacgaaauggugcacgcggacagcaaguuagucucaugccgccaaggauccggaaacaugaaggaauguguaaccaccggccgagcccuacugccagcugugaacccgggccaagaagcaugccuacacuucacagcgcccggcagcccagacucaaagugccuaaaaaucaaagucaaacgcaucaaccuaaaaugcaaaaagagcuccagcuacuucguacccgacgccaggucccgaugcaccuccguccgccgcugccgaugggcaggagauugccagagcggcugcccgccccacuucacaagcaacagcuucagcgaugacugggccggaaagauggacagggccgggcucggguucuccggcugcucagacggcugcggcggggcggcaugcggcugcuucaaugcggcacccuccuguauauuuuggcgaaaaugggucgaaaacccacauggcauaaucuggaaagucuccccgugcgcagccuggguuccaagcgcagucauagaacuaacaaugccuagcggcgaaguaaggacauuccacccuaugagcgggauccccacccagguauuuaaaggaguaucugucaccuaucugggcagcgacauggaaguaagcggacuaacggaccuuugugagauagaagaacucaagucgaaaaagcuagcgcucgcgcccugcaaccaagccggaauggggguaguaggcaaggucggcgaaauacaauguagcagcgaagagucugcgcgaacgaucaagaaagacggcugcaucuggaacgcagaccuagucggaaucgaacuaaggguagacgacgcgguauguuacucgaaaaucacaucgguggaggccguggccaacuacuccgcaauaccuaccaccaucggaggccucagauucgaacgaagccacgacucacaaggcaaaauauccggaagcccacuugacauuacugcaaucagaggcucauucagcguaaacuacaggggacugcgacucagccuuucagaaaucacagcuacaugcacaggagaaguaacaaacgucuccggcugcuacaguuguaugacuggggcgaaaguuuccauaaaacuacacucgagcaaaaacagcacagcucacguuagauguaagggagacgaaaccgccuucucaguacucgaagggguccauagcuacagcguaagccuaucauucgaccacgccguaguagacgaacaaugucagcucaacugcggaggccaugaaagccacgugaccuuaagaggcaaccuaaucuucuuggacguccccaaauucguagacggcuccuacaugcaaaccuaccacaguaccguacccaccggggcaaauaucccaagcccaaccgacuggcuaaacgcccucuuuggcaacggccugucccgauggauacuaggggucauuggcgugcugcucggcggccucgcccuguucuuccuaauaaugagucucuucaaacuaggaacgaagcaagucuuccgcagccggaccaaacucgcguaa

SEQ ID NO: 16387 - RNA, 3222 nt, Artificial Sequence
  derived and/or modified CDS sequence (opt11) from SFTSV(JS2011-13-2)__KR230770.1__GP
augaugaagguaauaugguucagcucgcuuauaugcuuaguaauacaauguggcggcgacacaggcccgaucaucugcgcaggcccgauccacucaaacaaaagcgcagauaucccccaucugcucggauacuccgagaaaauaugccaaaucgaccgacugauccacgucagcagcuggcuacgcaaccacucgcaguuccaaggcuacguagggcagagaggcggcagaagccaggucucauacuaucccgcagaaaacuccuacagccgauggagcggcuuguuauccccaugcgacgccgauuggcuuggaaugcugguuguaaagaaagcaaaaggaucagauaugauaguaccggggccgagcuacaagggcaaaguauuuuucgagcgcccaacauucgacggauacguuggauggggaugcggcuccggaaaaaguaggacagaaagcggggaacuaugcuccucggacuccggaacgucgagcggacuccugccuucagaccgcgugcucuggauaggagacguggcaugccaaccgaugaccccaauacccgaagagacauuccucgaacuuaaauccuucucgcaaucagaguucccugacauuuguaaaaucgacggaaucguuuucaaccaaugcgagggcgagagccucccccagccguucgacgucgcguggauggacgucggacacucacacaaaauaaucaugagagaacacaaaacaaaauggguacaagaaagcagcagcaaagacuucgucugcuacaaggaaggaaccggcccgugcucagaauccgaagagaaaaccugcaaaaccucaggaagcugucggggagacaugcaauucugcaaaguagcaggaugugaacacggggaagaagcaucagaagccaagugccgaugcucccuaguacacaagccaggugaaguaguggucucauacggaggaaugagagugcgcccaaaguguuacggguucucgcgcaugauggcaacacucgaagugaaucaaccagaacaacggauaggacaaugcacaggcugccaucuagagugcauaaauggcgguguccggcuuaucacccuaaccucagagcucaaaagcgccaccgucugugcgagccacuucuguucuuccgccacaagcgguaaaaaguccacggagauacaguuccacucaggaucccucguaggcaaaacugccauccacguaaaaggcgcauuaguagacgggaccgaguucaccuucgaaggcucgugcauguuccccgacggcugcgacgccguagacugcacauuuugcagggaguuccuaaagaacccccaaugcuacccagcaaagaaauggcuauucaucaucauugucauccuacucggauaugcaggccuaaugcugcuaacgaacguccugaaagccauuggcguauggggcagcuggguaaucgcaccgguaaaacugguauuugcaauaaucaaaaagcucaugcgagcagucagcugccugaugggaaaacugauggaucgcgggcggcagguaauccacgaagaaauaggggaaaaucgcgagggaaaccaagacgacguacguauagagauggcgcgaccccgcagggugcgccacuggauguacagccccgucauccucacgauacucgcaaucggccuagcagaaggaugcgacgaaauggugcacgcggauaguaaguuagucucgugcagacaggggucaggaaacaugaaagagugcgucaccacgggcagggcccuucugccagcggucaacccgggccaagaggcaugcuugcauuuuaccgcaccagguagcccggacuccaaaugccuaaagauaaaggucaaacgcauaaaccucaaaugcaaaaagagcucgagcuauuucguaccagacgcaaggagucgcugcaccucaguacggagaugccgaugggcaggagacugccaaagcggcugcccaccccacuucaccagcaacaguuucagcgacgacugggccgggaagauggacagagccggccucggcuucucaggcugcagugacgggugcggaggggccgcuugcgggugcuucaacgcagcacccaguugcaucuucuggagaaagugggucgaaaauccacacgggaucaucuggaaagucucacccugcgcggcauggguaccaucagcugugaucgaacucacgaugcccucaggggaagugagaacguuccacccgaugagcggaaucccgacacaagucuucaaaggagucucgguaaccuacuuaggcuccgacauggaaguguccggacucaccgaccucugcgaaaucgaagaacucaaauccaaaaagcucgcacuagcgccaugcaaccaagcgggaaugggaguaguaggcaaagucggagagauacagugcagcucggaagaaagcgcccggacaauaaagaaagacggcugcaucuggaacgcggaucuagucggcaucgaacuucgaguagacgaugcagucugcuauuccaaaauaacaucggucgaagcgguugcaaacuacucagccaucccuaccaccaucggcggccucagguucgaacguagccacgacagucaggggaaaaucagcggcucuccacuggacaucacggccauaagagguagcuuuagcgucaacuacagaggucuacgccuaagccuaagcgaaauaacagccacaugcacaggcgaagucaccaacguaaguggcugcuacagcugcaugaccggagcaaaaguaagcaucaaacugcacucauccaaaaauuccaccgcacacguccgaugcaaaggggacgaaaccgcguucucaguccuagaaggaguccacagcuacuccguuagccucagcuuugaccaugcagucgucgacgaacaaugccagcucaacugcggaggacacgagucgcacguaacccuaaaaggaaaccugaucuucuuagacguuccuaaauucgucgacgggagcuacaugcaaacauaccauagcaccguccccaccggcgcaaacaucccaagccccacagacugguuaaacgcacucuucggcaacggccuaagcagauggauacucggcgucaucggcgugcuacucggaggacuagcucucuucuuccuaauaaugucccuuuucaaacucggaaccaaacaaguguucagaagccgcacaaaacuagcauag

SEQ ID NO: 16388 - RNA, 3222 nt, Artificial Sequence
  derived and/or modified CDS sequence (opt11) from SFTSV(JS2011-69)__KR230771.1__GP
augaugaaagucaucugguuuagcucacucgugugccuaguaauccaaugcagcggcgacaccggcccaaucaucugcgccgguccaauccacagcaacaaaagcgcaaauaucccccaccuccucggguacucugagaaaaucugccaaauagacaggcucauacauguaagcucguggcuacgaaaccacagccaguuccaaggcuaugugggccagcgcggaggccggucccaaguuucauacuaccccgcagaaaauagcuacagucgauggucaggccuacucagccccugcgacgcggacuggcucgguaugcuagucgucaagaaagccaaaggaucagacaugaucguaccuggaccgucauacaaaggcaaagucuucuuugaaaggcccacauuugacggauacgugggauggggcugcgguucaggcaaaagccgcaccgaaagcggggagcuaugcagcuccgacagcgggacgucaucgggacugcucccgucggacaggguccuauggaucggcgacguugccugccaaccaaugaccccgauacccgaagagacauuccuagaacuaaagagcuucagccaaagugaguuccccgacaucugcaaaaucgacgggauagucuuuaaucaaugcgacucagaaucacuaccacaaccauucgacguagccuggauggacgucggccacucccacaaaaucaucaugcgggaacacaaaaccaaauggguacaagaaucgagcucgaaggacuucguaugcuauaaagaggguacaggccccuguagugaaucggaggagaaaacaugcaagaccagcggcagcugucgaggcgacaugcaauuuuguaaagucgccggcugcgaacacggagaagaggccucugaagcaaaaugccgaugcagccucgugcacaaaccuggagaggucgucgucaguuacggaggaaugcgcgugcgcccgaaaugcuacggguuuagucgcaugauggcgacccuagaagugaacccacccgaacagagaaucggucaaugcacagguugccaccuagaaugcaucaacggaggaguacgcuuaaucacacucacaagcgaacucaaauccgcgaccgugugcgcaagccacuucugcagcucagccacaagcgguaagaaaagcaccgaaauccaauuucacucaggaagccucgucggcaaagccgcaauccacguaaaaggcgcccuaguagacgggaccgaguuuaccuucgaagggagcugcauguuucccgacggaugcgacgcagucgauugcaccuucugcagagaauuucucaaaaacccucaaugcuacccagcaaagaaauggcuauucaucaucaucgucauccuacuaggauacgccggccuaaugcugcuaacaaacguacucaaagccaucgggguaugggggucaugggucauggccccggucaaacuuauguucgccaucauaaagaaacuaaugaggagcgucuccugcuuaauggggaagcuaauggaccgaggaagacagguaauacacgaggaaaucggagaaaacagagaaggcaaucaagacgacgucagaaucgagauggcacgccccagaagaguccggcauuggauguacagcccgguuauacuaacaauccuagcuauaggacuggcggaaggaugcgaugaaaugguacacgcggacuccaagcuggugagcugcagacaaggaagcggcaauaugaaagagugcgugacaacgggccgggcgcuccucccagccgugaacccggggcaagaagcauguuugcacuucaccgcaccaggauccccagacuccaaaugccuaaaaauuaaagucaagcgaauaaaucuaaaaugcaagaaaucgagcagcuauuucguucccgaugcaagauccagaugcaccagcgugcgccgaugccgcugggccggcgauugccaaagcggcugcccgagccauuucacaucaaacucguucagcgacgacugggcaggcaaaauggaccgagcugggcucgguuuuucaggcugcagcgacggcugcgggggagccgccugcgggugcuucaacgccgccccauccugcauauucuggaggaaaugggucgaaaacccacacgggaucauauggaaagucucgcccugcgcagccuggguucccuccgccguaaucgaacuaacaaugccguccggcgaaguccguacauuccacccaaugagcgggaucccaacccaagucuucaaaggaguaucagugacguaccugggcuccgacauggaagugucgggccugacggaucuaugcgaaauagaggaacuaaaaagcaaaaagcucgcucuagcaccaugcaaccaggccggaaugggcguaguggguaagguaggagagauccaaugcuccucugaggaaagcgcacgcacgauaaagaaagacggaugcauauggaacgcggaccucguaggaauagaacucaggguggacgacgcagucugcuauuccaaaaucacaucaguagaagcaguagcgaacuacucagccauaccgacgacgaucggcgggcuacgguucgaacgaucgcacgacagucaaggcaagauaagcggcucaccacuagacaucaccgccguaagaggaucauucucaguaaacuacagaggacuaagacucagcuuaagcgagaucacugcaaccugcacgggagaaguaacgaauguaagcgggugcuacaguugcaugaccggcgcgaaagugucuauuaaacugcacuccaguaaaaacucaacugcacacgucagaugcaaaggagacgagaccgcauucuccguacuagaggggguccacuccuacaccguaucccugagcuuugaccacgcgguaguagaugaacaaugccagcucaacugcggaggacaugaaucgcaagugacacucaaagggaaccuaaucuuccuagacgugccgaaauuuguggacggaucauacaugcagacauaccacucaaguguaccaaccggggccaacauaccgaguccgaccgacuggcugaacgcauuguucggcaacggacuaucuagguggauacucggagucaucgggguacuucucgguguccucgcgcuguucuuccucaucaugagccuauucaaacucggaaccaaacagguuuuccgaagccggacgaaacucgccuaa

SEQ ID NO: 16389 - RNA, 3222 nt, Artificial Sequence
  derived and/or modified CDS sequence (opt11) from SFTSV(JS2012-020)__KC505142.1__GP
augaugaaagucauaugguuuagcuccuuaauaugccucgucauucaaugcggcggggauacgggacccaucauaugugcaggccccauccauagcaauaaauccgccgacauaccgcacuuacuuggguacucggagaaaaucugccaaaucgaccggcucauccacgugaguucuuggcuaaggaaccauagccaauuucagggcuacguaggccagcgaggaggaaggagccaaguaucauacuaccccgcagaaaacagcuacagccgguggagcgguuuacugucgccaugcgacgccgacuggcucggcaugcugguagugaagaaagcgaaaggcucagacaugaucguacccggaccaucguacaaaggcaaagucuuuuucgaacgaccaacauucgauggauacgucggauggggcugcggcagcggaaaauccaggacugaaagcggagaauuaugcuccagcgacagcggcaccucaagcgggcuucuacccucagauagaguauuauggauaggcgacgucgccugccagccgaugacuccaauccccgaggaaacguuccuagaacuuaaaucauucucgcaauccgaguucccggacauaugcaagauugacggaauagucuuuaaccaaugcggaggggaaagccuaccccagccauucgacguagccuggauggacguagggcacagccacaaaauaauaaugagagaacacaaaacaaaauggguccaggaaagcagcagcaaagacuucgucugcuacaaggaaggcaccggaccaugcucagaauccgaagaaaagaccugcaagacguccggcuccugccgaggugauaugcaguucugcaaaguggccggaugcgagcacggcgaagaagccucagaagcaaaaugccguuguagccucguccacaaaccgggagaggucgucguaucauauggaggaaugcgcguaggcccgaaaugcuacggguucucgcgcaugauggcaacccuggaagucaaccaaccggagcaacgcauaggacagugcaccggcugccaucucgaaugcaucaauggaggcgugcggcuaauaacccuaacauccgaacuaaagagcgccaccgucugcgcgagccacuucugcucaagcgcaacauccgggaagaagaguacggaaauucaguuccacucgggaagucuagugggcaaaaccgcaauacacgucaaaggcgcgcuugucgacggcacggaguucaccuucgaaggcagcugcauguucccagacggaugcgacgcaguagacuguacauuuugccgggaguuccucaaaaauccacaaugcuacccagcgaagaaauggcuauuuaucaucauaauaauccuauuaggauacgcaggacucaugcuccucacaaacguacucaaagcaaucggagucugggggaguugggucauagcacccgucaaacucguguucgccaucaucaaaaagcucaugcgagcagucaguugccugaugggaaaacuaauggauagaggaagacagguaauacacgaggaaauaggcgaaaacagagaaggaaaccaggacgaugucagaauagaaauggcaagaccaagaagaguaaggcacuggauguacuccccagucauccuaacaauacuagccaucggacucgccgagggaugcgacgagaugguacacgcggauuccaagcugguaagcugcaggcagggcuccggaaacaugaaagaaugcguaacgaccgggcgagcccuccuaccggcaguaaauccagggcaggaggcaugccuacacuucaccgcucccgggaguccagacagcaaaugucucaagauaaagguaaagcguauaaacuuaaaauguaaaaaguccucaagcuacuucguacccgacgcuagaagcagaugcaccucaguaagaagaugccgaugggcgggcgacugccaaucaggcugcccgccccacuucaccagcaacaguuucagcgacgacugggcaggaaagauggaccgagcgggccucggguucucuggcugcuccgacgggugcgggggagcagcgugcggaugcuucaacgccgcaccaagcugcaucuucuggcgaaaguggguugagaacccacacgggaucaucuggaaggucagcccaugcgcagccuggguccccagcgccgugauagaacuaacuaugccgucuggcgaagugcgcacauuccaccccaugagcgggauuccgacucaagucuucaaaggagucagcguaaguuaccucggcagcgacauggaaguaucaggccuaacagaucugugcgaaaucgaggaacugaaaagcaagaaacuagcgcucgccccgugcaaccaggcagggaugggggucguuggaaaagucggggagauucaauguagcucagaagagagugcgcgaaccauaaagaaagacggauguauauggaacgcggaccucguaggaauagaacuccgaguugaugacgcggucugcuacucgaaaauaaccagcguagaagcagucgccaacuacucggcaaucccaacaacgauaggaggccuaagauucgagcgcucacacgacagccaaggaaaaauaucgggcucaccacucgauauaacugccaucaggggcucguuuucagucaacuacaggggccuccgucugagccuaagcgaaauaacagcgaccugcacgggagaagucacaaacguaagcgguugcuacaguugcaugacuggagcaaaaguaagcauaaaauugcacagcagcaaaaacucaacagcacauguacgcugcaaaggggacgaaaccgccuuuucaguccuagaagggguucacagcuacagcgugucgcucaguuuugaccacgcagucguagacgaacaaugucaacucaacugcggaggacacgagucacacguaacccugaaagggaaccuaaucuuccucgaugucccgaaauucguagacggguccuacaugcaaacauaccacagcacaguccccacuggggcaaacauuccaagcccgaccgacuggcugaacgcacucuucggaaacgggcugagucgguggauccuuggugugauaggggugcugcuuggaggccucgcccucuucuuccuaaucaugucccuguucaaacucggcaccaaacaaguguuccgaagccggacaaaacucgcauaa

SEQ ID NO: 16390 - RNA, 3222 nt, Artificial Sequence
  derived and/or modified CDS sequence (opt11) from SFTSV(JS2012-035)__KC505145.1__GP
augaugaaagucaucugguucuccucccuuaucugccuaguaauccaaugcggcggagacaccggaccgaucauaugcgccggccccauucacuccaacaaguccgcagacaucccccaccuacuaggauacucugaaaagauaugucaaauagauaggcucauacacgucuccuccuggcuacgcaaccacucucaguuccaaggguacguaggccagcgcggcgggcgaagccagguaagcuacuaucccgcagagaacagcuauucaagauggagcggccuacucucaccgugugacgccgacuggcuaggaaugcuaguagugaagaaagccaaaggcucggacaugauagugccggggccaagcuacaaaggcaaaguauucuucgaaagaccaaccuuugacggauacgucggcuggggauguggcagcggcaaaagccggaccgaaagcggagaacuaugcagcagugacucgggcaccagcucaggacuacugcccucagaccgcgugcuguggaucggggacgucgccugccagcccaugacccccaucccagaggaaaccuuccucgagcuaaaaaguuucucacaauccgaauuuccagauaucugcaaaaucgacggcauaguauucaaccaaugcgagggcgagagccucccccaacccuuugacgucgccuggauggacgucggccacucacacaaaaucauaaugcgcgaacacaaaacaaaauggguccaagaaucgagcucaaaagacuucgucuguuauaaagaaggcaccgggccaugcucagaaagcgaggagaaaacguguaaaaccucagggagcugccgaggcgacaugcaauuuugcaaaguagccggcugcgaacacggggaagaagcgucagaagcaaaaugccgcugcagccugguacacaaacccggagaagugguugucucguacggcgguaugcgcguacgccccaaaugcuacggauucucacgcaugauggcaaccuugggagucaaccagccagagcaaaggauaggccagugcaccgggugccaccuggaaugcauaaacgggggcguacgucuaaucacacuaacgagugaacuaaaaagcgcgacagugugcgcgucgcacuucugcucauccgcuacuagcggaaagaaguccacagaaauccaauuucacuccggaagccugguaggaaaaaccgcgauacacguaaaaggagcccuaguggacgggacagaguucacauucgaagggagcugcauguucccagacggcugcgacgccguagacugcacauucugucgagaguuccugaaaaacccccagugcuaccccgcaaagaaaugguuauucauuaucauaguaauucuccucggcuacgccggauuaaugcugcugaccaacguccucaaggccauagggguauggggaagcugggucaucgcaccaguaaagcucgucuucgccauaauuaaaaagcuaaugagggcaguaucgugccugaugggaaagcucauggaccgcggccgccaaguaauccaugaagaaauaggcgaaaaccgagaaggcaaccaagacgacguacgcaucgagauggcccgaccccgaagggucagacacuggauguacuccccggucauccucaccaucuuagcaaucggccuagccgaaggcugcgacgaaaugguacacgcagacuccaagcuagucagcugcagacaaggaagcggcaacaugaaagaauguguaacuaccggacgggcccucuuaccggccguuaacccaggccaagaagcaugccuccacuucaccgccccuggaucaccagacucaaaaugccucaaaauaaaggugaaaagaauaaaccucaaaugcaaaaagagcucaagcuacuucgucccagacgcccgcucccgaugcaccagcguaagaagaugcagaugggcaggagacugccagagcgggugcccgccgcacuucacaagcaacagcuucuccgacgacugggcuggcaagauggaucgcgccgggcuaggauucuccggcugcagcgacggcugcgggggagccgcuugcggcugcuucaaugcggcccccagcugcauauuuuggagaaaauggguggaaaacccccacggaauaaucuggaagguauccccaugcgcagccuggguaccguccgccgucaucgagcucacaaugccaagcggagaaguucgaacauuccaccccaugucagggauaccgacacaagucuuuaaaggagucagcgucaccuaccugggauccgacauggaaguauccggacuaaccgaccuaugcgagauagaggaauuaaaaucgaaaaagcuagcccuagcacccugcaaccaagcaggcaugggaguaguaggcaagguaggcgaaauccaaugcagcucugaggaaucagcacgcaccaucaaaaaggacggguguaucuggaacgcagaccugguaggaaucgaacuccggguagacgacgcaguaugcuacagcaaaaucaccagcguagaagcagucgcaaacuacagcgcgaucccaaccaccauaggaggacuccgauucgagagaagucaugacucacagggcaaaauaagcggaucaccgcuggacauaacugccauccggggaaguuucagcgucaauuacagaggcuuacgccucagcuuauccgagauaaccgcaacguguacuggagaagucacaaacgugucaggcugcuacuccuguaugacaggcgcaaaagucaguauaaaauugcacuccucgaagaacucgaccgcccacguaagaugcaagggugacgaaacagccuucagcguacucgagggaguacacucauacagcgucucacucagcuucgaucacgccgugguagacgaacagugccagcugaacugcggcggacacgaaucacacguaacacugcgaggaaacuuaaucuuccucgauguuccaaaauucguggacggguccuauaugcaaaccuaccacagcacagucccaacaggcgcuaacauccccagucccaccgauuggcuuaacgcacuuuucggcaacggccuaucucgauggauucucgguguuauaggaguacuucugggcgggcucgcccucuucuuccucaucaugagccuguucaaacucggcacgaaacaaguuuuccgcucacgaacaaaacucgcauga

SEQ ID NO: 16391 - RNA, 3222 nt, Artificial Sequence
  derived and/or modified CDS sequence (opt11) from SFTSV(JS2012-79)__KR230772.1__GP
augaugaaaguaauaugguucagcagccuaacaugcuucgucauucaaugcagcggggacuccggaccaauaauaugcgcggguccaauccacagcaacaaaagcgcagauauaccacaucugcucggauacagcgagaaaaucugucaaaucgaccgacugauacacgucuccucauggcuccgaaaccacagccaauuccaaggauacgucggccagcgcggcgggagaagucaagucucauacuacccagcagaaaauuccuacagucgcuggucgggccuacuuucacccugugacgcagacuggcuagggaugcuagucgugaagaaagccaagggauccgauaugauaguccccgguccaagcuacaaaggcaagguguuuuucgaaagacccaccuuugacggcuacguuggguggggcugcgggagcggcaaaagccggacagaaagcggugagcugugcucaagcgacagugguaccuccagcggacuccuccccagcgacagaguccucuggauaggcgacgucgcaugccaaccaaugaccccgauucccgaagaaaccuuccuugaacucaagaguuucucucaaagcgaguucccagacauaugcaaaaucgacggcaucgucuuuaaccagugcgaaggcgagagccucccacaaccauucgacgucgcauggauggacgugggccacucacacaaaauaauaaugcgagagcacaaaacaaaguggguccaggaaucgucaagcaaagacuucguguguuacaaagagggcaccggcccgugcucagaaucggaagagaaaacaugcaagaccuccggaucgugcagaggcgacaugcaguucugcaaaguagcaggaugcgaacacggagaagaagcaucagaagcaaaaugccguuguagucugguccacaaaccaggcgaagucgugguuucguacgggggcaugcgaauacgacccaaaugcuacggguucucccguaugauggccacucucgaaguaaaccagccagaacaaagacucggccaaugcacaggaugccaccuugaaugcauaaauggcggaguccgucuaauuacccugacgagugagcuaaagagcgcaaccgucugcgcgagucacuucugcagcagcgcaacgagcggcaaaaagagcacagagauacaauuccacucaggaagccucgucggaaagaccgccauccauguaaagggagcacuuguggacggcaccgaauuuaccuucgaaggaucaugcauguucccugacggaugcgacgcgguggacugcacauuuugcagggaauuucucaagaacccgcagugcuaccccgccaagaaauggcuauucauaauuaucgugauacugcucggguacgcaggacuuaugcuauugacaaauguacuuaaagccauuggaaucuggggaagcugggucauagcaccugucaagcuaauguucgcgauaaucaagaaacugaugagaacggucucgugccuaaugaggaaacucauggaucguggucgucagguuauucacgaggagauaggcgaaaacagggaagggaaccaggacgaugucaggaucgaaauggcucgcccgcgcagaguccgacacuggauguacagcccggugauccugaccauccuggcaauaggauuagcagaaagcugugaugaaaugguacacgcagacucgaaacucguauccugccggcagggcaguggcaacaugaaagagugcgugacaaccggacgggcccuacugucagcaguaaacccgggccaggaggcaugccuacacuucacugcacccggaucaccugacucaaaaugucuaaaaauaaaagugaaacgcaucaaccugaaaugcaaaaagagcucgagcuauuucguucccgacgcgagaagccgcugcacaagcguaaggagguguaggugggcgggcgacugccaaagcggaugucccccgcacuuuacguccaacucauucagcgacgacugggccggcaaaauggaccgagccggccucggguucucaggaugcagcgacggcugcggcggcgcagccugcgguugcuucaacgccgcccccucgugcaucuuuuggaggaaauggguagaaaacccccacgguauaaucuggaaaguaagccccugcgccgcaugggugcccagcgcagucauagaacuaacaaugccaagcggggagguacgaacguuccacccaaugagugguauaccaacacaaguauucaaaggugucucaguaaccuacuuaggcagugacauggaaguaagcgggcucacagaccugugcgaaaucgaggaauugaaaucaaagaaacuagcccuagccccuugcaaccaggccggcauggggguaguggggaaaguaggagaaauccaaugcagcagcgaagagagcgcucgcacaaucaagaaggacggaugcaucuggaacgcggaccucguagggauagaacuacggguagacgacgcagugugcuacucaaaaauaaccucgguagaagccguagcuaacuacagcgcaauaccaacaacgauuggcggacucagauucgagagaucccacgacagccaaggaaaaaucagcggaucaccuuuagacauaacggcaauaagaggcagcuucucagucaauuacaggggccugagacugagccuuucggagauaacggcuaccugcacaggcgaggugacgaacguaagcgguugcuacagcugcaugaccggagcgaaagucuccaucaaacuacacuccagcaagaacucaacagcacacguccgcugcaaaggcgaugagacagccuucuccguccuagaagggggccacagcuacaccgugagccuauccuucgaccacgccguagucgacgagcaaugccaacucaauugcgggggacacgaaagccaagucacacuaaaaggaaaccuaaucuuccucgacgucccgaaauucguagauggcagcuacaugcagacguaucacagcaccguaccgacaggagcgaacauaccuagcccaaccgacuggcuaaaugcacuguucggaaacggacuaagccgguggauauuaggagucauaggaguguuacucggaggccucgcacucuucuuuaugaucaugagccuguucaagcucgggacaaagcaaguauuccggagccgcaccaaacucgcguaa

SEQ ID NO: 16392 - RNA, 3222 nt, Artificial Sequence
  derived and/or modified CDS sequence (opt11) from SFTSV(JS2013-44)__KR230773.1__GP
augaugaagguaauaugguucaguucacuaauaugcuucguaauacaaugcagcggggacagcgguccaaucaucugcgcaggaccaauucacagcaacaaaucagccgauauaccccaccuccuaggcuacucugaaaagaucugccaaaucgacaggcuaauccacgucuccaguuggcuacgaaaccacucacaauuccaaggguacgucgggcaaagagggggccggagccaagucaguuacuaccccgccgaaaacaguuacagccgcuggucgggucugcuaagccccugugacgcggacuggcuaggaaugcucgucgugaagaaagcaaaaggcucagauaugaucguacccggacccucauacaaagguaaagucuucuuugaaagaccaacguucgacggauacguaggcuggggaugcggcuccggcaaaaguaggacagaaagcggggaacucugcagcuccgacaguggcaccucaagcggccuccuacccucagaccgaguauuauggaucggggacguggcaugccaaccuaugacaccgauccccgaagaaacguuccuagaacucaagagcuucucgcaaagugaguuccccgacaucuguaaaaucgacgggaucguuuucaaccaaugcgaaggcgagagccugccacaaccauucgacgucgccuggauggacgucgggcacucccacaaaaucauuaugcgagagcacaaaacaaaauggguccaggaaucauccaguaaagacuuuguaugcuauaaagagggcaccgggccgugcagcgagucagaagagaaaacgugcaaaacaaguggcagcugucgcggggacaugcaauucugcaaaguggcagggugcgaacacggggaagaaaccuccgaagcaaaaugccgaugcagucugguacacaaacccggagagguaguagugaguuacggcggaaugaggauacgcccaaaaugcuacggauuuucgcgaaugauggcaacacuggaagugaaucaacccgaacaacgacuaggccaaugcacagggugccaccuagaaugcaucaacggagggguacgucugaucacucugaccagcgaacuaaaaagugcgaccgugugcgcgagccacuucugcuccucagcuaccagcggaaagaaaaguaccgaaauccaauuucacagcgggagccuagucggcaaaaccgccauacacguaaaaggagcccuaguagauggcacagaauuuaccuucgaaggcucaugcauguuuccggauggcugugacgccguagacugcacuuucugccgggaguuccucaaaaacccgcaguguuacccagcgaagaaauggcuauucaucauaauagugauccuacuaggcuacgccggacuaaugcugcucacaaacguacuaaaagcaauaggcaucuggggaagcuggguaauagcccccgucaaacugauguucgcaaucaucaagaaacucaugaggacagucucuugccuuaugagaaaacucauggaccgcggaaggcaagugauccacgaagaaaucggcgaaaaccgagaaggcaaccaagacgacgugcgcaucgaaauggcucggcccagacgcguccgacacuggauguacagcccaguaauccucaccauccuggcaaucggacuugcggagaguugcgacgagauggugcacgcagacagcaaacucguauccugcagacaaggaagcggaaacaugaaagaaugcguaaccacagggagagcccuacugccugcugucaauccaggacaagaggcgugccuacauuucaccgcccccggaagccccgacucgaaaugccugaaaaucaaagucaaacgaauaaaccuaaaaugcaagaaaaguagcuccuacuucguccccgacgcgcgcagccgaugcaccaguguaagacggugccgaugggccggcgacugccaaaguggaugcccaccccacuuuaccucaaacagcuucuccgacgacugggcaggaaaaauggaccgggcgggccucggauucagcggcugcucggacggcugcggcggcgcagcaugcggcugcuucaacgcagcccccucaugcauauucuggcgaaaauggguagaaaacccccacggaauuaucuggaaagucagccccugcgcagcauggguacccagcgcggugaucgaacuaacaaugccaagcggagaaguacggacauuccauccaaugucggggauucccacucaaguauucaaaggggucucgguaacguaccuaggaagcgacauggaagucuccggucuuaccgaccucugcgagaucgaggaacuuaaauccaagaaacucgcgcuagcccccugcaaccaagccggaaugggagucguaggcaaagucggggaaauacaaugcagcucagaagagagcgcccgcacgauaaagaaagaugggugcaucuggaacgccgaccucgucgguauagaacucaggguggaugacgccgucugcuacucaaagauuacaucuguggaagcaguggcaaacuauuccgcgauccccacgaccauaggcggccuccgcuucgaaaggagccacgacagccaaggcaaaaucucaggcagcccccuagacaucagcgccaucagaggcucauucagcgucaacuaucgcggccuacgucucagccucagcgagaucacugccacauguacaggcgagguaacaaacgucucugguugcuacuccugcaugacaggugccaaagucucaauaaaacuucacagcagcaaaaacagcaccgcgcacguacgcugcaaaggagacgaaacugcauucucaguacuagagggaguccacucguacauuguaucacucagcuucgaccacgcgguugucgacgaacaaugucagcugaauugcggcggucaugaaagucaaguaacccucaagggaaacuuaaucuuccuagaugucccaaaauucgucgacggcucguacaugcaaacauaccacagcaccgucccaaccggagcaaacaucccguccccgacagacuggcugaaugcacucuucgguaacggccuaucacgcuggauucuaggcguaaucggaguacuccuaggcggauuggcacuauucagcaugauuaugagccucuucaaacucggaaccaaacaaguauuccggucccgcacgaaacucgccuaa

SEQ ID NO: 16393 - RNA, 3222 nt, Artificial Sequence
  derived and/or modified CDS sequence (opt11) from SFTSV(JS2013-46)__KR230774.1__GP
augaugaaaguuauaugguuuagcucacuaauaugcuuagucauccagugcggcggagacacagguccgauaauaugcgcaggcccaauccauagcaauaaguccgcugacauaccccacuugcucggguacucagagaaaauaugccaaauagacaggcuuauccacgugucgagcuggcuacgcaaccauucucaauuucaaggguacgugggccagcguggaggaaggucccaggucuccuacuacccggcggaaaauagcuacagccgguggucagggcuucucucccccugugacgccgacuggcuagggaugcuggucgugaaaaaggcaaaagggagcgacaugauaguaccagguccuucguacaaaggaaagguauuuuucgaacgcccaacauucgacggguacguaggcuggggcugcgguagcggcaagagucguaccgagagcggugaacuaugcucuagcgacaguggcaccucaaguggacuccuaccaagcgacagaguacucuggauaggugacgucgcaugccagccgaugaccccgaucccagaggaaacauuccuagagcucaagaguuucagccaauccgaguucccagacauuugcaaaaucgacggcaucgucuucaaccagugcgaaggcgagagcuuaccccaacccuucgacguagccuggauggacgucgggcacucacacaagaucauaaugagggagcauaaaacaaaauggguccaagagucaaguucgaaagacuucgucugcuacaaagagggaacgggcccauguucggaaucagaggagaaaacaugcaagacuucaggcuccuguagaggcgacaugcaauucugcaagguagcagggugcgaacacggagaagaagcaucagaagcuaaaugccgcuguagccuaguccauaagccgggcgaagucgugguaagcuacggugguaugcgcguacgcccgaagugcuacggauucucuagaaugauggcgacccuggaggucaacgagcccgagcaaagaaucggacaaugcaccggcugccaccuagaaugcauaaguggaggaguacgucugauaacacuaacgagugaacucaaaagcgccacagugugcgcaucccacuucugcuccucagccacauccggaaagaaauccacagaaauccaauuccacucggguucgcuagugggaaagacagcaauucacgucaaaggagcgcuaguggacggcaccgaguucacauucgaaggaucguguauguuccccgacgguugcgacgccguggacugcacuuuuugccgcgaguuccucaagaauccccaauguuacccagccaagaaauggcuuuucaucauaaucgugauccugcuaggauacgcaggccugaugcugcuaacaaacguccuaaaagccaucggagucugggggagcuggguaauugccccgguaaagcuaguauucgcgaucauaaagaaacuuaugcgcgcagucucaugccugaugggaaaacuaauggacagaggacgacaagucauacacgaagaaauaggcgaaaaccgagaagggaaccaggacgacguacgcauugaaauggcgagaccacgccgaguccgacacuggauguacagccccguaauacuaacgauucuggcgaugggccucgccgaagggugcgacgaaaugguacacgcggauagcaagcuaguaucaugcaggcaaggaagcggcaacaugaaagaaugcguaaccacgggcagagcacugcucccggcagucaacccgggccaggaagcgugccuucacuuuauggcgccugggagccccgacucaaaaugccucaaaaucaaagugaaacgcauaaaccucaaauguaagaaaagcuccagcuauuucgugcccgacgccagguccagaugcacaaguguacgacgcugcagaugggcuggagauugccaaagcggaugcccgccacauuucacuagcaauagcuucagcgacgacugggccgggaaaauggacagggccgggcuagguuucuccggaugcuccgacggaugcggcggggcagccugcgggugcuucaacgcggccccgaguuguauauucuggaggaaguggguagagaacccccacgggaucauauggaaaguaucgcccugcgcggcuuggguacccucagcuguaauagagcucacuaugcccagcggcgaaguacgcaccuuccaccccaugaguggaaucccgacccaggucuucaaaggugucagcguuacguaccucggcagcgauauggaagucagcggacugacggacuugugcgagauagaggaacucaaguccaaaaagcucgcacuugccccauguaaucaagccgguauggggguagugggcaagguaggagagauccaaugcucauccgaagaaagcgcccgcacaauaaagaaagacggaugcauauggaaugcagaccucguaggcaucgaacuaagaguagacgacgcgguaugcuacuccaaaauuaccucagucgaggccgucgcuaacuacucggccauacccacgaccauaggcggccuacguuucgaaagaagccacgacagccagggaaaaaucagcggcucgccucucgacauaaccgcaauuaggggaaguuucucaauaaacuaccggggccugcguuugagcuuaagcgaaaucagcgcgacaugcacgggggaaguaacgaacguaagcgggugcuacuccugcaugaccggggcgaaaguaagcauuaaacuacacagcagcaaaaacucgacagcacacguucgcugcaaaggagacgaaacagcguucagcguccucgaaggaguccacagcuacuccgugagccugagcuuugaccacgcuguaguagacgaacagugccaacuaaacugcgggggucacgaaucgcaagucacccuaagaggaaaccugaucuuucuagaugucccaaaauucguagacggaucguacaugcaaaccuaccacagcacggucccgacgggggccaacaucccgagccccaccgacugguugaacgcacucuucggcaacggacucuccagauggauacuaggugucaucggcgugcuacuaggcgggcucgcacucuucuuccuaauuaugucccuauucaaauuaggaaccaaacagguguuccgaagccgaaccaaacuagcguaa

SEQ ID NO: 16394 - RNA, 3222 nt, Artificial Sequence
  derived and/or modified CDS sequence (opt11) from SFTSV(JS2013-52)__KR230775.1__GP
augaugaaagucaucugguucuccuccuuaauaugcuucgucauccaaugcuccggcgacucaggccccaucaucugcgcaggccccauccacuccaacaaguccgcagauaucccucaccuccuuggcuacucagagaaaaucugccagauagacaggcucauccacguaagcagcuggcuacguaaccacucacaauuccaaggauacguaggucagcgcggaggcagaagccaggucagcuacuacccagcagaaaacaguuauagccgauggucuggguuacuaagccccugcgacgcagacugguuggggaugcuagucguuaagaaagcaaaaggaucagacaugauaguacccggccccagcuacaaaggaaaagucuucuucgagcggccaacauucgacggauacguaggauggggcuguggauccggcaaaagccgaaccgaguccggcgagcuaugcucaagcgacagcggaaccucauccggccuacuaccaucagaccgcguccuguggaucggcgacguagccugccagccaaugacccccauccccgaagaaaccuuccuagaacuuaagagcuucagucaaagcgaguuccccgacaucugcaaaaucgacggcaucgucuucaaccaaugugaaggagaaagccucccgcagcccuucgacgucgcuuggauggacgucggacauucacacaaaauuauaaugagggaacauaaaacgaaauggguccaagaaaguagcucaaaggacuucguaugcuacaaagagggcacaggaccgugcucagagucggaggagaaaacaugcaaaaccagcggcuccugcagaggagacaugcaauucugcaaaguggcaggaugcgagcacggggaggaagcauccgaagcuaaaugccgcugcucccucguccacaagccaggggaagucguaguauccuacgggggaaugagagugcgacccaaaugcuacggcuucagccgcaugauggcaacccucgaaguaaaccagcccgaacaacggauagggcaguguaccggcugccaccucgaaugcaucaacggaggugugcgccuaaucacacuaaccuccgaacucaaaagcgccaccgucugcgccagccacuucugcuccucagcaacgagcggcaagaaaagcaccgaaauccaauuccacagcggaagccuagucggcaaaaccgccauacacguaaagggcgcccucguagacgggacagaguucaccuucgagggcuccugcauguuccccgauggaugcgacgcaguagacugcacguucugcagagaguuccuaaagaacccacaaugcuacccggcaaagaaauggcuauucaucauaaucguaauacuacuuggcuacgccggccuaaugcuacucacaaacguacucaaagccaucggaauauggggaagcugggucauagcacccgucaaacucauguuugcgaucaucaagaaacuuaugcgcaccguaagcugcuuaaugggaaaauugauggaccgcgggagacaaguaauccacgaagaaaucggagaaaaucgcgaaggaaaucaagacgacguuagaauagaaauggcaaggccccguagaguccgacacuggauguauagccccgugauccucacauuucuagccauaggacuagccgaaucaugcgacgaaaugguacacgccgacuccaagcuagucagcugcagacagggauccggaaacaugaaagaaugcgucaccaccggccgagcccugcucccagcggucaacccgggacaagaagccugccugcacuucacagcgcccggcaguccagacaguaaaugucugaaaaucaaagugaaaagaauuaaucuaaaaugcaagaaaucaucaagcuacuucguaccggacgccagaagcagaugcaccuccguacgacgcugucgaugggccggcgacugccaaagcgggugcccgccccacuucacauccaacucauucagcgacgacugggcaggaaaaauggacagggcaggacuaggcuuuucuggcuguagcgacggaugcggcggggccgcaugcgggugcuucaaugcagcuccaucauguaucuucuggcggaaauggguugagaacccgcacgggauaaucuggaaggucucacccugcgcagcauggguucccagcgcggugauagaauugacaaugccaaguggcgaaguccgaaccuuccacccuaugucuggcaucccgacacaaguguucaaaggagucagcgucacuuaccuuggcagcgacauggagguaagcgggcucaccgaccucugcgaaauugaggagcuuaaaagcaaaaagcuagcgcuugcucccugcaaccaagccgggaugggagucguuggcaaagucggagaaauucaaugcucaagcgaagaaagcgcucgcacaauaaagaaagacggaugcaucuggaacgcggaccuggucggaauagagcuacgggucgacgacgccguuuguuacagcaaaaucaccuccgucgaagccguggccaacuacucugccaucccaacaaccaucggcgggcucagauucgaacgcucccaugacucacagggaaaaaucuccggcucuccacucgacauaacagccauccgcggauccuucagcguaaauuacagaggacugcgccugagucucagcgaaauaaccgccacgugcacaggagaaguaacaaacgucucugguugcuacuccugcaugaccggagccaaagucagcauaaaacuccacuccagcaaaaacucaacagcacacguacgaugcaaaggagacgaaaccgccuucucagucuuagaaggcguacacucauacacagucucccuaaguuucgaccacgcgguagucgacgagcagugccaacuaaacugcgggggccacgaaucacaaguaacacugaaggggaaucucauauuccucgacgugccaaaauucgucgaugggucuuacaugcaaacuuaccacagcaccguuccaaccggagccaauauaccaagcccgacagacuggcuaaacgcacuauucgggaauggccuuucacgauggauucuaggaguaaucgguguccuauuaggcguccuagcccuauuuuucuugauaaugagccuguucaaacuagggacaaaacaaguauuccgaagccgcaccaagcucgcauaa

SEQ ID NO: 16395 - RNA, 3222 nt, Artificial Sequence
  derived and/or modified CDS sequence (opt11) from SFTSV(JS2013-69)__KR230776.1__GP
augaugaaagugauaugguucuccucacuaauaugcuuugucauccaaugcagcggagacuccggcccaauaaucugcgccggacccauccacagcaacaaaagugccgacaucccccaccuacuaggcuacagcgagaagaucugccaaaucgaccgucuaauccacgucagcagcuggcuuaggaaccacucacaauuccaaggauacguaggccaacgcggaggccgcucgcaaguauccuacuacccugccgaaaacucauacucacgcuggagcggacuacucagcccaugcgacgcggacuggcuagggaugcuggucgucaaaaaggccaaaggauccgacauuaucguaccaggcccuuccuacaaggggaagguauucuuugaaagacccacauuugacggauacgucggauggggauguggaagcggaaagucccgaaccgaaucaggcgaacucugcagcucagacagcggaacgagcuccggacugcucccaagcgaucgaguccuguggauuggcgacguggcgugccagccaaugacaccuauacccgaagaaaccuuccuagaacucaagucuuucucucagucagaguucccggacaucugcaaaauugauggaaucguguucaaccaaugcgaaggagagagccucccccaaccauucgacgucgcauggauggacgucggacacucacacaaaaucaucaugcgcgagcacaagacaaaauggguacaggaauccucuagcaaggacuucgucugcuacaaagaaggcaccggaccgugcucagaaucugaggagaaaacuugcaaaacaucagggucaugccgcggagacaugcaguuuuguaaaguagcaggaugcgaacauggcgaagaagcguccgaagcgaaaugccgcugcucccucgugcacaagccgggggaagugguggucucuuaugggggaaugcggguccgcccaaaaugcuacggcuucucacgaaugauggcaacgcuagaagucaaccagcccgaacagagacuuggccaaugcacuggaugccaccuggagugcaucaacggcggcgugcgccucauuacccucaccucagaacuaaagagcgccaccgucugcgcaucacacuucugcagcuccgcaacgucgggcaaaaagaguaccgaaauacaguuccacagcggaucccuaguuggcaagaccgccauccacguaaagggggcacucguagacggaaccgaguucacacuggaaucuagcugcauguucccagacggcugcgacgccguagacugcacguucugccgagaguuccugaagaacccacaaugcuauccggcgaagaaauggcuauucaucauaauagucauccuccucggguacgcagggcucaugcuacuaacaaacgugcugaaagccauugguauauggggcucguggguaaucgcccccgucaaauuaauguucgcuaucaucaagaagcuaaugaggacagucagcugccucaugcgcaaacucauggacagaggccgccaagucauccacgaagaaauaggagaaaaccgagaagguaaccaagaugacguccgcaucgaaauggcgagacccagacgaguccgccacuggauguacucacccguaauccugaccauccuugcgauaggccucgccgaaagcugcgacgaaaugguccacgcggacagcaaacuggucagcugcagacaaggcucagguaauaugaaagagugcguuaccacaggaagggcauugcuaccagcugucaaucccggacaagaggccugccuacacuuuacggccccggggagccccgacaguaaaugccuaaagauaaagguuaaacgcauaaaccuaaaaugcaaaaagucauccuccuauuucgugccggacgcucgaucacgcugcacaucagugaggagaugccgaugggcuggugacugccaaucaggauguccaccgcacuucacuucaaacagcuucucagacgacugggcgggaaaaauggauagagccggucuuggauucucaggcugcagcgacgggugcggaggcgcagcaugcggaugcuucaacgcggccccauccugcauauucuggaggaaguggguagaaaauccccacggcaucaucuggaaaguauccccaugcgcggcgugggugccauccgccgugauagaacucaccaugcccucaggcgaagucaggacauuccacccgaugucaggaaucccaacccaagucuucaaagggguaagcguaacauaccuaggauccgauauggagguaagcggacucacagaccugugcgagaucgaagaacucaaaagcaagaaacucgcccucgcaccgugcaaccaagccggaaugggcgucgucggcaaaguaggcgaaauacagugcuccucagaagaguccgcacgcacuauaaagaaagacggcugcauauggaacgccgaccucguaggaauagaacucagagucgacgacgccguaugcuauagcaaaauaaccagcguagaagcagucgccaacuacagcgcgaucccaacaacaauugguggacugagauucgagcgaucucacgacucacaaggaaaaaucagugggucaccauuagacaucacugcaauacguggcagcuucagcguaaacuacagaggacucaggcuaucccucagcgaaauaacagcgacaugcacaggcgaggugaccaacguguccgggugcuacagcugcaugaccggcgcgaaaguauccaucaaacuucacagcagcaaaaacuccacggcacacgucaggugcaaaggugacgaaaccgcauucucggugcucgaaggcgugcacucuuacacagugucccugagcuuugaccacgccguagucgacgaacagugucaacuaaacugcggaggacacgaaagccaagucacauuaaaaggcaaccucauauuccuagacguaccaaaauucguagacggcuccuacaugcaaacguaccacuccuccguccccacaggggcaaacaucccaucaccuaccgacuggcugaaugcacucuucggaaacggacugucgcgcuggauacuaggcgucaucgggguacuccucggaguccuggcccucuucuucuuaauaaugucccucuucaaauuaggaaccaaacaaguuuuccgcucacgaaccaaacuagccuga

SEQ ID NO: 16396 - RNA, 3222 nt, Artificial Sequence
  derived and/or modified CDS sequence (opt11) from SFTSV(JS2013-71)__KR230777.1__GP
augaugaaagucauaugguucagcucgcugaucugcuuuguaauacaaugcggcggagacacagggccaauaauaugcgcgggacccauacauucuaacaaaucagcagacauaccacacuuacugggauauagcgagaaaaucugccaaaucgaccgccugauccacgucagcucguggcuaagaaaucacucgcaauuccaagguuacgucggccaacgagggggucgaagucaagucucguacuacccagccgaaaacuccuacagucgauggagcggccuauuaaguccaugcgacgcugacuggcuagggaugcuaguaguaaagaaagccaaaggcucagacaugauaguaccgggccccucauacaaggguaaggucuucuucgaacggccgacguuugacggauacguaggauggggaugcggcucgggaaaaucacguacagaaucgggggaacucugcagcucggacagcggcaccucaagcgggcuacuaccgagcgaccgaguccucuggauaggcgacguagcaugccaacccaugacacccauaccggaagaaacauuucuagaacucaaaucauucucacaaagcgaguucccggacauauguaaaauugacggaauaguauuuaaucagugugaaggggaaucacucccacaaccauucgaugucgcauggauggacguggggcacagccacaaaaucauaaugagggagcacaagacaaaauggguccaagaaucuagcaguaaggacuucguauguuacaaagaaggcacgggcccauguuccgaauccgaagagaaaaccugcaaaaccagcggcagcugcagaggcgauaugcaauucugcaaaguagccgggugcgaacacggcgaagaagccucagaagcaaagugcagaugcagccucguacacaagccgggugagguaguggucagcuacggaggcaugcgaguacgaccgaagugcuacggauucagucggaugauggcgacccuggaagugaaccagccugagcagaggauaggacaaugcacagggugccaccucgaaugcauaaacgggggcguacgacuaaucacccuaacgagcgaacucaaauccgcgaccguaugcgcaucgcacuuuugcagcagcgcaacaagcggcaagaaaagcaccgaaauccaauuucacucaggcucccucguagguaaaacagcaauucaugucaaaggagcccuagucgacggcacagaauuuacauuugagggauccugcauguucccagacggaugcgacgcaguggacuguacuuucugcagggaguuccucaaaaacccccaguguuacccagccaagaaauggcuauucauaauaauagucauacuauuggguuaugccggccucaugcuccuaacaaacguacucaaagcaauaggcguguggggaagcugggucauagcgccagucaagcuagucuuugcgauaaucaagaaacucaugagagcaguaagcugucuaaugggaaaacuaauggaucguggacgacaagucauacacgaagaaauaggagaaaacagagaagguaaccaagacgacguucgaaucgagauggcccgcccgcggaggguaagacacuggauguacagccccgucauccucaccauacucgccaucggccuugcugagggaugcgacgaaaugguacaugcugacuccaaacucguuagcugcaggcaagggagcggcaacaugaaagagugcgugacaacuggacgcgcccugcucccggcaguaaacccaggacaagaggccugccuccacuucaccgcaccgggaagcccagacaguaaaugccugaaaauaaaagucaaacgaauaaaccuaaaaugcaaaaagagcuccuccuacuucguccccgacgcccgauccagaugcacaagcgugcgcagaugcagaugggccggcgacugccaaagcggaugcccgccccacuucacgucaaacagcuuuucagaugacugggccggaaaaauggacagagccggccuaggauucagcggaugcagcgacggcugcgggggagcggcaugcggaugcuucaacgccgcaccaagcugcaucuucuggcgcaaauggguggaaaacccccacggaaucaucuggaaagucucaccgugcgcagcaugggugcccagugccgugaucgaacucacaaugccguccggggaagucagaaccuuccacccaaugagcgggauuccaacccaagucuucaaaggcguuagcguaacuuaccucgggucggacauggaagugagcggccucaccgacuugugcgaaaucgaagaacuaaaaagcaagaaacucgcccucgcacccugcaaccaagcagggaugggggugguaggcaaagucggagagauccaaugcaguucagaagaaagcgcgagaacaaucaagaaagauggaugcaucuggaacgcggaccucguaggaauagaacuucgagucgacgacgcgguaugcuacaguaaaaucaccucagucgaggccgucgcaaauuacucagcuauaccaaccaccaucggagggcuacgauuugaacggagccacgacagccaagggaaaaucucgggcuccccacuagacauaacagccauccgcggcucauucucgguaaacuauagagggcuacgacugucacuaucagagauaaccgccacaugcaccggggaagucacaaaugucagcggaugcuacaguugcaugacaggcgcuaaagugagcauaaagcuacacucuagcaagaacagcacggcgcacguucgaugcaaaggcgacgaaacagcauuuucgguccucgaagggguacacagcuacucagugucccuguccuucgaccacgccguggucgacgaacaaugccaguuaaacugcggaggccacgaaagccacgucacccuacgaggaaaccucaucuuccuagacgucccaaaauucguggacggcucauacaugcaaacauaccacuccacaguacccacuggcgcaaacaucccgaguccaacugauuggcucaacgcgcuauucggaaacggacugagcagauggauacucggggugauaggaguacuacuaggcggacuagcccuauucuuccuaauaaugagccuauucaagcuagggaccaaacaggucuuccggucacgaacaaaacucgcguag

SEQ ID NO: 16397 - RNA, 3222 nt, Artificial Sequence
  derived and/or modified CDS sequence (opt11) from SFTSV(JS2014-03)__KR230778.1__GP
augaugaagguaaucugguucaguagccucauauacuucgugauccagugcucgggcgacuccggaccuaucauaugcgcaggucccauacacucaaacaaauccgccgacaucccgcaccuccuaggauacuccgaaaagauaugccagaucgaccgacuuauacacguguccuccuggcugcgaaaccacagccaguuccagggcuaugucggccaacgcggcggccgcucucaggugucguacuacccagcagaaaacucguacucacgcugguccggccuacucucaccgugcgacgcagacuggcucggcaugcuggucgucaagaaagccaaaggaagcgacaugaucgucccaggcccaagcuacaagggcaaaguuuucuucgaaagaccaacauucgacggauacgugggcugggggugcggcagcggcaaaucgaggaccgaaagcggagaacuaugcaguagcgauucaggaacaagcagcggccuccugcccucggaccgaguccucuggaucggcgacgucgcgugccaaccaaugacaccgauacccgaagaaaccuuccuugaacucaagaguuuuucccagucggaguucccagacauaugcaagauagacggaauagucuucaaccagugcgagggcgaaucacuaccgcagccauucgacguggccuggauggacguagggcacucccacaagauaaucaugagagaacacaagacgaaauggguccaggaauccucaagcaaagacuucgucugcuacaaagagggaacgggacccugcuccgaaucagaagagaagacaugcaaaacaagcgggagcugcagaggcgauaugcaauucugcaagguagccggaugcgagcacggcgaagaggcaucagaagcuaagugccgaugcucacuggugcacaaacccggggaggucguagucucauacggcgggaugcgaauacgaccaaaaugcuacggauucucccgaaugauggcuacacuggaagucaaccagccagaacaaagaauuggacaguguacaggcugccaccucgaaugcaucaacgggggcguccgccuaaucacacucaccagcgagcuaaaaagcgcaaccguaugcgccucgcacuucugcagcagcgcgacgagcggcaaaaagaguacagagauccaauuccacagcggcagccucguaggcaagaccgcgauccacgucaagggcgcguuggucgacgguaccgaauuuacauucgaaggaaguugcauguucccagacggcugcgacgcgguagacuguaccuucugccgcgaguuccucaaaaacccccaaugcuaccccgcaaagaaauggcuuuucauaaucauaguaauuuugcucggauacgccggccugaugcuacugacaaacguccucaaagccauaggaaucuggggcucaugggucaucgcaccaguaaaacucauguucgccaucaucaaaaagcuaaugcgcacaguuuccugccucaugggcaaacuaauggaccgcgguagacaaguaauccacgaagagauaggagaaaaccgagagggcaaccaagacgacgucagaaucgaaauggccagacccaggagagugagacacuggauguacagccccgucauucuuacauuccucgccauaggccuagcagaauccugcgaugagaugguacacgcugacagcaagcuagucucaugccgccaagggagcggcaacaugaaagagugcguaacgaccggaagggcgcuccuuccagcugugaacccaggacaggaagccugcuugcacuucaccgcaccaggcagcccagauucgaaaugccucaagaucaaaguuaagcguaucaaccucaagugcaaaaagagcucaucauacuucguaccagacgcuagaucgagaugcacaagcguaagaagaugccgaugggcgggugauugucaaagugggugcccaccccacuucacauccaacuccuucagcgacgacugggccgggaaaauggaccgugccggucucggauucagcggcugcucagacggguguggcggcgcagcgugcggaugcuucaacgcagcccccuccugcaucuucuggagaaaaugggucgaaaauccccauggaaucauauggaaaguaucacccugcgccgccuggguacccuccgcagucauagagcucacaaugccaaguggcgaggugagaaccuuccacccuaugucaggcauuccaacgcaagucuucaaaggaguaucaguuacguaccucggaagcgauauggaaguaaguggccucacagaccucugcgagaucgaggaacucaaaagcaaaaagcuagcccuagccccauguaaccaggcaggaaugggcguagucggccgagucggagagauacagugcucaagcgaggaauccgcccggacuauaaagaaagacggaugcaucuggaacgcggaccuaguaggaauagaacuccgcguggacgacgcaguaugcuacucgaaaauaaccagcguagaggccguggccaacuacuccgccaucccgacuacuaucggaggacuccgguucgaacgaucacacgacagccaaggaaaaaucucaggaagcccccucgacauaacagcgauaagaggcuccuucucagucaacuaccgcggcuugagacuaucacuaagcgaaauaacggccacgugcaccggggaaguaaccaacguaagcggcugcuauaguugcaugacaggagccaaagucuccauaaaacuacauaguuccaaaaacucaaccgcacacguaagaugcaaaggagacgagacagcguuuucgguacuggaaggcguccacuccuauaccgucucauuauccuucgaccacgcugucgucgacgaacaaugccaacuaaacugcggcggccacgagucacaagucacacuuaagggcaaucucauuuuccuagacgucccaaaauucgucgacggcuccuacaugcaaacauaccacagcaccguaccuaccggagccaacauaccauccccaacggacuggcucaacgcacucuucggaaacggacucucacgcuggauacucggagucauaggcguacugcuagggggacucgcucucuucuuuaugaucaugucccuauucaaacuggggaccaagcaaguuuuccggucucggaccaaacucgcguag

SEQ ID NO: 16398 - RNA, 3222 nt, Artificial Sequence
  derived and/or modified CDS sequence (opt11) from SFTSV(JS2014-16)__KR230780.1__GP
augaugaaaguuaucugguucagcucgcuaaucugccucgugauacaaugcuccggagacaccggaccaaucauaugcgcgggcccaauccacuccaacaaaucagcaaacauaccacacuugcucgguuacucugagaagaucugccagauagacagacuuauccacguauccucauggcuccgaaaccacucccaauuccaaggcuauguaggccagcgcggcggccggucccaggucucauacuacccagcggaaaacagcuauucccgauggucaggacugcucucgccaugcgacgcagacuggcuuggaaugcuaguagugaaaaaggccaaaggaucggacaugauaguacccgggcccucauacaaaggcaaagucuuuuucgaacgcccgacuuuugacggcuacguaggcuggggcugcggguccgguaagagcaggaccgaaagcggagaacugugcagcagugacagcgggacuucuagcggacuauuacccagcgaccgaguccuguggauaggcgacgucgcaugucaacccaugacaccaauacccgaagagaccuuccucgagcugaaaucuuuuagccaaagcgaguucccagacauaugcaaagucgauggaaucguguuuaaccagugcgacagugaaucccuuccacagccaauagacguagcguggauggacgucgggcacucccacaagauuauaaugcgagaacacaaaacgaaauggguucaggaaagcucaucaaaggacuucguaugcuacaaggaaggaacaggaccuugcagcgaaucggaagagaaaacgugcaaaaccuccggcucgugucguggcgacaugcaauucugcaaaguugcaggaugcgagcacggagaagaggcgucggaagcgaaaugccgcugcucccugguccacaaaccaggcgaaguagucgucucguacggcggcaugcgaguacgcccgaaaugcuacgguuucucacgcaugauggcgaccuuagaaguuaacccacccgagcaaagaauaggccaaugcacaggcugccaucucgaaugcauaaacggcggagugcgccuaaucacgcucacaucagaacuuaaaagcgccacagugugcgcgagucacuucugcucaagugccacgagcgggaagaaaagcaccgaaauacaauuccacucaggaagucuaguagguaaagccgcaauccaugucaaaggagcauuaguggacgggaccgaguucacuuucgaaggcucaugcauguucccagacggcugcgaugccguggacuguaccuucugcagagaguucuuaaagaacccgcaguguuacccagcuaagaaauggcuauuuauaauaauaguaauacugcuggguuacgcaggccucaugcuacuaaccaacguccucaaagccaucggcguguggggaaguuggguaauggccccaguaaaacuuauguuugccaucaucaagaaacugaugcgaucagucucgugcaugauggggaaacuaauggaccgcggcaggcaagugauccacgaggagauaggcgaaaaccgugagggcaaccaagaugacgucagaauagagauggcgcgcccccgaaggguccggcacuggauguacagcccggucauacucaccauucuagccauaggccuagccgaaggcugcgaugaaaugguucacgcagacucaaaacucgugcugugcagacaagggagcggaaacaugaaagagugcguaaccacaggacgagcacuucucccagccguaaacccaggacaagaagcaugcuuacacuucaccgccccagguucaccagacucgaaaugccucaaaaucaaagucaaacgaauaaaccucaaaugcaagaaaagcucaagcuacuucguacccgacgcccgaucuagaugcacaucaguccgaagauguaggugggccggcgauugccagaguggaugccccagucacuucacauccaacagcuucagcgacgacugggcaggaaaaauggaccgcgcugggcucggauucucaggcugcagcgacggcugcggaggggccgccugcggaugcuuuaacgcugccccgagcugcaucuucuggcgaaaaugggucgagaacccacacggaaucauauggaaaguaucacccugcgccgccuggguucccagcgcgguaaucgaacucacgaugccaagcggggaaguucggaccuuccaccccaugaguggaaucccaacacaggucuucaaaggagucucaguaacguaucugggcuccgacauggaagugagcggacuuacagaccuaugcgagauagaagaacuaaaaagcaagaaauuagcucucgcaccgugcaaccaagcgggaaugggagucguaggaaaaguaggagaaauacaaugcagcucggaagagagcgcucgaacgaucaagaaagacggaugcauauggaacgccgaucucgucggcaucgaacuaaggguagacgacgcagucuguuacuccaaaauuacaucaguggaggcaguagcaaacuacucggccaucccaacaacuaucggaggacuacgauucgaacgaucgcacgacucccaaggaaaaauauccggaucaccucuagacauaacagcuaucagggggucguucagcguuaacuacaggggccugcggcuguccuugagcgaaauaaccgccacaugcaccggggagguaaccaacguaucggggugcuacagcugcaugaccggcgccaaagucagcaucaaacugcauucguccaaaaacagcacagcacacgugcgcugccgaggggacgagaccgccuucucuguccucgaaggaguacacagcuauaccguaucccugagcuucgaccacgccguaguagacgaacaaugccaauuaaacugcggaggacacgaaagccaagugacacucaaaggcaaccugaucuuccuagacgucccaaaauucgucgauggcucuuacaugcaaacguaccacagcucgguaccgaccggggcaaacaucccgaguccaaccgacugguugaacgcacucuuuggcaauggccugagccgguggauacuaggcguuaucggcguucuacucggaguccucgcgcuguuuuucuuaauaaugagccuauuuaaacuggggaccaaacaaguauuccguucuagaaccaaacucgccuaa

SEQ ID NO: 16399 - RNA, 3222 nt, Artificial Sequence
  derived and/or modified CDS sequence (opt11) from SFTSV(JS2014-18)__KR230781.1__GP
augaugaaggucauaugguucagcucacucauaugcuuaguaauccaaugcggaggggauacgggaccgaucaucugcgcggggccaauacauagcaacaaauccgcggacaucccacaccuccuaggcuacucagagaaaaucugucaaaucgaccgacucauacacguaagcucguggcugcgaaaucacucgcaauuccaaggguacguaggccagagagggggccggagucagguaucguacuaccccgccgaaaacagcuacaguagguggucgggccuacuaucgccaugcgacgcggacuggcucggcaugcuagucguuaagaaagccaaaggcucagacaugauaguucccggcccgucauacaaaggcaaaguauuuuucgaacguccaaccuucgacggcuacguaggcuggggcugcggcuccggcaaaagccgcacagaaagcggggaacucugcucuagcgauagcggaacaucgagcgggcuacugccgagugacaggguccuguggauaggcgacgucgcuugucagcccaccacgcccaucccagaagagacauuccuagaacuaaagagcuuuagccagagcgaguucccggacgucugcaaaauagacggaaucgucuuuaaccagugcgaaggcgaaucccuaccccagccauuugacguggccuggauggauguggggcacucccacaagauaaucaugcgggagcacaaaacgaaauggguucaagaaucgagcagcaaagauuucguaugcuacaaagaagggacaggucccugcagcgaaucugaagagaaaacaugcaagacgagcggaagcugcagaggcgacaugcaauucugcaaagucgcaggcugcgagcacggagaggaggcgucggaagcaaaaugccgcugcucccuaguacauaagccaggcgagguuguagucagcuacggaggcaugcgugucagaccaaaaugcuacggcuucucacgcaugauggccacguuggaagugaacccaccggagcaaagaauagggcagugcaccgggugccaccucgagugcauaaacggcggggugcgccuaaucacgcucacuagcgaacuaaaaagcgcgacagugugcgcaagucacuucugcagcucggccacgucagggaaaaagaguacggaaauacaauuucacucagggucgcuuguuggcaaaaccgcgauacaugucaaaggcgcccuaguagacggaacagaguucaccuucgaaggaucaugcauguuuccagacggcugcgaugcagucgacugcaccuucugccgcgaguuccucaagaacccacaauguuaccccgccaagaaguggcuauucaucauaauaguaaucuuacuaggcuacgccggccuaaugcugcucacaaacguacuaaaagcaauaggcgucuggggaagcugggucauagcccccguuaaauuaguauucgcuaucauaaagaaacugaugcgggcagucucgugucuaaugggaaaacugauggaccgcgggcggcaagucauccacgaagaaauaggcgaaaaccgcgaaggcaaccaagacgacguaaggauagagauggcacgcccaagacgcguucggcacuggauguauagcccggucauacuuacaauccuggcaauaggcuuggccgagggcugcgacgagauggugcacgccgacucaaaacucgucucguguaggcagggcagcggaaacaugaaagagugcguaaccacgggaagggcccugcucccugccgucaaccccggccaagaagcgugccuacacuuuaccgcgccagggagcccagacucaaaaugccucaaaaucaaaguaaaaagaaucaacuuaaaaugcaaaaagucuagcuccuacuucguacccgacgcaaggagccgaugcacgagcguacgccgcugccgaugggcgggagacugccaaagcggcugcccaccccacuuuacgucaaauaguuucagcgacgacugggccgggaaaauggacagggcaggccuaggcuucagcggcugcagugacggcugcggcggggccgcaugcggauguuuuaacgcggcaccgagcugcaucuucuggaggaaaugggucgagaacccacacgggaucaucuggaaagugucacccugugccgcaugggucccaucagccgugaucgagcucacaaugccaagcggggaaguuagaacauuucaccccaugagcgguaucccuacccagguauucaagggggucuccguaacauaccuuggcagugacauggaagugagcgggcucacagaccucugcgaaaucgaagaacugaaaagcaaaaagcuagcacucgcgccaugcaaucaagccgggauggggguggucgguaaagucggagaaauccaaugcagcucggaagagagcgcccgcacaaucaagaaagacggcugcaucuggaacgcggaccuaguaggaauagaguugcgcgucgacgacgccguauguuacuccaaaauaaccuccgucgaagccguggcaaauuacucagccaucccuacgaccaucggagggcucagguucgaacgcucgcacgauagccaggggaagaucuccgggucuccccuggacauaaccgcaaucaggggcucuuucucggucaauuauagaggacucagacugagcuugagcgaaauaacagcgaccugcacgggcgagguaacgaacgugagcgggugcuacucaugcaugacgggugccaaagucuccauaaaacuacauucaaguaaaaacucgaccgcacaugucagaugcaaaggcgacgaaaccgcauucucgguccuggaaggcguucacucauacuccgugagccucagcuucgaccacgccguuguagacgaacagugccaacuaaacugcggcggacacgaaucacaaguaacccugcguggcaaccuaaucuuccuugacguccccaaauuugucgauggaucguacaugcaaacauaccacagcaccguaccaaccggagccaacaucccaaguccgaccgacuggcuaaacgcacuauucggcaacggacugagucgguggauccuaggggucauaggcguauuacugggaggcuuagcacuauucuucuugaucaugucccuauucaagcucggcaccaaacaaguauuccgcucuagaacgaaacuagcguga

SEQ ID NO: 16400 - RNA, 3222 nt, Artificial Sequence
  derived and/or modified CDS sequence (opt11) from SFTSV(JS2014-31)__KR230782.1__GP
augaugaagguaaucugguucagcucccugauaugcuucgucauacaaugcucgggcgacucaggacccaucauuugcgcgggacccauacacucgaacaaauccgcagacaucccacaccuccuaggcuacucagagaaaauaugccaaauagacagacuaauccacgugaguucguggcuacgaaaccacagucaauuccaaggauaugucggucaacgaggaggacgcucacaaguauccuacuauccggccgaaaacucauacucacgaugguccggacuguuaucgcccugcgacgcagacuggcuaggcaugcuagucgucaagaaggcaaaggguucagacaugauaguaccuggacccaguuacaaagguaaggucuucuucgagcgccccaccuuugacggguacguaggcuggggcugcggaucaggaaagaguagaacagaaagcggagagcucuguagcuccgauucaggaaccaguagcggacuccugccauccgaccgcguacuguggaucggagacgucgcaugccaacccaugaccccgauccccgaggagacauuuuuagaacucaaaucauucucccaaagcgaguucccagacaucugcaaaaucgacggcauagucuucaaccagugugaaggcgaaucucuaccccagccauucgacgucgcauggauggacgugggccacucccacaaaauaaucaugagggaacacaaaacaaaguggguccaggaauccagcucaaaggacuucguaugcuacaaagaaggcacaggacccugcuccgaaucagaagagaaaacgugcaagaccagcggcucaugcagaggagacaugcaguucugcaaaguagccgggugugaacacggcgaagaggcauccgaagcaaagugcagaugcucacugguccacaaaccuggcgagguaguaguauccuacggagggaugagaauccgcccaaaaugcuacggguucucccgaaugauggcaacacuagagguaaaccaaccggagcaaagacuagggcagugcacagggugccaccucgaaugcauaaacgguggagugcgccugauaacccuaaccucugaacucaagagcgcgacaguaugcgccagccacuuuugcaguucagccacaagcggaaagaaaagcacugaaauacaauuucacuccggaucgcuagucggaaaaaccgccauacacgucaaaggagcgcuaguagacgguaccgaguucacguuugaaggaucaugcauguucccagacggaugugaugcggucgacuguaccuuuugucgcgaguuccucaaaaacccccaauguuacccagccaagaaauggcuguucaucaucauagucauccucuuaggauacgccggccucaugcuccucacgaacguucuaaaagcaaucggaaucuggggcagcugggucauagccccagucaaacuaauguucgcgauaauaaagaaacugaugagaacagucagcugcuuaaugcggaaauugauggacagaggccgccaggucauccacgaggaaauuggcgaaaaccgagagggcaaccaagacgacguacgaaucgagauggcucggccacgacgaguacgacacuggauguacagcccggucauacucaccauccuggccaucggucuggcagaaagcugcgacgaaaugguacacgcagacucaaaacucgucucgugccgacaaggguccggaaacaugaaagaaugcguaacaacaggcagggcccuacuacccgcgguaaauccaggccaagaagcaugcuuacacuucacagcacccggauccccugacucaaaaugccuaaaaauaaaggucaaacgaauaaaccucaaaugcaaaaaguccucaagcuacuucgugcccgacgcccgcucaagaugcaccagcgugcgaagaugccgcugggcgggcgacugccaaagcggaugcccaccccauuucacauccaacucauucucggacgacugggcaggcaagauggacagagccggccuuggguucagugggugcagugacggcuguggaggcgcagcuugcggaugcuucaaugccgccccaagcugcauauucuggcgcaaaugggucgagaacccacacggcaucaucuggaagguaucccccugugcagcaugggucccaucagcaguaauugaacuaacaaugcccaguggcgagguacgcacauuccaccccaugagcggaaucccaacccaaguauucaaagggguaucagugaccuacuuaggaucggacauggaagugagcggacucacagacuuaugcgaaauagaagaauugaaaucgaagaagcuagccuuagcgccguguaaccaagcaggaaugggggucguaggcaaggucggagaaauccaauguucaucagaggagagcgcacgaacaaucaaaaaggacggcugcauauggaacgcagaccuagucgggauagagcuucgcguagacgacgccguaugcuacaguaaaaucacaucagucgaagccguagcaaacuacucagcgauaccuacaacuauaggcgggcuacgcuuugaacgcagccacgacucccaagguaagaucuccgggagcccacuagacauaaccgcgauucggggaucauucucggucaacuaccgaggacuccgacucucccuuucagaaaucaccgccacaugcaccggagaagucaccaacguauccggaugcuauagcuguaugacaggagccaaaguauccaucaaacuccacucauccaaaaacuccacagcgcauguaaggugcaagggggaugagacagcauucucgguacuugaggggguacacagcuacaccgucucccugucauucgaccaugccguggucgacgaacagugccaacuaaauugcggagggcacgagucucaaguaacccucaaagggaaccugaucuuccuagacguccccaaauucgucgacgguucauacaugcaaaccuaccacagcacgguaccgacaggagcaaacaucccaagccccacggauuggcuuaacgcgcuauucggcaacggcuugagccgcuggauccucggaguaauuggcguccuacuagggguacucgcccucuucuuccucauuaugucacuguucaaacucgggacuaaacaaguauuccguagccgcacaaagcuagcauga

SEQ ID NO: 16401 - RNA, 3222 nt, Artificial Sequence
  derived and/or modified CDS sequence (opt11) from SFTSV(JS2014-33)__KR230783.1__GP
augaugaaagugaucugguucuccagccucaucugcuucguaauccagugcagcggcgauuccggcccgaucauaugcgccggcccgauacacaguaacaaaucggcagacaucccgcaccuccucggauacuccgaaaagaucugucaaauagaccgacugauccacguguccuccugguuacggaaccacucacaauuccagggcuacgucggacaaagagggggcaggagccaaguaagcuacuauccugcggaaaacagcuacagcagauggucgggucuacucucaccaugugacgcagacuggcuaggaaugcucgucguaaagaaagcaaaagggucggacaugaucguaccgggacccucauacaaaggcaaaguauucuuugaaaggccgaccuuugacggguaugugggauggggcugcggaucuggaaagagccgcacagaaagcggagaacuguguagcucugacucgggaacaucuucaggacuacucccaagcgacaggguacucuggauuggagacguagccugccaacccaugaccccaauaccagaggagaccuuuuuggagcucaagagcuucucacagagcgaguucccagacauaugcaaaaucgauggcauaguguuuaaccaaugugaaggcgagagccuuccucaaccguuugauguagccuggauggacgucggccacucacauaaaauaauaaugcgggaacacaaaaccaaauggguccaagaaucauccagcaaagacuuugugugcuauaaagagggaacaggaccaugcucagaaucagaggagaaaaccugcaagaccucaggcucauguaggggcgauaugcaauucugcaaagucgccggaugcgaacacggggaagaggcuuccgaagcaaaaugcagaugcucacucguacacaaacccggcgaagucguaguaagcuacggaggcaugcggguacguccaaaaugcuauggcuucucacgcaugauggccacccuugaagucaaccaaccugaacaacguauugggcagugcaccggcugucaucuggaaugcauuaacggaggaguccgccuuaucacgcuaacauccgaauuaaaaagugccaccguaugcgcgagccacuuuugcuccucagcgacaagcgggaagaaaaguacagaaauacaauuccacucggguucgcucguuggaaaaacagcgauacacguaaaaggagcacucgucgacggaaccgaguucaccuucgagggcaacugcauguuuccagacggcugugaugccguagacuguacauucugcagggaauuucugaaaaacccgcaguguuaccccgccaagaaauggcuauucaucauaaucguaauccuacuaggauacgcaggguugaugcugcuaacaaacguacuaaaagccauaggcauauggggaagcugggucaucgccccaguaaaacucauauucgcaauuaucaagaaacucaugcgggcagucggcugccuaaugggaaaacuaauggacagagguagacaaguaauucacgaggaaauaggcgagaaccgcgaagggaaccaagaugacgucagaaucgaaauggcaagaccgcggcgaguccgacacuggauguacuccccagucauacuaacaauccuggccaucgggcucgccgagagcugugacgaaaugguacacgcggacagcaagcuaguaucuugccgacaaggcggagggaacaugaaagaauguguaacgacagggcgugcccugcucccagcaguaaauccgggccaagaagcaugccuccacuucaccgcccccggaaguccggacagcaaaugccuaaaaaucaaaguaaaacggaucaaccugaaaugcaaaaagagcuccuccuacuucgugcccgaugccaggagccguugcacgagcguccgcagaugcagaugggcaggagacugccagagcggaugcccgccccauuucacgagcaacagcuucagcgaugauugggcagggaaaauggaccgggccggcuugggguucucgggcugcagcgacgguugcggcggagccgcaugcgggugcuucaacgcagccccaucaugcauauucuggcggaaaugggucgaaaacccacacggcaucaucuggaagguauccccaugcgcagcaugggugcccagcgcaguaaucgaacugacgaugccaucaggcgaagugcgcacauuccaccccauguccggaauccccacucaagucuucaaaggagucucaguaaccuaccuaggcucagacauggaaguguccggucucacugaccuaugcgaaaucgaggaacucaagagcaagaaacucgcccucgcacccugcaaucaagcaggcaugggcgucguaggcaaagucggggaaauacaaugcagcagugaggagagcgccaggacaauaaagaaggacggaugcaucuggaacgccgacuuggugggaaucgaacuaagagucgacgacgcagucugcuacucgaaaauaaccagcguagaagcaguggccaacuacucagcgauacccacaacaaucggcggucugcgauucgaacgaagccacgacagccaaggaaaaauaagcggcucgccccucgacauaacggcgauacgcgggagcuucagugucaacuacagaggccugcguuuaagccugucagaaauaacagcaaccuguaccggggaaguaacgaauguaagcggaugcuacuccugcaugacaggagcaaaggugucgaucaaacuccacucaagcaagaacaguacagcgcacguacgaugcaaaggcgacgagaccgccuucagcguccuagaagggguacacagcuacacaguaagccuaaguuuugaccacgccgucguagacgagcaaugccaacuaaacugcgggggccacgaaagccaggugacguugaaaggaaaccugauauuccuggacgugccgaaguucgucgauggcagcuauaugcaaacauaccacagcgccgucccgaccggcgcaaacauccccagccccacggacuggcucaacgcacuguuuggcaacggccugagccgauggauucucggcgucauagguguguuacucgggggccuagcacuuuucuucaugaucaugagccuguucaaacucggcacaaaacaagccuucagauccagaaccaaacuagcuuaa

SEQ ID NO: 16402 - RNA, 3222 nt, Artificial Sequence
  derived and/or modified CDS sequence (opt11) from SFTSV(JS2014-39)__KR230784.1__GP
augaugaaagucauaugguuuagcuccuuaaccugcuucguaauacaaugcagcggcgacucaggccccaucauuugcgcaggcccaauccacaguaauaaaucagccgacaucccacaccuccucggcuacucagagaagauaugccaaaucgacagacucauacacguaagcuccuggcuccgcaaucacagccaauuccaaggauacguaggccagaggggaggacgaucacaagucaguuacuacccggcagaaaacuccuauagccgauggucaggccugcuaucgccaugcgacgcagacugguugggaaugcucgugguuaagaaagcaaaaggaucagacaugaucgugccugggccaucauacaaaggcaaagucuucuucgaacgcccgaccuucgacggguacgugggauggggcugcggaucgggaaagagucgaacagagucaggcgaacuuugcaguuccgacagcgggacgucaagcgggcuccuucccucggacagaguccucuggauaggagacguagcaugccagcccaugacgccgaucccggaagaaaccuuccucgaacugaaauccuucagccaaagcgaguucccggacaucugcaagaucgacggcaucgucuucaaccaaugcgaaggagagucacugccgcagcccuucgacguagcauggauggacgucgggcauucccauaagaucauuaugcgagaacacaaaacaaaauggguacaagaaucaagcucaaaggacuucguuugcuacaaagaaggcacaggcccguguuccgagucggaggagaaaaccuguaaaacgagcggcucuugccgaggcgacaugcaauucugcaaaguggccggaugugaacacggcgaggaaaccagugaagcaaaaugccgcugcagccugguacauaaaccaggcgaagucgucguauccuauggcggaaugcgaauacgcccaaaaugcuacggcuucucacgaaugauggccacccuagaaguaaaccaaccagagcaacgacucggacaaugcacggggugccaccuggagugcauaaaugggggcgugcgcuugauaacucugaccagugaacucaaaagcgcgaccguaugcgcaagucacuucugcucaucagccaccaguggaaagaaauccacggaaauacaauuccacuccggcagccuagucggcaagaccgcaauccacguaaagggagcgcuaguggacggaacugaguucaccuucgaaggcuccugcauguucccagacggcugcgacgcagucgauugcaccuucugccgggaguuccucaaaaacccgcaaugcuaccccgcaaagaaauggcuuuuuaucaucauaguaauccuauuaggguaugcaggccucaugcuccuaacgaacgucuuaaaagcaaucggaauauggggauccuggguaaucgcaccagucaaacuuauguucgcuaucaucaagaaacuaaugcgaaccguaucaugccugaugaggaaacucauggaccgcggcagacaagugauucacgaagaaauaggagaaaaccgagaaggaaaccaagacgacguaagaaucgaaauggcgcgcccacgacgaguacgacacuggauguacagcccgguaauacugacaauacuagcaauagggcucgcagaaagcugugacgagaugguacacgcggauagcaaacucgucucaugucgccaaggaagcggaaacaugaaagaaugcguaaccacaggcagagcucuacucccagccgugaauccgggacaagaagcaugccuccacuucacggccccaggcagccccgacagcaaaugccucaaaaucaaaguaaaacgcauaaaccugaaaugcaagaagucgagcucauacuucgugccagacgccagaagccgcugcacauccguacgacggugccgcugggcgggcgauugccaaucgggaugcccaccccacuucacaaguaacagcuucagcgacgacugggccggcaaaauggacagagcuggccuuggcuucagcggcugcuccgauggcugcggaggggccgcuugcggcugcuucaacgcagcacccagcuguauauucuggaggaaaugggucgaaaacccccacggaauaaucuggaaagucucaccuugcgccgccuggguuccgucagccguaaucgagcugaccaugccgucaggagaggugcgcaccuuucaccccauguccgggauaccgacacaagucuucaaaggggucagcguaacauaccucggcagcgacauggaaguuucaggacucacagaccuuugcgagauagaggaacucaaaucaaagaaacucgcacucgccccauguaaccaggcuggaaugggggucgucggcaaaguaggcgagauacaaugcucaucagaagaaagcgcccgcacaaucaagaaagacggcugcaucuggaacgcagaccuaguggggauagagcuacgcguggacgaugcggucugcuacagcaaaauaacaucggucgaagccguagccaacuauagcgccauccccaccacaauaggagggcuccgcuucgagcgaagccacgacucccagggaaaaaucagcggaagcccacucgacaucagugcaauaaggggauccuucagcguaaauuaccggggccuccgccucucccugagcgaaaucacagccacaugcaccggggaggucaccaacgucagugggugcuacagcugcaugacaggagcaaaaguaagcauaaaauuacacuccaguaaaaacucgacagcacacguacgaugcaaaggagaugagaccgccuucagcguccuagaggguguccacucuuacaucgugagccugagcuucgaccacgcgguagucgacgagcaaugccagcucaacugcggcggacaugaaucccaagugacacuaaaaggcaaucuaauauuucucgacgugccgaaguucgucgacggaucuuacaugcaaacauaccacuccacggucccaacgggagcaaacauaccaagccccacugacuggcuaaacgcacuguucgguaacggccugagucgguggauacucggcguaauaggcgugcuacugggcggucuggcacucuucagcaugaucaugagucucuucaaacuggguaccaaacaaguguuccggagcagaacaaaacucgcauga

SEQ ID NO: 16403 - RNA, 3222 nt, Artificial Sequence
  derived and/or modified CDS sequence (opt11) from SFTSV(JS2014-H.longicornis-02)__KR230786.1__GP
augaugaaaguuauaugguucucuuccuugauaugcuucgucauccaaugcucaggagacucgggacccauaauaugugcaggaccaauccacucaaacaaaagcgccgacauaccucaccuccuagguuacagcgaaaagaucugccaaauagacagacuuauacacgugaguagcuggcuccgcaaccacagucaguuccaaggauauguagggcaaagaggaggacgcagccaaguaucguacuaccccgcugagaauaguuacaguagguggagcggccuacuaagccccugcgacgcggacuggcucgguaugcuaguugucaagaaagcaaaagguuccgacaugauaguccccggacccagcuacaagggaaaagucuucuucgaaagaccgacauucgauggguauguaggauggggcugcgggagcgguaagucaaggacagagagcggggaacucugcucgagcgacuccggaaccucaucagggcuacuaccgucagaccgcguacuauggauaggcgauguagccugccagccaaugacacccaucccaguggaagcauuucucgaauugaaaucauucagccaaagcgaguucccagacauaugcaaaaucgacgggaucgucuuuaaccaaugcgaaggcgagucccuuccgcagcccuucgacgucgcuuggauggacgugggacacucacacaagauuauaaugagagaacacaaaacaaaauggguccaagaaucgagcucuaaggacuucgucugcuacaaagaaggcacagggcccugcccggaaucagaagagaaaacgugcaagacguccgguuccugccggggcgauaugcaauucugcaaaguggccggcugcgaacacggcgaagaggcaucugaagcgaaaugcagauguagccugguccacaaacccggagaagucgucgucucauaugguggaaugcgcauacgcccgaaaugcuacggauuuagccgaaugauggccacccucgaagugaaccagccagaacagcgucuaggccaaugcacaggcugccaccucgaaugcaucaacggagggguccgccuaauaacgcucacguccgaacuaaaaucggccaccgucugcgcaagccacuucugcagcuccgccacgagugguaagaaguccacagaaauccaguuccacagcggaagccucguaggcaagacagcgauacacguaaaaggcgcccuuguagauggcacagaguucacauucgaaggcucaugcauguuuccagacggaugcgaugcagucgacugcacauucugccgcgaauuucucaaaaacccccaaugcuacccugccaagaaauggcuauucauaaucaucguaauccuacuaggauacgcaggccuaaugcuccuaaccaacguacucaaagccauagggauauggggaagcugggucauagcaccaguaaaacucauguucgccauaaucaagaaacugaugcgcacagucucaugccuaaugagaaaacuaauggaccgcggacgccaagucauccacgaagaaaucggcgaaaaccgagagggcaaccaggacgacguaagaaucgagauggcaagaccacgaaggguaaggcacuggauguacucccccgugauccucacgauccuggcaaucgggcucgcugagagcugcgacgaaaugguacacgcagacuccaaacuggucucgugccgacagggaagcgggaacaugaaggaaugcgugacaacggguagagcacuccugccggcgguaaaccccggccaagaagcgugccuacacuuuacggccccaggcagcccggacagcaaaugccuaaaaaucaaaguuaagcggauaaaccugaagugcaagaaaagcucaagcuacuucguccccgacgcacggagcagaugcacuagcguaagacgcugcagaugggcaggggacugccaauccggcugucccccacacuucacguccaacagcuucagugacgacugggcaggaaagauggaccgggccggacuaggauucuccggcugcagcgacggaugcggcggcgcagccugcggcugcuuuaacgcagcaccgaguuguauauucuggcgaaaaugggucgaaaacccgcacggaaucaucuggaaaguaucaccuugcgccgcaugggucccgucggccguaaucgaacucaccaugcccagcggagaaguacgcaccuuccacccaaugucaggaauaccaacacaagucuucaaaggugucagcguaaccuaucucggcagcgacauggaagucagcggacugaccgaccugugcgaaaucgaagaauuaaaaagcaaaaagcucgcacuggcccccugcaaccaagcaggaaugggcgucguaggcaaggucggagaaauccaaugcuccagcgaggagagcgcacggacaauaaagaaagacggaugcaucuggaacgccgacuugguaggcauagagcuaagagucgacgaugccgucugcuacucaaaaauuaccucgguagaagccguagccaacuacuccgccauaccaacgaccaucgggggccuaagauucgaacgaagccacgacucacaggggaaaaucagcggcuccccgcuagacaucacugccauucgcgggaguuucagcgucaacuacaggggcuugagacugucccuuagcgaaauaacagcuaccugcacaggagaagucacaaacguaaguggaugcuauuccugcaugacaggggcaaaagucagcaucaaacuacacagcucgaagaacagcaccgcccacguaagguguaagggagaugaaacagcauucagcgucuuggaaggcguucacagcuauacagucagccucagcuucgaccaugcagucguugaugagcaaugccagcuaaacugcggaggccacgaaagccaagugaccuuaaaagggaacuugaucuuccucgacguucccaaauucguagacggauccuacaugcaaaccuaccacaguacaguuccaaccggagccaacauacccagcccaacagacuggcucaacgcgcuauucgguaacggacuaagccgcuggauauuaggcgucauaggaguauuacuaggcggacucgcacucuucuucaugauaaugucccuauucaaacuuggaacuaagcaaguauuucggagccgaacaaagcuggccuga

SEQ ID NO: 16404 - RNA, 3222 nt, Artificial Sequence
  derived and/or modified CDS sequence (opt11) from SFTSV(JS2014-H.longicornis-03)__KR230787.1__GP
augaugaaagucauaugguucagcucucugacauguuucgucauacaaugcuccggagacucuggacccauaauaugcgcaggaccgauucacagcaacaaaucagcggauaucccccaccuccuaggcuacuccgagaaaaucugccagauagaucgacugauucaugugagcuccuggcuacgcaaccacagccaauuccaaggauacguaggccaacgcggaggacgaagccaggucaguuacuacccagcagaaaacagcuacucaagauggucaggacuacuaucacccugugacgcagacuggcuaggcaugcuuguaguaaagaaagccaaagggucagacaugaucguacccggcccaagcuacaaaggaaaaguauuuuucgaacgaccaaccuucgacggauacgucggcuggggcugcggcucagguaagucaagaaccgaauccggcgaacucugcucauccgacuccggcacaucuucuggacuacuacccagcgaccgagucuuauggauaggagacguagccugccaaccgaugacucccauaccagaagagaccuuccucgaacuaaaauccuucagccaaucagaguucccagacaucugcaagauagacgguaucguguuuaaccaaugcgagggcgaaucacuaccccagccauucgacguggccuggauggacgugggccacucacacaaaauaaucaugagagaacacaagacuaaauggguccaagagucauccagcaaagacuucguaugcuacaaagaaggaacaggcccaugcucggaauccgaggagaaaaccugcaaaacuagcggcagcugccgcggugacaugcaauucugcaaagucgccggcugugaacacggagaagaggcguccgaagcgaaaugccgcugcucccucguucacaaacccggggaaguaguagucucauacggagggaugaggaucagaccgaaaugcuacggauucucccgcaugauggcgacccuggaaguaaaccaacccgaacaaagaaucgggcaaugcacaggaugccaucucgaaugcauaaacggaggcguccgacuaaucacccucaccucagaacucaagagcgcaaccguuugcgcgucccacuuuugcaguucggcgacaucaggaaagaaguccacagaaauacaauuucacagcggaucacucguagggaaaaccgcaauccacgucaaaggagcccucguagacggaacagaguucacauucgaaggcuccugcauguucccagacgggugcgaugcagucgacugcacauuuugccgagaguuccugaaaaacccccaguguuauccagccaagaaaugguuauucauaauaauaguuauauuacucggauaugcaggccucaugcugcucacaaacguacucaaagcaauaggcauauggggaagcugggucauugcaccaguaaaacucauguucgccaucauaaagaaacugaugcggacagucucuugccuaaugggaaaacugauggaccgaggacgccaaguaauccacgaagaaaucggagaaaaccgcgaagggaaccaagacgacguacgcaucgaaauggcccgaccccgcaggguccggcacuggauguacagcccaguaauacugacauuccucgcgaucggacuagcagaaagcugcgacgaaaugguucacgcagacaguaaacucgugucaugcagacaaggauccggcaacaugaaagaaugcguuaccacagguagagcccuccuaccagcagucaacccaggacaggaagcaugccuccacuucaccgcuccuggauccccagacucgaaaugccugaaaaucaaagucaaacgcaucaaccuuaaaugcaagaaaucaucgucuuacuucguccccgacgcucggagccgcugcacauccgugcgccggugccguugggcaggcgacugccaguccggaugcccgccccacuuuacauccaacuccuuuucagacgacugggcaggaaaaauggaucgcgcgggccuaggguucagcggcuguagugacggcuguggaggggcagcaugcgggugcuucaacgccgcaccgagcugcauauucuggagaaaaugggucgaaaauccgcacggcaucauauggaaagucagcccaugcgcagccuggguacccagcgcagugaucgaacuaaccaugccaucaggagagguaagaacguuccacccaaugucaggcauucccacccaaguauuuaaaggaguuagcguaacauaccucggcucugacauggaggucucaggacucacggaccuaugcgaaaucgaagaacuuaaaucaaagaaacuugcgcucgcgcccuguaaccaagcaggaaugggaguugucggcaaaguuggagagauccagugcucaagcgaagaaagcgcgagaacgauuaagaaagacgguugcauuuggaacgccgaccuagucggcauagaacuccgcguagacgacgcaguaugcuacagcaaaaucacaucggucgaagcggucgcgaacuacagcgccaucccuacgaccaucgggggacucagauuugaacgaucccacgauucccagggaaaaaucuccggcucaccucucgauauaaccgccaucaggggcucauucucggucaacuaccguggccuacgauugagccucagcgagauuacagcuacaugcaccggcgagguaacgaacgucagcggcugcuacagcugcaugacgggugccaaggucucaaucaaacuccacuccuccaaaaacagcaccgcacacguucgcugcaaaggagacgaaacagcauucagcguccuagaaggaguacacuccuacacagucucccucuccuucgaccacgccgugguagacgaacagugucaacucaacugcggcggacacgagucucaagucacacuaaaaggcaacuugaucuuucuagacguccccaaguuugucgacggaagcuacaugcaaacguaccacuccacgguaccaaccggggccaacauaccgucaccaacagacuggcuaaacgcacuauucggaaacggccuuucccgcuggauccuaggggucauuggaguacuacuuggaggccucgcacucuuuuucaugauaaugucacucuucaagcucggaacaaaacaaguguucagaucacgcacaaaacucgcauaa

SEQ ID NO: 16405 - RNA, 3222 nt, Artificial Sequence
  derived and/or modified CDS sequence (opt11) from SFTSV(JS2014-Hedgehog-02)__KR230789.1__GP
augaugaaggugauaugguuuagcagccuaauaugcuucguaauucaauguagcggcgacucaggaccgaucauaugcgcgggaccaauacacagcaauaagucggcagacaucccccaccuccuaggguauagcgagaaaauaugccaaauagauagacugauccacguaagcagcugguuacggaaccacagccaauuccaaggauauguaggacaaaggggcgggagaucacaagucagcuacuaucccgcagaaaauagcuauagccgguggucagggcuccucucgccaugcgaugcggauuggcuagguaugcuggucgucaagaaggcaaaagguucagacaugauagucccuggucccagcuacaaaggaaagguauucuucgaaagaccgaccuucgacggauacguaggcuggggaugcggcuccggcaagagccgaaccgagagcggagagcugugcucaagcgacagcggcaccucaagcgggcugcuacccucagacagaguucuuuggauaggcgauguagcaugccagccuaugacccccauaccggaagaaaccuuccucgagcuuaagagcuucagccaaagugaguucccggacaucugcaaaaucgauggcaucgucuucaaucagugcgaaggagagagcuugccacaacccuuugauguagccuggauggacgugggccacucacacaaaauaaucaugagagaacacaaaacaaaauggguacaagaaucaucgagcaaagauuucgugugcuacaaggaaggaacggggccuugcagcgaaucggaagaaaagacaugcaaaaccagcgggucuugucgcggcgacaugcaauuuugcaaaguagcagggugcgaacauggagaagaagcaagcgaagcaaaaugccgaugcagccuaguccacaagccaggagaaguaguaguuucuuacggaggaaugaggauacgcccgaaguguuacggcuucagccguaugauggcaacacucgaaguaaaccagccagaacagagaaucgggcagugcacggguugccaccuggaaugcaucaacgguggcguucgccuuauuacgcucacaagcgagcuaaaaagcgcaacggugugcgcaucacacuucugcagcucagcaacaagcggcaaaaagucaacagaaauacaguuccacucgggaucgcuaguggguaaaaccgccauucacgucaaaggugcgcugguggacggcaccgaguucaccuucgagggcagcugcauguuccccgacggcugugacgccguagacugcacauucugcagagaguuccucaaaaacccgcaaugcuacccagccaagaaguggcuauuuaucaucauaguaauauuguuaggcuacgcaggccugaugcuacucacgaauguacugaaagccaucgguauuuggggaagcugggucaucgcuccagucaagcucauguuugcgaucaucaaaaagcugaugcgaacagugucaugccuaaugggaaaauuaauggaccgaggacgacaggucauacacgaagaaauaggcgagaaucgcgaaggcaaccaagacgacguacggauagagauggcccgcccgcgacgaguccgacacuggauguacagcccggucauccugaccauacuagcaauaggguuagccgagagcugcgacgaaaugguacacgccgacucgaagcuagucucgugcagacaaggaagcggcaacaugaaagaaugcgugacgacgggcagggcacuacugccggccgugaaccccggccaggaagccugccuccacuucacagcgccggggagcccggacucgaaaugccucaaaaucaaaguaaagcgaauuaaucugaaaugcaagaaaagcaguagcuacuucguacccgacgcacgaagcagaugcacgagugugcgaaggugcagaugggccggcgacugccagucaggaugcccgccccacuucacaaguaacagcuucagcgacgacugggcagggaaaauggaccgggccggacugggauucucgggcuguagugacgggugcgguggggccgcaugcgggugcuucaacgcggccccgagcugcauauucuggagaaaauggguagagaauccacacggaauaauauggaaagucuccccgugcgcagcaugggugccgucagccgugaucgaacucacgaugcccagcggggaggugaggacguuccacccaaugucagggauacccacgcaaguguucaagggggucucagucacauaccugggaucggacauggaagugagcggucuuacagacuuaugcgaaaucgaagaacuaaagagcaagaaacuagcacuagccccgugcaaccaggcagggauggggguaguaggcaaaguuggggagauucaaugcucaucagaagagucagcacgcacgaucaaaaaggacggaugcauauggaacgcagaccuggucgggauagagcuacgggucgacgacgcagucuguuacucgaaaauaaccagcgucgaagcggucgcaaacuauagcgcaauaccuaccaccaucggaggccugagauucgaaagaucgcacgacagucagggcaaaaucucugggagccccuuggacauaacagcaauacggggcucguucucagucaacuacagaggauugcgccuaagccuguccgagaucacagccacgugcacgggcgaaguuaccaacguguccgguugcuauaguugcaugacgggcgcaaagguaaguauaaaguuacacagcaguaaaaauucgaccgcgcauguacguugcaaaggagacgagaccgcauucaguguccucgagggagugcacaguuauaccguaagccugagcuucgaccacgcagucguggacgaacagugccagcuaaacugcggaggacacgaaagccaagucacacuaaagggaaaccuaauauuccuggacguccccaaauucgucgauggcucguacaugcaaacguaccacagcacggucccgacaggggcaaacauaccaagcccgacagauuggcuaaacgcccucuucggaaacggacugucgagguggauccucggaguaaucggaguacuucuuggugggcuagcacuauucuucaugauaaugagcuuauucaagcucgggacaaagcaaguguucagaagcagaaccaagcuggcauaa

SEQ ID NO: 16406 - RNA, 3222 nt, Artificial Sequence
  derived and/or modified CDS sequence (opt11) from SFTSV(KACNH)__KU507558.1__GP
augaugaaagucaucugguucucaucccucauaugcuuagucauacagugcagcggagauuccggcccaaucauaugcgcggguccgauacacagcaacaaaagcgcuuccauaccgcaccuacuaggcuacucagagaaaauaugccagauagacagacuaauacacguaucaucauggcugcgaaaucacucccaguuccaaggcuacguaggacaaagaggagggcggagucaggucucguacuacccagccgaaaacagcuacaguagguggucagggcuacucagccccugcgacgcagacuggcucggaaugcucguagucaagaaagcuaaaggaucugacaugaucguaccgggacccuccuacaaaggcaaaguauucuucgaacggccaacauucgacggcuacgucggcuggggaugcggcaguggcaagucacgcaccgaauccggcgaacuaugcagcucagacaguggcaccuccagcggacuccucccgucggaccgcguccucuggauaggcgacgucgcaugccaacccaugaccccaaucccagaagaaacauuccucgaacuuaaaaguuucucccaaucagaguucccagacaucugcaaaauagacgggauaguuuucaaucagugcgaaggagagagccuaccacaaccuuucgaugucgcauggauggacgucggacauagccacaagaucauaaugagagagcacaaaacaaaauggguccaggagucaagcucaaaagacuucgucugcuacaaggagggcacaggacccuguagugaaagcgaagaaaaagccugcaaaacaagcggcagcugcagaggcgacaugcaauucuguaaagucgccggcugcgaacacggcgaagaggcaucagacgccaaaugccgcuguucccugguccacaaacccggagaggucgucgucucauacggcggcaugagagugagaccaaaaugcuacggguucagcagaaugauggcaacgcuagaagucaacccacccgagcaacgaauaggccaaugcaccgggugccaccuugaaugcauaaacggcggagugcgccugaucacucuaacaagcgaacucaaaagcgcgacaguaugugcaucgcacuucugcagcagcgcaacaagcggcaagaaaagcacagagauacaauuccacagcggaagccucguggggaagaccgcaauacacguaaaaggagcccuuguggacggcaccgaauuuacauucgaaggaagcugcauguuccccgacggcugcgacgcgguagacugcacauucugccgagaguuccucaaaaacccgcagugcuacccggccaagaaauggcuauucauacuaaucguaauccuccucggguacgccggacuuaugcucauaaccaacguccucaaagcaaucggcguauggggguccugggucaucgcgccgguaaaacugauguucgcaauaauaaagaaacuaaugagaacggucagcugucucaugggaaaacuaauggaccggggucgucaagucauccaugaagaaaucggcgagaacggggaggggaaucaagacgacguccgcaucgaaauggcccgacccagaagaguccgacacuggauguauagcccaguaauccucaccauacucgcaaucggccuggccgaagguugcgacgaaaugguacacgccgacaguaaacucguaucaugccggcaaggauccggaaacaugaaagaaugcgugacaacaggccgagcacuacuaccagccguaaaucccggacaagaagcgugccuccacuucaccgccccaggcagccccgacucaaaaugucugaaaauaaaagugaaacgcaucaacuuaaaaugcaaaaagucgucgagcuacuucguaccagacgccagaucccgaugcacgaguguccgaagauguaggugggccggagacugccaaaguggcugcccaccccacuuuacguccaacagcuucagcgacgacugggcaggcaaaauggauagagccggacucggcuucagcggaugcucagauggaugcggcggagcggcgugcgguugcuucaacgccgcccccuccugcaucuuuuggcgcaaaugggucgagaacccgcacggcaucauauggaaggucuccccgugcgcagcauggguacccucagccguaaucgaacucacaaugccaagcggggagguacgaacauuccacccaaugagcggaaucccaacccaaguauucaaaggagugucgguaaccuaccucggcuccgacauggaagucagcggacucacagaccucugcgaaauagaagaacucaaaagcaagaaacuagcauuagccccuugcaaccaggcagguaugggagucguagggaaagucggagaaauccagugcagcagcgaagagagcgccaggaccauaaagaaagacgguugcaucuggaacgccgaccuaguaggcauagaacuccgagucgacgaugccgucugcuauagcaaaaucacaucuguagaagcaguagccaacuacucagccauacccacuaccaucggcgggcuucgguuugaacgcucccacgacucccaaggaaaaaucucggggagcccacucgacauaaccgcgaucagaggaucguucucugucaacuaccgcggccuaagacuaucgcucagcgaaaucaccgcuacaugcacaggagaagucaccaacgucagcggguguuacagcuguaugacaggcgccaaaguaagcaucaaacuccacucauccaaaaauucaaccgcccauguaagauguaaaggagacgaaaccgccuucucaguacuagaaggcguacauagcuacaccguaucacucagcuucgaucacgcggucgucgacgaacagugccaacuaaacugcggcggccacgaaucacagguaacgcuaaaaggcaaccuaauauuucuagacguaccaaaauucguagauggaucguacaugcagacauaccauucaaccguccccacaggugccaacauaccaagccccaccgacuggcugaacgcccucuucgggaacggacucagcagauggauauuaggcguaauaggcguacuccuaggcggacuggcccucuucuuccuuaucauguccuuguucaaacuaggaacaaaacaaguauuccgcucccgcaccaaacuagcguga

SEQ ID NO: 16407 - RNA, 3222 nt, Artificial Sequence
  derived and/or modified CDS sequence (opt11) from SFTSV(KACNH2)__KU507559.1__GP
augaugaaagugauaugguucuccucacuaaucugccuaguuauacaauguaguggcgacacgggcccaaucaucugcgcaggccccauucacagcaacaaaagcgcaaacaucccgcaucugcuaggguacucggagaaaauuugucagauagacagacuuauacacgugagcagcuggcuaagaaaccacucgcaguuccaaggauacguaggccaacgaggaggccgaagccaaguaucauacuauccagcagaaaauucuuacaguagguggucaggucugcuaagcccgugcgacgcggacuggcuagguaugcuagugguaaagaaagccaaaggaucagacaugaucguccccgggcccaguuacaaagguaaaguauucuucgaaaggccuaccuucgacggauacguaggcuggggcuguggaucgggcaaaagcaggaccgagucaggagaacucugcucuagcgacagcgggaccucaagcggccuacucccuucuaauagaguacuuuggaucggagacguagccugucaacccaugacuccgauaccggaagaaaccuuccucgagcuaaaauccuucagucagucagaguucccagacauuugcaaaauugacggcaucguguucaaccaaugcgaaucggaaagccugccucagccauucgacgucgcuuggauggacgucggccacagccacaagauaauaaugagagaacacaaaacaaaguggguccaggaaucgucuaguaaagacuucguaugcuacaaagaaggcacaggaccguguagcgagucagaagaacgaacauguaaaacauccggaagcugcagaggcgacaugcaauucugcaaagucgcuggcugcgagcacggcgaagaagccuccgaagcgaaaugccgaugcuccuuaguccacaaacccggggagguaguggugagcuacggaggaaugcgagugagaccuaaaugcuacggcuucucgcgcaugauggcaacacuagaaguaaauccacccgagcaacgaaucgggcaaugcaccgggugccacaucgaaugcauaaacgggggaguaagacuaaucacacucaccagcgagcuaaaaagcgcgaccgugugugcgagccacuucuguagcagcgccacuagcggaaagaaaagcacugaaauacaauuccacagcggcucgcuugugggaaaagcggcaauacacgucaaaggagcccucguagacgggaccgaguucacuuucgaaggcucgugcauguuccccgacggaugcgaugcagucgacugcaccuucugcagggaauuucucaaaaacccgcaaugcuacccggccaagaaguggcuauuuaucauaaucguuauacugcuaggauacgcagggcuaaugcuacucacaaacguacugaaggccauaggaguauggggauccuggguaauagccccagugaagcucauguucgccaucaucaaaaagcucaugcguucagugagcugccuaaugggaaaacuaauggaccggggccgucaagucauacacgaagaaauaggcgagaacagggaaggaaaccaagacgauguacggauagagauggcacgaccacguagagugcgucacuggauguacagccccguaauacuaacaauccucgccaucgggcuagcagaaggcugcgacgaaauggugcacgcagacucaaaacuggucagcugccggcagggaggcggcaacaugaaggagugcguaacaaccggccgggcccuacucccggccgugaaccccggccaagaagccugccuacacuucaccgcgccaggcagcccggacucgaaaugccuaaaaaucaagguaaaacggauaaaccugaaaugcaaaaaguccuccagcuacuucguccccgacgcacgaagccggugcacaagcgugcgccgcuguaggugggcaggagacugccaaagcggcugccccucucauuuuacauccaauuccuuuagcgacgacugggccggaaagauggaccgagcaggccucggguucagcggcuguagcgacggcugcggcggcgcugcaugcgggugcuucaacgcagccccgucaugcaucuucuggcgcaagugggucgagaauccacacgggauaauauggaaagucucgccaugugcagcgugggugccaucagccguaaucgaacucacgaugccaucgggagaggugagaacauuccaccccaugagcggaaucccgacccaaguauucaaaggggucucagucacauaccuaggcagcgauauggaaguguccgggcucacagaucucugcgagaucgaagaauuaaaaagcaagaagcucgcgcuagcgcccugcaaucaggccggaaugggcguuguaggcaaagucggggaaauacagugcagcagcgaagaaagugcgcgaacgaucaagaaagacggauguaucuggaacgcagaccugguagggaucgaacuacggguugacgacgccgucugcuacucgaaaauaacaagcgucgaggccguagccaauuauucagcaauaccgacaaccauaggagggcuacgguucgaacggucucacgacagccaaggcaaaaucucaggcucgccacucgacauaaccgcaauccgaggcucguucucagucaacuacagaggacuacgccugucccugagcgaaaucacagcuaccugcaccggagagguuacgaacguguccggaugcuacagcugcaugacaggcgccaaagucagcauaaaacuacacagcuccaaaaacucgaccgcgcacgugcgaugcaaaggcgacgaaacggcauucuccguacuagagggaauccacuccuauaccgugagcuuaaguuucgaccaugccgucgucgacgaacagugccagcucaacugcgggggacaugaaucccaggucacacugaaaggaaaccucaucuuccuagacguuccaaaguucguagauggcuccuacaugcaaacauaccacaguagcgucccaaccggcgcgaacaucccaucgccgaccgacugguuaaacgcacuauucggaaacggccucagccgauggauccuagggguaaucggaguccuacuagguggacucgccuuguucuuccuaauaaugagccucuucaagcuagggacaaagcaaguauuuagaagcagaacgaagcuagcguga

SEQ ID NO: 16408 - RNA, 3222 nt, Artificial Sequence
  derived and/or modified CDS sequence (opt11) from SFTSV(KACNH3)__KP663744.1__GP
augaugaagguaaucugguuuucaucgcugaucugcuuagucauacagugcucaggggacacgggaccgauaaucugcgcgggucccauacacaguaauaaaucagcuaacaucccccaccuacuaggauacucagagaaaaucugucaaaucgaccgauuaauacacguaaguuccuggcuacgaaaccacucgcaguuucaaggauacgugggccagcgcggcggaaggagccagguaucguacuaccccgccgaaaacucguauagcagauggucgggacuccucagccccugcgacgcggacuggcucggcaugcuagucgucaaaaaggcgaagggcucagacaugaucguacccgggccaagcuacaagggcaagguuuucuucgagaggccaacauucgacggguacgucggauggggaugcggcucaggaaaaagccggaccgagaguggggagcuaugcagcagcgauuccggaacauccagcggccuccucccgucagacaggguccuguggauuggcgacguagcgugccaaccaaugacccccauccccgaggagacuuuucuagagcucaagagcuucucccaaagcgaauuuccagacauaugcaagauagacggcaucguguucaaccagugcgaaagcgagucccugccccagccauucgacguggcauggauggacgucgggcacucacacaagaucauaaugcgggaacauaagaccaaauggguacaagagucaucgucgaaagacuucguguguuacaaagagggcaccgguccgugcuccgaaucagaagagaaaacaugcaagacauccggcucgugcaggggcgauaugcaguucugcaagguagcgggaugcgaacacggggaggaggccuccggcgccaaaugccgcugcagccuagugcacaaaccaggcgagguagugguguccuacggcggaaugcgugugcgcccgaaaugcuacggguucucaagaaugauggcaacacucgaaguaaauccgcccgaacaaagaaucgggcaaugcaccgguugccaccuggaauguaucaaugggggcguacgacuaauuacauuaaccagcgaacuaaagagcgcgaccguaugcgcgagccauuucugcagcucagccacgagcggcaaaaagagcaccgaaauacaauuccacucgggaucauuaguaggaaaaaccgcgauccacguaaaaggagcgcuaguagacgguaccgaguucacguucgaaggaagcugcauguucccagacggaugcgaugcaguggauugcacauucuguagggaguuccucaaaaacccgcaaugcuaccccgccaagaaaugguuauucauaaucaucguaaucuuacucggauacgcgggccugaugcuacuaacaaacguacuaaaagccaucggcgugugggggucaugggucauagcacccguaaagcugauguucgcaaucauaaagaaacucaugagaucagugucaugcuuaaugggcaaacuaauggaccgcggaaggcaaguaauacacgaagaaaucggcgagaacagagaaggaaaccaggacgacguacgcauugagauggcgcgaccacgacgagucagacacuggauguauagcccgguaauucucaccauccuagccauuggacucgccgaaggcugcgacgagaugguccacgcugacucaaaauugguaucuugcaaacaaggaucagggaacaugaaagagugcgucacaaccggcagagcccuccuaccagccgugaaccccggccaagaagcgugccuacacuuuacagccccaggcaguccggacuccaaaugccucaaaauuaagguaaaaagaauaaaccuaaagugcaagaaaucaagcaguuacuucgugccggacgcccgcaguagaugcacaagcguacgaaggugccggugggcuggugacugccaaaguggaugcccgagccauuucacuagcaacucauuuagcgacgauugggcaggcaaaauggacagggcugggcuaggguucucaggcuguagcgacggcugcgggggagccgcaugcggcugcuucaacgcggcaccgagcugcaucuucuggcggaaauggguggagaacccgcacgggauaauauggaaagugucaccaugcgccgcuugggugcccuccgccgucauugagcuaaccaugccgagcggagagguacgcacauuucauccgaugagcggaauacccacccagguauucaaagggguaucgguaacguaccugggcucugacauggaggugagcggccuaacggaccuaugcgaaaucgaggaacugaaaucgaagaaacucgcauuggcaccaugcaaccaagccggaaugggcguugugggcaaaguaggagaaauccaaugcagcucagaggaaagugcacgcacgaucaagaaagaugguugcaucuggaacgcggaccuagucggaaucgaacuaagagucgacgacgccguaugcuacucaaaaauaaccucggucgaggccguggcaaauuauuccgcaauccccaccacaauaggcggucuacgcuucgaaagaucccacgacagucagggaaaaaucucagguucgccucuugacauaaccgcaauccgaggaucauucucgguaaacuaccgaggauugcgccuauccuuaagcgagguaaccgcgacaugcacgggcgaaguaacaaacgugucgggcugcuauucaugcaugacgggugcgaaagugucgauaaaacuacacuccuccaaaaauagcacagcacacgugcgaugcaaaggcgaugaaaccgcauuuagcguccuggaaggaguccacagcuacaccgugagccucagcuucgaucacgcaguggucgaugaacaaugccagcuaaacugcggcggacacgaaucgcaagugacccugaaaggaaaccucaucuuccucgacguaccgaaguucgucgacggcucauacaugcaaacguaccacagcucggucccaaccggagccaacauaccaucucccacagacuggcuaaacgcgcuauucggaaacggacucagccgcuggauccuaggggucauaggcguccuucuaggcgggcucgcacuuuucuuccuaauaaugagccuguuuaaacucggcaccaaacaaguguuuaggagcagaaccaagcucgccuga

SEQ ID NO: 16409 - RNA, 3222 nt, Artificial Sequence
  derived and/or modified CDS sequence (opt11) from SFTSV(KADGH)__KU507548.1__GP
augaugaaggugauaugguucuccucauuaaucugccucguaauacaaugcagcggggacacaggaccaauaaucugcgcagggccaauccauucuaacaaaucugccaacaucccccaccuacuaggcuacucggaaaagauaugccaaaucgaucgccugauacacguaagcucguggcuccgaaaccacucgcaauuccaaggauacgucggacaacgcggaggccgcagccagguaucauacuauccggccgagaacagcuauaguagaugguccggacugcucuccccaugcgaugcagacuggcuaggaaugcuagucgugaaaaaggccaaagggucagacaugauagucccagggcccagcuacaaaggcaaaguauucuuugaacggccaaccuucgacggauacguaggauggggaugcgggagcggcaaaagccguacugaguccggggagcucugcagcuccgacagcgggaccagcagcgggcuacuaccaucugacaggguccuauggauuggcgacguagccugccagccaaugacccccauacccgaagagacauuccuugagcucaaaucauucagccagagcgaguuccccgacaucugcaaaaucgacgguauaguguucaaccaaugcgaaagcgaaagccuagcccaacccuucgaugucgcauggauggacgucggacauagccauaaaaucauaaugcgagaacauaaaacaaaauggguccaggaaucauccuccaaggacuucgucugcuauaaggaggggacaggaccaugcucagaaucagaagagaaaacgugcaagaccucaggaucgugccgcggcgacaugcaauucugcaaggucgccggcugcgaacacggcgaagaaacaucaguggccaaaugccgcugcucucuaguccauaaaccaggggaaguagucgucagcuacggaggaaugcgcguccgacccaaaugcuauggcuucucucguaugauggcaacucuggaagucaacccaccugaacaacggaucggacaaugcaccgggugccaccuggagugcauaagcggcggagugcgccucaucacccucaccagcgaacucaaaagcgcaacagucugcgccucacacuucugcagcagcgccaccagcgggaagaaauccacugaaauacaauuccacuccgggagccuaguaggcaaagcagcaauccacgucaaaggcguucugguagacgggaccgaguucacguuugaaggauccugcauguucccagacgggugcgacgcagucgauuguaccuucuguagagaauuucuaaagaacccccaaugcuacccagccaagaaauggcuauucaucauuaucgucauccuacucggguacgccggacuaaugcuacucacaaacguccucaaagcaaucggggugugggggagcugggucaucgcccccgucaaacucauguucgcgauaauuaagaaacucaugcgaucggucucaugucucaugggcaaacuuauggaccgaggacgacaggucauccacgaagaaauaggggaaaacagagaagguaaccaggacgacgugcgcauagaaauggcuagaccacguaggguacgacacuggauguacucccccguaauacuaacuauacuagcgauaggccucgcggaaggcugcgacgaaaugguacaugcggacucaaaacucguaagcugccgacaaggcagcggaaacaugaaagaaugcgucaccacgggacgugcguuacuaccggcaguuaaccccggccaagaagcaugccugcacuucaccgcaccaggcuccccggacucgaaaugccuaaaaaucaaaguuaaacgcaucaaccucaagugcaagaaauccuccagcuacuucguacccgacgcccguagccggugcaccagcguccgaagauguagaugggcgggcgauugccaaucgggauguccgagccauuucacauccaauucauucagcgacgacugggccggcaaaauggaccgcgccgggcuaggcuucuccgguugcagcgacggcugcggaggugcugcaugcgggugcuucaacgccgcgccaagcugcauauucuggcgcaaaugggucgaaaacccccacggcaucauuuggaaagucucgcccugcgcagcauggguaccaagcgccguaauagaauuaaccaugcccagcggagaagugcguacuuuccacccuaugagcggaauccccacacagguauucaaaggagucucagucacauaccucgggagcgauauggaaguuagcggccucaccgaccuaugcgaaaucgaagaacuaaaaucuaaaaagcucgcacuagcaccuugcaaccaagccgguaugggggucguaggcaaaguaggagaaauccaaugcucaucggaagaauccgcccgcaccauaaagaaagacggaugcauauggaacgcggaccuaguagggauagaauuaagaguggacgacgcagucugcuacucaaaaaucacauccguagaagcugucgcaaacuacuccgccauuccaaccaccaucggcggacuccgauucgaacgaagccacgacucacagggaaaaauaagugggucaccccucgacauaaccgcaaucagagggagcuuuucagucaacuacagaggacugcgccugucccuaagcgaaaucacagcgaccugcaccggcgaggucacaaacgucagcgggugcuauuccugcaugacgggcgccaaggucagcauacggcuccacucaagcaaaaacagcaccgcacacgugcguugcaaagaagacgaaacagccuucucaguccucgaaggaguacacucauacacagugucacucaguuucgaccacgcaguaguagacgaacaaugccagcuuaacugcggaggucacgaaucgcaagugacgcucaaaggaaaccuuaucuuccucgacguaccaaaauucgucgauggcucauacaugcaaacuuaccacaguagcguacccaccggcgcuaacauaccaagccccacagacuggcuaaacgcccuauucgguaacggucucuccagauggauccucgggguaaucggcguccuacuaggcggccuagcccucuucuuucugaucaugucacuuuucaaauuaggcacaaagcaaguauucaggucccggaccaagcucgcauaa

SEQ ID NO: 16410 - RNA, 3222 nt, Artificial Sequence
  derived and/or modified CDS sequence (opt11) from SFTSV(KAGBH)__KU507560.1__GP
augaugaaaguaauaugguucucaucccucauaugucucguaauacaaugcucaggagauacaggcccgaucauaugcgccgggccaauccacucaaacaaaagugccaacauaccacaucuacucggauacucggaaaagaucugccaaauagacagacucauacacguaucuucuuggcuccgaaaucacucgcaguuccaaggauaugucggacaacgcggaggccgaucacaaguaucauacuuucccgcagaaaacagcuacaguagauggucaggacuccugucaccaugcgacgccgacuggcuaggaauguuagucgucaaaaaggcuaaaggguccgacaugauaguacccgggcccucauacaaaggaaagguauucuucgaacgccccaccuucgacggauacgugggauggggcugcggaucgggcaaaagccggaccgaaagcggcgaacuaugcucgagcgacagcggcacaucgagcggcuuacuccccucagaucggguccuauggauaggcgacguagcaugccaacccaugacacccauccccgaagaaacauuucuagaauuaaagagcuucagccaaagcgaguucccagacauauguaaaauagacggaauagucuuuaaccaaugcgaauccgaaagccucccccagcccuucgacguggcauggauggacguaggccacagccacaagaucauaaugcgugaacauaaaaccaaauggguucaggaaucaagcucaaaggacuucgugugcuacaaagaaggcacaggaccuugcucagaauccgaagagaaaacgugcaagacuucaggaaguugcagaggagacaugcaauucugcaaaguggccggcugcgaacacggggaagaggcaucagaagccaaaugcagaugcagccugguacauaagcccggagaggucgucgugucguacgggggcaugaggguacgcccaaaaugcuacggcuucagccgcaugauggcuacacuagagguaaacccacccgaacagcgaaucgggcaaugcacaggcugucaccucgaaugcauaaacgggggcguacgccucauaacacucaccagcgaacucaaguccgcgaccguaugcgccucccacuucugcagcucagccaccucaggaaagaaaucuacugaaauacaauuccacucgggcucgcuaguaggcaaaacagcgauccacgucaaaggagcacucguugacggaaccgaguucacauucgaaggcucauguauguuccccgauggaugcgacgcagucgacugcaccuucugcagggaauuucugaaaaauccccaaugcuacccggccaaaaaguggcuauucauuaucaucguaauccuacuaggauacgcaggccuaauguuacugacaaacguacuaaaagcaaucgguguaugggguagcuggguaaucgccccagucaaacucauguuugccauaaucaagaagcucauccgcagcguauccugccugauggggaagcugauggaccgcgggaggcaagucauccacgaagaaaucggcgaaaaccgagaagguaaccaggaugauguacgcauagaaauggccaggccacgcaggguccggcacuggauguacagcccagucauccuaacaauccuugcuauuggauuggccgagggaugcgacgagaugguacacgcggacagcaaacuuguguccugcaaacaaggguccggaaacaugaaagaaugugugaccaccggcagagcacuacucccggccgugaacccaggccaagaagccugccuccacuucacagcacccggguccccagacuccaaaugccuuaaaauaaaaguaaaacggauaaaccugaaaugcaagaaaagcucguccuacuucguaccagacgccagaagccgaugcaccucaguccgccgcuguaggugggcaggagacugccaauccggcugccccucacacuucacaagcaacagcuucagcgaugauugggcagggaagauggaccgagccggauuaggauuuagcggaugcagugacggaugcggcggcgccgcaugugggugcuucaacgcagccccaagcugcauauucuggagaaaauggguagagaacccccacggaauaaucuggaaagucucccccugcgccgcauggguacccuccgccguaaucgaacugaccaugcccucaggagaagugcggacauuccacccaaugagcggaaucccaacccaagucuuuaaaggaguaucgguaacguacuuaggcucggacauggagguaagcggccugacggaccugugcgagaucgaggaauugaagaguaaaaagcuagcacuagcacccuguaaccaggccggaaugggaguggugggcaaaguaggagaaauccaguguucaucagaggaaagcgcccgcacgaucaagaaggacggcugcaucuggaacgcagaccuggucgggauagaacuccgggucgacgaugcaguaugcuacucuaaaaucacauccguagaagcagucgcgaacuacagcgcaauaccgacaaccaucggaggccuacgguucgagcgaagccacgacagccaggggaagauauccgguagcccgcucgacaucacagcgauaagggggagcuucucggucaacuaccgcggacuacgccuaagccuaagcgagaucaccgccacgugcaccggcgaagucacuaacguauccggaugcuacucuuguaugaccggagccaaaguauccauaaaacuccauucauccaaaaauucaaccgcucacguacgcugcaaaggggacgaaacagccuucucaguccuagaaggaguccacucauacacaguaagccucucauucgaucacgccgucguggacgaacagugccagcuuaacugcggcgggcacgaaagccaagucacccugaaaggcaaccuaaucuuccucgacguaccaaaguucgucgacgggucauacaugcaaacauaccacucaucagucccaacaggagccaauaucccaagcccuacagacugguuaaacgcccuuuucggcaacggacucagccgauggauccuaggcgucaucggaguccugcucggcggacucgcucucuucuuccucauaaugagcuuguucaaacugggaaccaagcaaguauuccgaagcagaacgaaacucgcguga

SEQ ID NO: 16411 - RNA, 3222 nt, Artificial Sequence
  derived and/or modified CDS sequence (opt11) from SFTSV(KAGBH3)__KU507561.1__GP
augaugaagguaauaugguucaguagccucauaugccuggucauacaaugcucaggcgacacaggacccaucauaugcgcgggcccaauacacagcaacaaauccgccaauauaccacaucuccuuggauacucagaaaagaucugccaaaucgacagacucauccacgucuccucuugguugaggaaccacucgcaauuccagggcuaugugggccaaagaggaggaaggucgcaagugucguacuucccugcagaaaacucauacucccggugguccggacuccuaagccccugcgacgcagacuggcuagggaugcuagucguaaagaaggccaaaggcucggacaugauuguacccggcccauccuacaaaggaaaggucuuuuucgagcgcccgaccuucgacggguacgucggauggggcugcggcuccggcaagagccgcaccgaaagcggggaacucuguucaagugacuccggaacauccagcggccuccucccgagcaaccgcguucuauggauuggcgacguagcaugccaacccaugacaccaauaccagaagagacauuccuagaacucaagagcuuuucucaaagcgaguucccggacaucugcaagaucgauggcaucgucuucaaccaaugcgaaagcgaaaguuuaccucaacccuucgacguggccuggauggacguaggacacucacauaagaucauuaugcgcgaacacaaaacaaaauggguccaagaaucaagcuccaaagacuucgugugcuacaaagaaggaacagguccaugcucggaaagcgaagagaaaaccugcaaaaccagcggaaguuguagaggagacaugcaauucugcaaggucgccggaugugaacacggggaagagacaucagaggcgaaaugccgaugcagccuaguacauaaacccggcgaggucgucgugucauacggaggcaugcgcgugcgaccaaaaugcuacggcuucagccgcaugauggcgacacuagaaguaaaucccccagaacagcgaaucggccagugcacgggaugccaccuagaauguaucaacggaggcguccgcaucaucacacucacgagcgaacucaaauccgcaacagucugcgccagccauuucugcuccucugccacgucaggaaagaaaagcacagaaauccaauuccacagcgguucacucgucggcaaaaccgcuauccacgugaaaggcgcgcucguggacggcacagaauuuacguucgagggaucaugcauguuccccgacgguugugacgcagucgacuguacuuuuugcagggaguuccucaaaaacccccaguguuaccccgccaagaaauggcuguucaucauaauaguaauccuccuuggauacgcaggccugaugcucuuaacuaacguccucaaagcaaucggcgucuggggcuccuggguaauagcccccguaaaacucauguuugccaucauuaagaagcucaugcgaucaguaucaugcuugaugggaaaauuaauggaucgcgggcgacaagucauacacgaagaaauaggagaaaauagggagggcaaucaggacgacguacgcaucgaaauggcccgcccccgaagagugcgccacuggauguacuccccagucauacucacgauccucgcgauaggccuagcagaaggaugugacgagaugguccacgccgauucuaagcucguacucugcaaacaaggcuccgguaauaugaaagaauguguaacuacgggccgggcccuacuaccagccguaaacccuggacaagaagccugccuacacuuuacagccccugggagccccgacucaaaaugccuuaagaucaaggucaaacgcauaaaccucaaaugcaaaaagagcagcucauacuuugugcccgacgcgcgcucacgaugcacaagcguacguagaugccgaugggcgggcgacugccaaagcggguguccaucgcacuucaccagcaacaguuucagcgacgacugggccggcaaaauggaccgcgcaggacuaggguucucaggcugcagcgacggcugcggaggcgcagcuuguggaugcuucaacgcggcgccaucgugcaucuucuggaggaaaugggucgagaacccacacgggaucauauggaaaguguccccaugcgccgcaugggugcccucggcugugaucgaacucaccaugcccagcggcgaaguacgcacguuucacccgaugagugggaucccaacacaagucuucaaaggagugagcguaacguaccucggguccgacauggaaguuucaggccugaccgaccuaugcgaaaucgaagaacugaaaagcaagaaacuagcacucgcaccgugcaaccaagcgggaauggggguagucggcaaagucggagaaauacaaugcagcagcgaagaaagcgccagaaccaucaagaaagacggcugcauauggaacgcagaccucgucggcaucgaacuuaggguggaugacgcagugugcuacuccaaaauaaccuccguagaggccgucgcgaacuacagcgcaauccccacuaccaucggaggacuaagauucgaacgaucccacgacagccaaggcaaaauaucagggagcccacucgacauaaccgcaauccgcggcagcuucagcguaaacuaccgaggccugcggcugagccuaucugaaauaaccgcuacaugcaccggggaagugacaaacguaucaggaugcuauagcugcaugacgggcgcgaaaguauccauaaaacuccacuccuccaaaaacucaacagcgcacguacgaugcaaaggagacgaaacagccuucucaguacuagaaggcguccacucauaugcgguaagccugaguuucgaccacgccguaguagaugaacaaugccaacuuaacugcggaggccacgaaagccaagucacucuaaaaggaaaccucaucuuccuagacguaccaaaauucguggacggaucguauaugcagacuuaccauagcucaguaccgacgggagcuaacauuccaagcccaacagauuggcucaacgcacucuuugguaauggccugagccgcuggauucuaggcguaauaggcgugcuccucggcggacucgcgcuauucuuccugaucaugagccuuuucaaacuuggcaccaaacaaguauuccgcucaaggacuaaacuggcauga

SEQ ID NO: 16412 - RNA, 3222 nt, Artificial Sequence
  derived and/or modified CDS sequence (opt11) from SFTSV(KAGBH4)__KU507562.1__GP
augaugaaagucaucugguucagcucacuaaucugccugguaauucaaugcucgggagacacaggacccauaaucugcgcggggcccauccacagcaauaaaucggccaacauuccacaccuucucggauacagcgagaaaaucugccaaauagacagacugauacacgugagcagcuggcugaggaaccacucacaauuccaaggauacguaggccaacgugggggccgcagccaagucucauauuucccagcggaaaacucauauuccagauggaguggauuacuaagccccugugacgcagacuggcuaggaaugcucgugguaaagaaagccaaaggcucagacaugaucgugccagguccgagcuacaagggcaaggucuuuuucgaacguccgacauucgacggauacguuggauggggaugcggauccgggaaaagccggaccgaaagcggcgaacuaugcuccucagauagcggaacaucguccgggcuacugccaagcgacagaguccuguggauaggcgacguagcaugccaaccgaugacccccauucccgaagaaaccuuccucgaacucaagucauucagccagagcgaguucccggacaucugcaaaauagacgggaucgucuucaaucagugcgaaagcgagagccucccccaacccuucgacgucgcauggauggacguaggccacucccacaaaaucauaaugcgggaacacaaaacgaaguggguacaggaaagcaguuccaaagauuucgucugcuacaaagaagggacuggacccugcuccgaauccgaagagaaaacgugcaaaacgagugggucaugccggggagacaugcaguucugcaaggucgccggcugcgaacacggagaagaagccucagaagcaaaaugccgauguagccucguccacaagccgggcgaagucgucgucucuuacggagggaugcgagugaggccgaaaugcuacggcuucagucgaaugauggccacguuggaagugaauccgcccgaacaacgaaucggccaaugcaccggcugccaccuagaaugcauaaacggaggugucagacucaucacccuaacaagugaacugaaaucagccacagugugcgcaagccacuucugcaguuccgcgacaagcggcaagaaaagcaccgaaauacaauuccacucgggcagccuaguaggaaaaaccgcaauacacgucaagggcgcccuaguagacgggacagaguucacguucgaaggaucaugcauguucccggacggaugcgacgccguagacugcacauucugcagagaguuccucaaaaacccacagugcuacccggcaaagaaauggcuguucauaauaauagugauccuacuaggauacgccggucugaugcuacuaacgaacguccucaaagcgaucggagucuggggcucguggguuauagcuccaguaaaacucauguucgccaucauaaagaagcucaugagauccgucagcugccucaugggcaaauuaauggaccgcggacgacaaguaauacacgaagaaauuggcgaaaauagagaagggaaccaagacgacgugcgcaucgaaauggcaagaccccgcagaguccgacacuggauguacuccccagucauccuaacaauacuagcaauuggacuagcagaaggcugcgacgagaugguacacgcagauucaaagcuaguaucauguaaacaaggaucgggcaacaugaaggagugcgucaccacaggacgagcccuacuacccgcagucaacccaggccaagaagccugucuacauuucacagcccccggaagcccagauuccaaaugccucaaaaucaaagucaaacgaaucaaccuaaaaugcaaaaagagcucaagcuacuucgugcccgacgccagaucccggugcacguccguccgacgcuguaggugggcgggcgacugccaaucaggaugcccaagccacuucacauccaacaguuucucagaugacugggccgggaagauggaccgcgccggacugggcuucucgggcuguucagauggcugcggcggagcugcaugcggcugcuucaacgccgcgcccagcugcaucuucuggcggaaauggguagagaacccccacggcaucauauggaaagugagccccugugcagcaugggucccaagcgcggucaucgaguuaacuaugccuagcggagaagugagaaccuuccacccaauguccgggauccccacccaagucuucaaaggaguuaguguaacguaccugggcucggacauggaagucuccggacugacagaucucugcgagauugaggaacuaaaaagcaagaaacuagcccuagcaccaugcaaccaggccggcaugggcguagucggaaaagucggcgagauacaauguagcuccgaagaaucagcacgcacuaucaagaaagacggcugcaucuggaacgcagaucucgucggcaucgaacuacgaguggaugacgcaguaugcuacucgaaaauaaccagcguagaagccgucgccaauuacucagccauccccaccaccaucggcggccuccguuucgaacgaucucacgacucccagggaaaaauuucaggaucgccacuagacaucaccgccauacgaggaucauucagcgucaauuacagaggccuaagacucucacugucagagauuaccgcaacaugcacaggggaagucacaaacgucagcggcugcuacaguugcaugaccggagccaaaguaucaaucaaacuacacucgucgaaaaacucaaccgcccacguacgcugcaaaggagaugagaccgcguucagcguacuagaagguguacacagcuacacaguaagccuaucauucgaucaugcagucgucgaugaacaaugucaacucaacugcgggggacaugaaagccaagucacccucaaaggaaaccuaauauuccucgacguacccaaguucgucgacggcucguauaugcaaacauaccacagcagcguaccaaccggcgccaacauacccagcccaaccgacuggcucaacgcgcuauuuggaaacggccuaagucgcuggauacuaggcguuauagguguucuccuaggagggcucgcccuauucuuucugaucaugagccuauucaaacuuggaaccaaacaaguuuuccggagccgcacaaaauuagccuaa

SEQ ID NO: 16413 - RNA, 3222 nt, Artificial Sequence
  derived and/or modified CDS sequence (opt11) from SFTSV(KAGBH5)__KP663738.1__GP
augaugaaagucaucugguucagcucgcucauaugccugguuauacaguguagcggagacaccggaccgauuaucugcgcgggaccgauacacaguaacaaauccgcaaauauaccacaucugcuaggguacagcgagaaaaucugccagauagacagguuaauacacguaucgucguggcuacgaaaccacucacaauuccagggauacgugggccaacggggaggcaggucccagguuucguacuuuccagccgaaaauucuuacaguagauggucgggccucuugucgccgugugacgcggacuggcuaggcauguuggucguaaagaaagccaaaggcucggauaugauaguccccggcccccuauacaaaggcaaagucuucuucgaacgccccacauucgacggauacguaggcugggggugcggcagcggaaagagcaggaccgaauccggggagcucugcagcagcgauagcgggaccuccagcgggcuacugcccuccgacagaguacucuggauaggcgacgucgcgugucaacccaugaccccaaucccagaggaaacauuccucgaacugaaaaguuucagccaaagcgaguucccagacaucugcaaaauugacggcauaguauucaaccagugcgaaagcgagagccugccacagcccuuugacguggcuuggauggaugugggccacagccacaaaauaauaaugagggaacacaaaacuaaguggguccaagagucgagcucgaaagacuuuguaugcuacaaagagggcacagggccaugcuccgaaucagaagaaaagacgugcaaaacuucaggcuccugcaggggagacaugcaguucugcaaagucgccggcugcgaacacggggaggaaaccuccgaagcgaaaugccgauguagccucguacacaaaccaggugaggucgucguaagcuacgggggaaugcgaguccgacccaaaugcuacggauucucacggaugauggccacccuagaagugaacccaccagagcagagaaucggacaauguaccggaugccaccuugagugcauaaauggcggcguacguuugauaacgcugaccagcgaacuaaaaucggcgaccgugugcgcgagucauuucuguagcucggcaaccucagggaaaaagagcacggaaauccaauuucauucaggcucacugguaggcaagaccgcgauccacgucaaaggcgcccuaguagacgggacggaguucacauucgaggguagaugcauguucccggacggaugcgacgcgguagacugcacauucugcagagaguuccugaagaacccgcaaugcuacccagcgaagaaauggcuuuucauaaucaucgugauccugcuuggguacgccggacugaugcuauugacaaacgugcuaaaggcagugggaguaugggggagcugggucauugccccgguaaaacuaauguucgccauaaucaaaaagcuaaugaggucagucagcugccuaaugggcaaacugauggaucggggacggcaagucauacacgaagaaauaggcgaaaacagggagggaaaccaggacgacguacggaucgagauggcgcgccccagacgggucagacacuggauguauagcccagugauucuggccauccuugccaucggccuagccgaaggcugcgaugagauggugcacgcagacucgaagcuagucucuugcaaacaggggagcggaaacaugaaagaaugcguaacgacaggaagggcacuccucccagcaguaaauccggggcaagaggcauguuuacacuucacggcucccgggucaccagacucgaaaugucucaaaaucaaagucaaacgaauaaaccucaaaugcaagaaaagcucaagcuacuucguaccagacgcccggaguaggugcacuagcguaaggcgcugccgaugggcaggagacugccagaguggaugcccaagccacuuuacgagcaacagcuucagcgacgacugggcggggaaaauggacagagccggacuaggcuucuccggcuguagugacggcugcggcggggcagccugcgggugcuucaacgcugcccccuccugcauauucuggagaaaauggguggaaaacccgcacgggaucaucuggaaagucucaccaugcgcagcauggguaccaagugccgugaucgaacucacgaugccgaguggagaaguacgcacguuccacccaaugagcggaauccccacccaagucuucaaaggaguaucagucaccuaccugggauccgacauggaagugagcggacucacggaccugugcgaaaucgaggaauugaaauccaaaaagcuggcgcucgccccaugcaaccaggcggggaugggaguaguagguaaggucggggaaauacaaugcagcagugaggaaagcgcacgcacaauaaagaaagauggcugcauauggaacgcagaccuagucgggauagaacuccgcguugacgacgcgguaugcuacagcaaaauaacgagcgucgaagccguagccaacuacucggcgauaccuacgaccaucggcgggcuccgguucgagcgcagucacgacagccaggggaaaauaagcggcucgccccuagacaucaccgcgaucagaggcagcuucucggucaacuaccggggccuaagacuaaguuuaagcgaaaucacugcaaccugcacaggagaaguaacuaacgugagcggaugcuacagcugcaugacaggagcuaaaguaaguauaaaauugcacucaagcaagaacagcaccgcacacguuagaugcaaaggagacgaaaccgccuuuucaguacuagaaggaguacacagcuacacaguaucgcuauccuuugaccacgcaguaguagacgagcagugccaacuaaacugcggcggccaugagagccaagucacacuaaaaggcaaccuaaucuuccuagacguaccaaaauucguagacggauccuacaugcaaacauaccacagcuccgucccgaccggggccaacaucccgucaccgacagacugguuaaacgcacuauucggaaauggccuaagccgauggauccucggcgucaucgguguacugcugggaggacucgcacucuucuuccugaucaugagucucuucaagcuggggacaaagcaaguuuuccgaagccggacaaaacuggcguga

SEQ ID NO: 16414 - RNA, 3222 nt, Artificial Sequence
  derived and/or modified CDS sequence (opt11) from SFTSV(KAGBH6)__KP663741.1__GP
augaucaaggugaucugguucuccagccuaauaugccuaguaauccaaugcuccggcgacacgggcccaauaaucugcgccggcccuauacacagcaacaaaagcgcgaacauuccacaucuacucggauacucggagaaaauaugccaaauagacagacucauccacgucagcucuuggcugcgcaaccacucacaauuucaaggcuauguugggcaacgagguggaagaagccaggucagcuacuuccccgcagaaaacaguuacagccgauggucaggacuacugucgccaugugacgccgacuggcucggcaugcucguagugaagaaagcaaaggguucagacaugaucgugcccggccccuccuacaaagggaaggucuucuucgaaagacccaccuucgacggauacguaggaugggguugcggcagcgguaaaagcaggaccgaaagcggcgaacuaugcuccagcgacagcggcaccucaagcggacuacuacccagcgaccgaguacuauggauaggagacgucgcaugccagcccaugacacccauaccagaagaaacauuccuagaacuaaaauccuucucccaaagcgaguuccccgacaucugcaaaauagacgguauugucuucaaccaaugcgagagcgaaagccuaccccagccauucgauguagcguggauggacguaggacauagccacaaaaucaucaugcgggaacacaagacgaaauggguccaagaaucaaguucgaaagacuucguuuguuacaaagagggaacgggaccauguucagaauccgaagagaaaacgugcaagacauccggaucgugucgcggcgacaugcaguucugcaaaguggcaggaugcgaacacggcgaagaagcaucagaagcgaaaugccgcugcucacucguacacaaacccggagaagucgugguaucguacggaggaaugcgaguacgcccgaaaugcuacgguuucagccgcaugauggcgacacuagaagugaacccaccagaacaacgcauaggccaauguacagggugccaucucgagugcaucaaugguggagugcgacugauaacucucaccagugaacuaaaguccgcaaccgucugcgccagccauuucugcagcucggcaacgaguggcaaaaaguccacugagauccaguuucacucgggaucccucgucggcaaaaccgcaauccaugucaaaggagcucuuguagacgggaccgaguucacguucgaaggcuccugcauguucccagacgggugugaugcggucgacugcaccuucugucgcgaguucuugaaaaacccccaaugcuacccagcaaagaaauggcuguuuaucaucaucguaauccuccuaggguacgccggacugaugcuacuaacaaacguccucaaagcaauaggcguauggggguccugggucauagcacccguaaagcuaauguucgcgauaaucaaaaagcucauaagaagcguaucuugccuaaugggcaaacuaauggaccgcggccgccaaguaauacacgaagaaaucggagaaaacagggagggaaaccaagacgacguacgaaucgagauggcccgcccacgaagaguaagacacuggauguacucuccaguuauacucacaaucuuggccaucggucucgcugaagguugugacgagaugguccacgcugacucaaagcuaguuucgugcaaacaaggguccggaaacaugaaagaaugcguaacuacaggccgagcacugcugccagccgugaacccgggacaagaagcaugccuccacuuuacagcccccgggucaccagacagcaaaugucuaaaaaucaaagucaaacgaauaaaucucaaaugcaagaaauccucaaguuacuucguaccugacgcgcgcagccgcugcaccagcguacgcagauguaggugggcaggagacugccaaagcggaugccccagccacuucacauccaacucguucucagaugacugggcggggaaaauggacagggccggacuaggcuucaguggcugcagcgauggcugcggaggagcagcaugcgguugcuucaacgcggcccccagcugcauauuuuggaggaaauggguggagaacccccaugguauaaucuggaaagucucaccuugcgccgcauggguacccucagcaguaaucgagcuaacuaugccaagcggagaagugcggacauuccaccccaugagcggaauacccacccaagucuuuaaagggguaucuguaacguauuuaggcucagacauggagguaagcgggcuaacggaccugugcgagauagaggaacuaaaaaguaagaaacuagcgcucgcacccugcaaccaagccggcaugggcguaguaggcaaagucggagaaauccaaugcucaucggaagaauccgcacgaacaauaaagaaagacggcugcaucuggaacgcugaccucguaggcaucgaacuuaggguagaugacgccguguguuacuccaaaauaacgagcguagaagccguagcgaauuacuccgcaauacccacgaccauaggcggacuccgcuucgagagaucccacgauagccaaggaaaaauauccggaaguccccucgacaucaccgcgauaagaggguccuucagcguaaacuauagaggccuucgauuaagccucagcgaaaucagcgccacaugcacuggcgaaguuacaaacgugaguggcugcuacagcugcaugacaggcgcgaaagucucaauaaaacuacacucgagcaaaaacucaaccgcucacguccgaugcaaaggggacgaaacagcguuuucgguccuggaaggcguacacagcuacaccguaucacucagcuucgaccacgcaguagucgacgagcagugccaacuaaauugcgggggacacgagucucaagugacacuaaaaggcaacuuaauauuccuagacgucccaaaauucguagacggcucauacaugcaaacauaccacuccucuguaccuacgggagccaauauccccagcccgacagacuggcuaaacgcacucuucggaaacggacuauccagauggauccucggagugauaggaguacuacuaggcgggcucgcccucuucuuccugauaaugagccuguucaagcucgggacaaagcaggccuuccggucaaggacaaaauuagcauag

SEQ ID NO: 16415 - RNA, 3222 nt, Artificial Sequence
  derived and/or modified CDS sequence (opt11) from SFTSV(KAGNH)__KU507550.1__GP
augaugaaagucaucugguucuccagccuuauaugcuuagucauacaaugcaguggagacacgggaccgauuauaugugcaggcccaauacacagcaauaaaagcgcgaacauaccgcaccuccugggauauucugagaaaaucugccaaauagacagacuaauacacgucaguucuuggcuaaggaaccacagccaguuccaaggguacgucggcagacgcggggguaggucccaggucucauacuucccggccgaaaacaguuacucgagauggagcggacuacugagcccuugcgacgccgacuggcuuggcaugcuagugguaaagaaagcaaagggaagcgacaugaucgugccagggccgagcuauaaaggcaaagucuucuucgaacgcccaaccuucgacggauacguuggcuggggcugcggaucgggaaagucacgaacugaguccggggagcugugcucgucagauagcgggaccaguagcggccuccugccaucggaccgcguccuguggauaggagacgucgcuugucagccuaugaccccgaucccagaagaaaccuuccucgaacucaagucauucagucaauccgaguucccugacauaugcaagaucgacggaauagucuucaaccaaugcgaaagugagagucucccgcagccauucgacguggcauggauggacguuggacacagccauaaaaucauaaugcgcgaacacaaaacgaaauggguacaggaauccagcucaaaagacuucguaugcuacaaggaggggacggguccgugcucggaaucggaagagaaaacuugcaaaacuagcggcucgugccgaggggacaugcaguucugcaaagucgccgguugcgaacacggugaagaggcaagcgaggccaaaugccgcugcagucuaguccacaaacccggggaaguagucgugucguacggaggcaugcgcguacgaccaaaaugcuacggguucucccgcaugauggcgacacuagaaguaaauccgcccgaacagcggauaggacaaugcacagggugccaccucgagugcauaaacgggggcgucaggcugaucacacuaaccagcgaacucaaaagcgcaaccguuugcgccucccacuucuguagcagcgcaacaagcgguaaaaagagcacugagauccaauuccacuccggcagccuagugggaaaaacagcaauccaugugaaaggcgcacucgucgacgguacagaguucaccuuugagggcagcugcauguuucccgacggaugcgacgccguagacugcaccuucugccgagaguuucuuaaaaacccccaaugcuacccagcgaaaaaguggcuauucaucaucaucgugauccugcucggguacgcaggacugaugcuccucaccaacgucuugaaagccauaggcguuugggggagcugggugauagcuccggucaaacucauguucgcgaucaucaagaaacuaauccgcagcguaucaugccugaugggaaagcuaauggaccgcggacgccaggucauacacgaggagauaggugagaaccgcgaaggaaaccaggacgacguaagaauagaaauggcgagaccaagaagaguacgacacuggauguacucaccagucauacucacaauccucgcaauaggacuggcagaagguugugaugagauggugcacgcggacucaaaacuggucagcugcaaacaaggcuccgggaacaugaaagagugcguaacaacaggccgggcucuacuaccggcagugaaucccggccaggaagcgugucuacacuucacggcgcccgggagcccagacucaaagugccuaaaaauaaagguaaaacguauaaaucuaaaauguaagaagucaucguccuacuucgucccggaugcaagaagccgcugcacaucaguccggcggugccgcugggcgggagacugccagagcggcugcccaagccacuucacgagcaacagcuucagcgacgacugggccgggaagauggaccgggcaggacugggguucucgggcugcagcgacgguuguggcggggccgccugcggaugcuucaacgcggccccaagcugcaucuucuggagaaaaugggucgagaacccgcacgggaucaucuggaaagucagccccugcgccgccuggguccccagcgccguaauagagcuaaccaugccaagcggagaggucagaaccuuccauccaaugagcggaaucccgacccagguuuucaaaggagugucagugaccuaccucggcagugacauggaagugagcgggcuaacagaccuaugcgaaaucgaggaacucaaaagcaagaaacucgcacuggcccccugcaaccaagcaggaaugggcguagugggaaaagugggagagauacaaugcuccucggaagaaucagcccggaccaucaagaaagacggcugcaucuggaacgccgaccugguagguaucgagcuuagggucgaugaugcgguaugcuacucaaaaaucacuucaguagaggcaguggcaaacuacucagcaauaccaacgaccauaggcggucugcgcuucgagcgaagccacgacagccaggggaaaaucucaggaagcccacuagacauaacggcgauccgaggcucauucucggucaauuacaggggacuucgccuaagccugagcgaaaucaccgcgacgugcaccggagaagucacgaacgugaguggaugcuacagcugcaugacaggggcgaaaauaaguaucaaacuccauucgaguaaaaacucgacggcacacguacgaugcaaaggugacgagaccgcauucagcguccuagaaggcguacacagcuacacaguauccuuaaguuucgaccaugccguggucgacgaacaaugccaacucaacugcggagggcacgaaucgcagguaacucucaaaggaaaccucauauuucuagacguaccgaaauucgucgacggcagcuacaugcaaacguaccacagcucagucccaaccggagcaaacaucccgagcccaacagacuggcuaaacgcauuauucggcaacggacuaucaagguggauacucggaguaauaggaguccuauuagggggucuagcacucuucuuccugaucaugagccuauuuaaacuaggcaccaaucaaguuuuccgcucaagaacgaagcucgcauaa

SEQ ID NO: 16416 - RNA, 3222 nt, Artificial Sequence
  derived and/or modified CDS sequence (opt11) from SFTSV(KAGNH4)__KU507551.1__GP
augaugaaggugaucugguucagcagccucauaugccucgucauccaaugcagcggcgacacaggaccuaucauuugcgccggaccaauacacucaaacaaaagcgcgaacauaccccaucuacucggcuacucggagaaaaucugccaaauagacaggcucauacaugugagcucauggcuccgcaaucacucgcaauuccagggguacguggggcaaagaggcggccggagccagguauccuacuucccggccgaaaacuccuauagucgcugguccggccuccugucccccugcgacgcggacuggcucggaaugcugguggugaagaaagccaaaggcagcgacaugauugugccaggaccauccuauaaaggcaaggucuucuucgaacgcccgacauucgacggauacgucggauggggcuguggaucaggaaaaagccggacagaaucaggggagcugugcuccagugauuccgggaccuccagcggacuguuacccagcgacagggucuuauggauaggcgacgucgcaugccaacccaugacacccaucccagaagaaacguuccuagagcucaagagcuucagccaaagcgaguucccagacauauguaaaaucgacggcauaguauuuaaccaaugcgaaagcgaaagucuaccccagccauucgacgucgccuggauggacgucggacacucccacaaaaucaucaugagagaacauaaaacaaaauggguacaagaaucaaguucuaaggacuucgucugcuacaaagaaggaacaggacccugcuccgaaagugaagaaaagacaugcaaaaccagcggcuccugcagaggagacaugcaauucugcaaaguagcuggaugugaacacggcgaagaagccagcgaagcgaaaugccgaugcucgcucguccacaaaccaggagaggugguagucucguacggcggaaugcgaauacgaccaaaaugcuacggauucucacguaugauggccacccucgaaguuaaucccccagaacaaaggaucgggcagugcaccgguugccaccuagagugcauaaacgggggcguacgcuugaucacacuaacaagcgaacuuaaaucagcaaccguaugcgccucccacuucugcucaagcgccacaucaggcaaaaagagcaccgaaauucaauuucacagcggaucccuggucggcaagacugcgauucacguuaagggagcgcuaguagacggaaccgaguucacguucgaaggaagcugcauguucccggacggaugcgacgcaguggauugcacauucugcagagaguuccuaaagaacccccaaugcuauccggccaagaaauggcuuuucauaauaaucguaauacugcuagguuacgccggccuaaugcuacucacaaacguacuaaaagccauaggcguauggggguccuggguaaucgccccagugaaacuaauguuugcgauaaucaagaaacucaugcgcucagucucaugccucaugggcaaacucauggaccgagguagacaaguuauccacgaagaaaucggcgaaaaccgggaagggaaccaagacgacguccgaauagagauggcgcggccccgccgagugagacacuggauguacagcccaguaauacucacuauacucgcaauaggccuagccggcgguugugacgaaaugguacacgcugacucaaaacuuguaucaugccgacaaggaagcgguaacaugaaagaaugcgugaccacgggacgagcccuccuaccagccgucaacccgggccaggaagcaugccuucacuucacagcaccaggaucaccagauucaaaaugccucaaaauucgagucaaacgcaucaacuugaaaugcaagaaaagcaguuccuacuucguaccagacgcgcgcagccgaugcacgaguguccgaagaugcagaugggcaggcgacugccaauccgggugcccaucccacuucacaucuaacaguuuuucagacgacugggccgggaaaauggacagagcgggccuugguuucagcggcuguagcgacggguguggcggggcagccugcggaugcuucaacgcagcaccuagcugcaucuucuggcggaaauggguagaaaacccccauggcaucauauggaaagugucaccaugcgcagccugggucccaagcgccguaaucgaacucacgaugccaagcggggaaguaagaacauuccaccccauguccgggauaccgacccagguauuuaaaggcguaucgguaaccuaccucggcucggacauggaaguaagcgggcugacagaccugugcgaaauagaagaacuaaaaucccgcaaacuagcacuagccccaugcaaccaagcagggaugggggucguggguaaagugggagaaauacaaugcucaagugaagaaucagcacgcacuaucaagaaagacggguguaucuggaacgccgacuugguugggauagaacucagagucgacgacgcagucugcuacuccaaaauaaccagcguggaagccgucgccaacuacagcgccauccccacgaccauaggaggcuuacgguucgaaagaucacaugacagccagggcaaaaucagcggaagcccccuagacauaacagcaauaaggggcuccuucucaguuaacuaccgcggacuacgacucagccucucagaaauaaccgcgacguguacaggugaagucacgaacguauccggcugcuacagcuguaugacuggcgccaaaguauccaucaaacuacauucgaguaaaaauucgaccgcccacguaagaugcaaaggggacgaaacagccuucagcguacuagaaggggugcacagcuacacagucagccugagcuucgaucacgccgugguggacgaacaaugccaacucaacugcggcggacacgaaucccaagucacccuaaaggggaaucuaauauuucucgauguaccuaaauucgucgacggcucauacaugcagacguaucacuccucggucccgaccggcgcgaacauaccaagcccuaccgacugguuaaacgcccucuucggaaacggacuuucuagguggauacuuggugugaucggaguauuacucggaggccucgcacucuuccuccucaucaugagccuauucaaacugggcacgaagcaagucuuccgcagcagaacaaaacucgcguga

SEQ ID NO: 16417 - RNA, 3222 nt, Artificial Sequence
  derived and/or modified CDS sequence (opt11) from SFTSV(KAGWH2)__KU507564.1__GP
augaugaaaguaauaugguucagcucccucauaugccugguaauacaaugcggcggggacacagguccaauaauaugugcaggcccaauccacagcaacaaaucggcgggaauaccccaccuacuaggauacucagagaaaaucugccaaauagaccggcucauacacgugagcuccugguuacgaaaccacucacaauuucaaggcuacgugggccaacgcgggggacgaucacaaguaucauacuaccccgcggagaacagcuauuccagauggucaggauuacucucgcccugcgacgcagacuggcuagggaugcuuguagugaaaaaggcaaagggcagcgacaugauugucccuggacccucuuacaaaggaaaagucuucuucgaacgaccuacauucgacggguacguaggcuggggcuguggaucaggcaagucucgaaccgaaaguggggagcugugcucgagugacagcggaaccucaaguggccuacugccuagcgaccggguccuauggaucggagacgucgcgugccaaccaaugaccccgauaccagaagaaaccuucuuagagcuaaaaaguuucucccagagugaguucccagacgugugcaaaaucgacggcauaguauucaaccaaugcgaaggagaaucacuaccacagccauucgacguggccuggauggacguaggacacucacacaaaaucauaaugagggaacacaaaaccaagugggugcaggaaucgagcuccaaagacuucguaugcuacaaagaaggaacgggcccaugcucggaaucagaagaaaagacaugcaagacaucgggcagcugcaggggcgacaugcaguucugcaaaguagcaggaugcgagcacggggaagaggccucugaggcgaaaugccgcugcagccuuguccacaaaccuggcgaagugguggucaguuacggaggaaugagagucagacccaaaugcuacggcuucagcagaaugauggcaaccuuagaagugaauccgccggagcaaagaaucgggcaaugcaccggaugccauuuagaaugcauaaaugggggaguacgccucauuacgcucacgucagagcuaaagagcgccaccgugugugcaagccacuucuguaguucagcaacgagcgggaaaaagagcacagaaauucaauuccacucaggcucacuggugggaaaaacggcgauccauguaaaaggagcccugguggacggaacagaguucacguucgaaggcucaugcauguucccagacgggugcgacgccguagacuguaccuucugccgagaguuccuaaagaacccgcaaugcuacccagcaaagaaguggcuauucauaauaauuguaauuuugcucggguacgcgggccuaaugcugcucacaaacguacucaaagcaaucggcguaugggggagcugggucauugcaccgguuaaacuuguguucgcgaucaucaagaaacugaugagggcggucagcugccugaugggaaaacugauggaucgagggcgccagguaauacacgaagaaauaggcgagaauagggaaggaaaccaggacgacgugcggaucgaaauggcacguccgcgacggguaagacacuggauguacaguccagucauccugacgauccuggcgauaggccuagcagaggggugcgacgaaaugguucaugcggacucaaagcucgucuccugccgccagggauccggaaacaugaaggaaugcguaacuacaggccgugccuuacucccggcugugaaccccggccaggaagcaugccuccacuucaccgccccaggaagcccggauagcaaaugccugaaaaucaaggucaagcgcaucaacuugaaaugcaagaagaguucguccuacuucgugcccgaugcacggagccgaugcacgagcguaaggcgcugcagaugggcgggcgauugccagagcgggugcccaccgcacuuuacguccaacagcuuuucggaugacugggccgggaaaauggaccgagccggccucggcuucagcgguugcagugacggcugcggaggggcggcgugugggugcuucaacgccgccccgagcuguauauucuggagaaaaugggucgagaacccgcacggaaucauauggaagguuucaccuugcgccgcaugggugccgagcgcagucaucgagcuaacaaugccgagcggggagguaagaacauuccacccaaugagcggaaucccaacacaagucuucaagggggucucgguaaccuacuugggcuccgacauggaagugagcggccucacggaccucugcgagauagaggaacucaaaucgaaaaagcucgcacucgcaccaugcaaucaagcaggcaugggggucguaggcaaagucggggaaauacaaugcucaagcgaagagagcgcccgcacgauaaagaaagacggcuguaucuggaacgcagaccuagucgggaucgagcucagagucgacgacgcaguuugcuacucgaaaaucaccucaguagaggcgguugcaaacuacucagccauaccaacgacaauagguggacucagguuugagcgcagccacgacagccaggggaaaaucucggguucaccucuggauaucacggcgaucagaggaucauucucaguaaauuacagaggccuaagacucucccucagcgagauuacagccacaugcaccggcgaaguaacgaacgugagcgggugcuacucauguaugacaggugcaaaagucagcauaaaacuacacucgagcaagaacagcaccgcacacguaaggugcaaaggggacgaaaccgccuucucgguacuggaagggguccacagcuacucaguaucgcuauccuucgaccaugccgugguggacgaacaaugccagcucaacugcggaggccacgaaucacaaguaacucuccgcggaaaccugauuuuccuugacguaccgaaguuuguagacggcucuuacaugcaaacguaccacagcacggucccgaccggggcaaacauaccaaguccaacagauuggcugaacgcgcuauucggaaacggauuaagccgauggauacucggagucaucggcgugcuacuaggagggcucgcacuauucuucuugauaaugagccuauucaaacucgggacaaagcaaguauucagaagcaggacaaagcuagcguga

SEQ ID NO: 16418 - RNA, 3222 nt, Artificial Sequence
  derived and/or modified CDS sequence (opt11) from SFTSV(KAGWH3)__KP663735.1__GP
augaugaaaguaauaugguucagcucacugauauguuuagugauccaaugcaguggcgacacgggcccaaucauaugugcagggccgauccacagcaacaagagcgccaacaucccgcaccuccuaggauacucagagaagauaugucaaaucgacagauuaauacacguuagcagcuggcuacgcaaccacucacaguuccaagguuauguaggccaaaggggaggacggucccaagucucguauuuuccugcggaaaacaguuacuccaggugguccggacuacuaucaccaugcgacgcagacuggcucggaaugcuuauagucaagaaagcgaaagggagcgacaugaucgugcccggccccuccuacaaaggcaagguauucuuugagcgaccaaccuucgauggcuacgucggauggggaugcggauccggcaaaagcaggacagaaagcggggaauuauguucuuccgacucaggcacaaguagugggcuacucccaucagacagaguccuguggauaggagacgucgcaugccagccgaugaccccgauacccgaagagaccuuccuagaacucaaaucuuucagccaaagcgaguuccccgacaucugcaaaauagacggcaucgucuucaaucaaugcgaaagcgaaucacuaccacaaccuuucgacguagccuggauggaugucggucacagccacaaaaucaucaugcgagaacacaaaaccaaguggguccaagaaagcagcuccaaagacuucgucugcuacaaagagggaaccggcccaugcuccgaaagcgaagaaaagacgugcaaaacaagcgguucaugcagaggggacaugcaguucugcaagguagccggcugcgagcacggagaagaagcuagcgaagcaaaaugcagaugcagucuaguccacaaaccgggggaaguuguaguauccuacggagguaugaggguuaggcccaaaugcuauggauucagucgcaugauggccacacuggaaguuaaucccccagaacaacgaauaggacaaugcacaggcugccaccucgaaugcauaaacggcggcguacgccuuaucacacugacaucggaacuaaaauccgccaccgugugcgcaagccacuucugcuccucagcgacauccgguaagaaaagcaccgaaauacaguuccacucagguagccucgucggcaaaaccgccauucacguaaaaggcgcgcuaguagacgguacagaguucacauuugaaggguccugcauguucccggacggcugcgacgccguagacugcacauucugccgcgaguuccuuaaaaacccacaaugcuaccccgcuaagaaaugguuauuuauaaucaucguuauccuacuaggauacgcgggcuuaaugcuacuaaccaauguccucaaagccaucggggucuggggaaguuggguaauagccccaguaaaacuaauguucgccauaaucaagaaacuuaugcgcagcgucucaugccuaaugggaaaacucauggaucgaggacggcaaguaauacacgaagagauuggcgaggucagggagggcaaccaggacgacguccggaucgaaauggcacgaccuagacgaguccgacacuggauguacagcccagucauacucacuauccucgcgaucggacucgcagaggggugcgacgagauggugcacgcggacuccaaacucgucuccugcaaacaaggcucgggaaacaugaaagaaugcguaacaaccggacgagcccuacuacccgccguaaaccccggacaagaagcaugccuacacuucacggcaccgggaucacccgacucaaaaugccucaaaauaaaaguaaagaggauaaaccugaaaugcaagaaauccagcagcuacuucgucccugaugcccguagccgcugcaccaguguacguagaugccgcugggcaggagacugccaauccgggugcccgagccacuuuaccagcaacagcuucagcgacgacugggcaggcaaaauggacagagcaggccugggcuucagcggaugcagcgacggcugcggcggcgcagcgugcggaugcuucaacgcagccccauccuguauauucuggcgaaaaugggucgaaaauccacacggcauaaucuggaaaguuagcccaugcgcagccugggugccgucggcagucaucgaacugaccaugcccucaggagaaguaagaaccuuccacccaauguccggcaucccgacacaagucuucaaaggggucagcgucacauacuuagguagcgacauggaaguaagcggacuaacggaucucugcgagaucgaagaacugaaaagcaagaaacucgcgcucgcaccaugcaaccaggcaggaauggggguaguagggaaaguaggcgagauucaaugcagcucagaagagucagcacgaaccauaaagaaagacggaugcaucuggaacgccgaccuggucggaauagaacucagaguggacgaugcaguaugcuacagcaaaaucaccuccguagaagcgguugccaacuacucugccauaccgaccaccauaggcgggcugcgauuugagagaagucacgacucccaaggcaaaaucucagguagcccgcuagacauaacagcuaucagaggauccuucuccgucaacuaccgcggacucagacucagccucagcgaaauaacagcgacguguacaggagagguaacaaauguaagcggcugcuauucaugcaugaccggcgcaaaggucaguauaaaacuccacagcuccaaaaacagcacagcacacgugcgaugcaaaggugacgaaaccgcauucagcguccucgagggcguacacagcuauacagugucccucagcuucgaccacgccgucgucgacgaacaaugccagcuaaacugcggcggccacgaaucacaagucacgcuaaaagguaaccuaaucuuccucgacguacccaaauucguagacggcucauacaugcaaacauaccacagcagcguaccaacgggagccaacauuccauccccaaccgacuggcucaacgcccuauucgggaacggucuaagccgcuggauacuagggguaauaggcgugcuacucgggggacuagcccucuucuuccucaucaugagccucuuccgacucggaacaaaacaagucuuccgcucucgaaccaagcuagccuag

SEQ ID NO: 16419 - RNA, 3222 nt, Artificial Sequence
  derived and/or modified CDS sequence (opt11) from SFTSV(KAICH)__KU507565.1__GP
augaugaaaguaaucugguucagcagcuuaaucugccucgugauccagugcggaggggacacaaguccuaucauaugcgcaggcccaauccacucgaauaaauccgcagacauuccgcaccuucuaggcuacuccgagaaaaucugucagauagacagacuuauacaugucucgucauggcuccgcaaccacagccaauuucaagguuacgucgggcagcgaggcggccggucucaagucucauacuaucccgccgaaaacagcuacuccagguggucaggccuacucagcccgugugaugcggacuggcuaggaaugcuggucguaaagaaagcgaaaggcucagacaugaucguacccggacccuccuacaagggaaaaguauucuucgaacgacccaccuuugacggcuacgucggauggggaugcggcucagggaaaucccggacggaaagcggcgaacucugcucuagcgacucugggacgucauccggacucuuaccguccgacagggugcuguggauaggcgacguagcgugccaaccaaugaccccaaucccagaagagacauuccuagaacuaaaaucauucagccaaagcgaguuccccgauaucugcaagaucgauggaauugucuucaaccaaugcgaaggagaaagccuaccucaaccauucgauguagcguggauggaugucggccacucacacaaaauaauaaugagggaacacaaaacaaaauggguccaggaaucaagcagcaaagacuucgugugcuacaaggaaggaaccggaccuugcuccgaaucagaggagaaaacaugcaagacaucgggaagcugcagaggagauaugcaauuuugcaagguggcugggugugagcacggggaggaagccucagaagcaaaaugucgcugcucacucguacacaaacccggcgaggucguggucucauacggaggcaugcgaguacgaccgaaauguuacggauucucacgaaugauggccacccucgagguaaaccaaccagaacaacgcaucggucagugcaccggcugucacuuagaaugcauaaguggaggcgugcggcucaucacgcucacuuccgagcuuaaaagcgccacaguaugcgcaagccacuucugcagcagcgccacguccggcaagaaauccacagagauacaauuccacagcggaagccugguaggaaaaaccgcgauccacgucaaaggagcccucgucgacggaaccgaguucacauucgaaggcucaugcauguucccggacggaugugacgccguagacugcacguucugcagagaauuucuuaaaaacccacaaugcuaccccgcaaagaaauggcucuuuaucaucauagugauacuacuaggauacgcaggucucaugcugcucaccaauguacucaaagccauaggcgucugggggagcugggugaucgcgcccgucaaauuagucuucgcaaucaucaaaaagcugaugcgcgcggucuccugcuugauggggaaacucauggacagaggacgccaggucauacacgaggaaaucggggaaaaccgcgagggaaaccaagacgacguacggaucgaaauggcacgcccacgccguguaagacacuggauguacagccccgugauacuaaccauacucgcaauaggcuuagccgaaggcugcgacgaaaugguacacgcggacuccaagcuagucucaugccgacaaggaucaggcaacaugaaagaaugcguaaccaccggcagagcccugcuaccagccgucaaccccggccaagaagcgugcuuacacuucaccgcgcccggguccccggacucaaaaugucugaaaaucaaaguuaaacgaauuaaccucaagugcaagaaauccucaagcuacuucguccccgaugccagaagccgcugcaccuccguacggcgaugcagaugggcgggggacugccagucuggaugcccgccccacuucacuagcaauucauucucugacgacugggcagguaaaauggacagagcaggacucggauucucaggcuguagcgacggaugcggcggcgcagcuuguggaugcuucaacgcagcucccagcuguaucuuuuggcgaaaauggguagaaaacccccacggcauaauauggaagguaucccccugcgccgccuggguccccucagcagucaucgaacuaacaaugccuuccggcgaaguaagaaccuuccaucccaugucugggauacccacacaagucuucaaaggaguaucaguaacauaccuaggauccgacauggaaguaagcggacucacggaccucugugagauggaagaacugaaaucgaaaaagcucgcuuuagcaccauguaaccaagccggcaugggagucguggggaaaguuggugaaauucaaugcagcucagaagaaagcgcacgcaccaucaagaaagacggcuguaucuggaacgcagaccucgucggcauagaacuccguguggacgacgcagucugcuacaguaaaauaaccucaguugaggcaguaaccaacuacucagcaaucccaaccaccaucggagggcucagguucgaacgaucccacgauagccaaggcaaaauaucaggaucaccgcucgacauaacggccauaagaggcagcuucucaguuaacuaccgcggacucagacucucccuguccgagaucacagcgaccugcaccggagaaguaacgaacguaagcgggugcuacaguuguaugacaggugcgaaagucagcauuaaacugcacucauccaaaaacucgacagcacacgugcgaugcaaaggcgacgaaaccgccuucucuguccuagagggaguccacagcuacagcgucagccuaucauucgaccacgcaguaguagacgaacaaugccaacuaaacugcggcggccacgaaagcaagguaacccucagagggaaccucaucuuccuugacguaccaaaauucgucgacggcagcuacaugcaaaccuaccacagcacagucccaacuggggccaacaucccguccccgacggacuggcuaaacgcccucuucggcaacggacugucgaggugguuccuuggagucauuggaguacuacucgggggacucgcacucuucuuccugaucaugagcuuauuuaaacuagggacaaaacaaguguuuaggucaaggucgaaacucgccuag

SEQ ID NO: 16420 - RNA, 3222 nt, Artificial Sequence
  derived and/or modified CDS sequence (opt11) from SFTSV(KAJJH)__KU507566.1__GP
augaugaaggucaucugguuuagcucacuaaucugccuggugauacaaugcuccggagacacuggccccaucaucugugccgggcccauacacagcaacaagagugcaaacaucccacaccuacucggcuacagugaaaagaucugucaaaucgaccgccucauccacguaagcucauggcugcguaaccacucccaauuccaggguuaugucggacaacgcgggggcagaucccaagucucauacuaccccgcagaaaauucauacucacgauggucuggccuacuaucacccugcgacgccgacuggcugggaaugcucgucgugaaaaaggcgaagggcucggacaugauaguaccagggccaaguuacaagggcaaaguuuucuucgaaagaccaacauucgauggauacgugggcuggggaugcggaucaggcaagagccgcaccgaguccggagagcucugcucaagcgacagcggaacgagcagcggacuccuacccucgaaccggguacuauggaucggagacguggcuugccaaccuaugacuccaauccccgaagaaaccuuccuagagcuaaaaucuuucagccaaagcgaguucccggacauaugcaagauagauggaaucguauucaaccaaugcgagagcgaaagccucccacagcccuucgacguagcauggauggaugucgggcacagucacaaaauaaucaugagagagcacaaaacaaaaugggugcaagaaucaagcucaaaagacuucgugugcuauaaagaaggcacaggaccgugcucggagagcgaagaaagaaccuguaaaaccucagggagcugcagaggagacaugcaauucugcaaggucgcaggaugcgaacacggagaagaagccagcgaagcaaaauguaggugcagccuaguccacaaaccaggagaagucguagugucauacggaggaaugagagugaggcccaaaugcuacggcuucagccgaaugauggccacccuagaaguaaacccaccagaacagaggaucggccaaugcaccggaugccacauagaaugcauaaacggaggcguacgccucaucacacucacaagcgagcuaaagagcgccaccguaugcgccucacacuucugcaguucagcuacgagcgggaagaaauccaccgaaauccaguuucacagcgggucgcuggucgggaaagcugcaauccacguaaaaggggcgcuagucgacggaaccgaguucacauucgaaggauccugcauguucccagacggcugugaugccgucgacugcaccuucugccgcgaauuucucaaaaacccacaaugcuauccagccaagaaauggcucuuuauaauuauaguaauacuacuaggcuacgcaggccuaauguuacucacgaacgugcucaaagcaauaggaguguggggauccuggguaaucgcgccaguaaaacuuauguucgccaucauaaagaaacuaaugcggagcguaaguugccugauggggaaacugauggacagaggcagacaggugauacacgaagagauaggagagaacagggaaggaaaccaggacgacgucaggauugaaauggcacgaccaagacgaguaaggcacuggauguauuccccagucauccucacaauccucgcaaucggacuagccgagggaugcgaugaaaugguccacgcggauagcaagcuggucagcuguagacaagggggaggcaacaugaaggagugugucaccacagggagagcacucuuacccgcaguaaacccaggacaggaagccugucuucacuucacggcaccaggaagccccgacaguaagugccuaaagauaaaagucaagcgaauaaaccuaaaaugcaaaaagagcucaagcuacuucgucccugacgcaaggucaagguguacgagcgucaggcgcugccggugggcaggggacugccagagcggaugcccgagccacuucacuagcaacagcuucagcgacgacugggcaggaaagauggacagagccggccugggcuucagcggcugcagcgacggcugcggaggagcagccugcggaugcuucaaugccgcacccaguugcaucuucuggagaaaaugggucgagaacccccacgggauaauauggaaaguaucgcccugcgccgcguggguccccagcgcaguaauagaacucaccaugccauccggagaagugagaacauuccacccaauguccggcaucccaacacaagucuucaagggagugucuguaacauacuuaggaucggacauggaaguaagcgggcugacagacuugugcgaaaucgaggaacuaaaaucaaagaaacucgcgcucgccccgugcaaccaggcagggaugggcgugguaggcaaagucggggaaauccaaugcagcagugaagaaucagcucguacaaucaaaaaggacggcugcauauggaacgcggaccuggucgggauagaacucagaguagacgacgcagugugcuacucaaagaucaccucagucgaagcgguagccaauuacucagcaauacccacgacgauaggaggacuacgauucgagcgaagccacgauucccaaggaaagauaucagggaguccacucgacauaacagccauacggggaaguuucagcguaaacuaccggggccuaagacugagccuguccgaaauaacggcgaccugcacaggagaagugacaaacguauccggaugcuacagcugcaugaccggcgccaaagugagcaucaaacuacacaguaguaagaacagcaccgcacauguaagaugcaaaggugacgagaccgccuucagcguacucgaaggcgugcacucguauaccgugucacucuccuucgaccaugccguagucgacgagcagugccaacucaacugcgggggccacgaaagccaagucacccuaaagggaaaccugaucuuucuggacgucccaaaauucgucgacggcuccuacaugcaaacguaccacagcucaguaccgaccggagccaacaucccguccccuacggacuggcucaacgcacuauucgggaacggacuaagcagauggauacucggaguuauaggugugcuacucggcggacucgcccucuucuuccucauaaugagccucuucaagcuaggaaccaagcaggucuuccgaagcagaacaaaacuagcguga

SEQ ID NO: 16421 - RNA, 3222 nt, Artificial Sequence
  derived and/or modified CDS sequence (opt11) from SFTSV(KAJNH2)__KU507552.1__GP
augaugaaggucaucugguucagcucccucauaugccuggucauucaauguaguggggacacaggcccaaucaucugcgcgggacccauccacucuaacaaaucagcaaacauaccacaucuccuaggcuacucagagaaaaucugccagauagauagacugauccacgugagcucuuggcugcgcaaccauucacaauuucaaggcuacguaggacagcgaggcgggcgaucgcaaguaucauacuacccagcggagaacaguuacagcagauggucgggccuacuaucccccugcgacgcggacuggcuggggaugcuggucuuaaagaaagccaaagaaagcgacaugaucgugcccggacccagcuacaaaggcaaagucuuuuucgaacgacccaccuuugacggauacgugggcuggggguguggauccggaaaaaguagaaccgagagcggggaguugugcuccagcgauagcggcaccucaagcgggcuccugccguccgaccgaguacuguggaucggcgacguagccugccaacccaugaccccaauuccggaggagacauuccuggaacucaaaucuuucagccagucagaguuccccgacaucuguaaaauagacggcauaguuuucaaucagugcgaaagcgaaagucuaccgcaaccauuugacgucgcuuggauggacguaggccacucccacaagaucaucaugcgagaacacaaaacaaaaugggugcaagagucaagcucuaaagauuucguaugcuacaaagaaggcaccggccccugcuccgaaucggaagagaaaacaugcaaaaccucagggucgugccgaggagacaugcaauucugcaaaguagcaggaugcgaacacggagaagaagcaucagaagcaaaaugcagaugcucccucguccacaaaccaggagagguagucguauccuacggaggaaugcgaguaagaccgaagugcuacggcuucucgcgcaugauggcgacacuagaaguaaacccgccugagcagagaauaggacaauguacgggaugccacuuggaaugcauaaacggaggggugagacucaucacacuaacaagcgaacugaaauccgcgacagugugcgcgagccacuucugcagcucggccacgagcggcaagaaaagcacggaaauacaauuccacucaggcucacuugucggcaaagccgcaauccacgucaaaggggcccuaguggacggcaccgaguucacauucgaggguucuuguauguuccccgacgggugcgacgccguggacugcaccuucugcagggaguuccucaaaaacccacaaugcuauccagcaaagaaauggcuguuuauaaucauagucauacugcucggauacgccggauuaaugcugcugacaaacguccuaaaagccauaggagucuggggcucguggguuauagcaccggucaaacuaauguucgccauaaucaagaaacucaugagaucagugucgugccugaugggaaaacuuauggaucgggggcggcaaguuauucacgaagaaauaggcgaaaacagggaaggcaacagagaugacgucagaaucgaaauggcccggccaagaaggguaagacacuggauguauaguccgguaauacuaaccauacucgccauuggccuggcggaaggaugugaugaaaugguacacgccgacagcaagcuaguaucgugcaggcaaggaagcggaaauaugaaagaaugcguaacaaccgguagagcacuccuccccgcuguaaacccaggacaggaggcgugucuccauuucacagcccccggaagccccgauucuaaaugccucaaaaucaaaguaaaacgaaucaaccucaaaugcaagaaauccucgaguuacuucguaccugacgccagaagcagaugcaccaguguuagaaggugcagaugggcgggagacugccaaagcggaugccccagccacuucaccagcaacucguucagcgaugacugggccggaaaaauggacagggcaggacuaggguucagcggaugcagcgacggcugcgggggugccgcaugcggcugcuuuaacgcagcccccuccugcauauucuggaggaaguggguagaaaacccccacggaaucauauggaaagugagccccugugcugcaugggugccaucagcggugauagagcuaacaaugccaucaggagaaguucgcaccuuccacccaaugagcggaauccccacccaagucuucaagggggucuccguaacauaccuaggaagcgacauggaaguaucagggcuaacagaccucugcgaaaucgaggaacuaaaaagcaagaaacuagcgcuugcacccugcaaccaagccggaaugggggucgucggaaaagucggcgaaauccaauguucuucagaagaaagcgccagaacgauaaagaaagacgggugcauuuggaacgccgaccuagucggcauagagcucagagucgacgacgcgguaugcuacagcaaaaucacauccguagaagcaguagcaaacuacagcgccauccccaccaccaucggcggacuacgcuucgaacggucacacgacagccaagggaaaaucaguggaucgccccucgacauaaccgcaauacgagggagcuucucgguaaacuaucgaggacucaggcuaucgcucagcgaaaucacagcaaccugcaccggcgaagucacaaacguaagcggaugcuacagcugcaugaccggggccaaaguaagcauaaaacuccacucaaguaaaaacagcacggcacacguccgaugcaagggagacgagacagccuucagcguacuagaggggguccacagcuacaccgucucccucucauucgaccacgcgguagucgacgaacaaugccaauugaacuguggcggacaugaaucucaagucacacucaaaggcaaccugauauuucuagacgucccaaaauucguggaugggagcuacaugcaaacauaccacagcuccgugcccaccggggccaacauacccagcccaacggacuggcuaaaugcccucuucggcaacggccuaaguagauggauccucggaguaauaggcgugcuacucggugggcuagcucucuucuuucuaauaaugucacuauucaaguuagggacaaaacaagucuucaggagccgagcgaagcuagcauga

SEQ ID NO: 16422 - RNA, 3222 nt, Artificial Sequence
  derived and/or modified CDS sequence (opt11) from SFTSV(ZL13-32)__KU361342.1__GP
augaugaaagucauaugguucagcucucuaauaugcuucguaauacaaugcagcggagacagcggcccgaucaucugcgcgggccccauccauagcaacaaaucggccgacaucccacacuuacucggauacagcgaaaagauuugccaaauagaccgacuuauacacgucagcagcugguuacgcaaccauagccaauuccaaggauacgugggccaacgcggcggccgcucccaagucucauacuaccccgccgaaaauagcuacuccagguggagcggacugcucucacccugcgacgcugacuggcuggguaugcucgucgucaagaaagcaaaaggcucagauaugaucgugccaggcccaaguuacaaagguaaagucuuuuucgaaagaccgacauuugauggauacgucggcuggggcugcggcucaggcaaaagcagaaccgagucaggcgaacucugcagcagcgacuccggaacaucgagcggacugcugcccucagaccgcguacuauggauaggcgacgucgcgugccaacccaugaccccaaucccggaagaaacauuccuugagcuaaagagcuucucccaaucagaguuccccgacaucugcaaaauagacggcauugucuucaaccagugcgaaggagagucccucccgcagcccuuugacguggcauggauggacguaggccacucgcacaaaauaaucaugagagagcacaaaacaaaguggguccaagaguccucaaguaaagacuucgucugcuacaaagaaggcaccggccccugcuccgagagcgaggagaaaaccugcaagacaucagggagcugcaggggagacaugcaguucugcaaaguagcaggaugcgaacacggagaagaagcaagcgaggccaaaugccgcugcucccucguucauaaaccaggagaaguugugguaucguacggaggaaugagaguacgaccgaagugcuacggauucucacgcaugauggcaacccuagagguaaaccagcccgagcagagaaucggccaaugcaccggaugccaccuagagugcaucaacgggggcguucgccucaucacacugacgagcgaacucaaaagcgccacggugugugccagccacuucuguuccuccgccacuuccgguaaaaagagcacagaaauacaauuccacucgggaagccuaguaggcaaaacagcaauucacguaaaaggagcgcucguagacggcacagaguucacauucgaaggaucaugcauguuccccgacgggugcgaugcagucgauugcacauucugcagggaguuccucaaaaacccucagugcuacccagcuaaaaagugguuauuuaucaucauaguaauauugcuaggcuacgcaggacugaugcuucuaaccaacgugcucaaagccaucggaauauggggauccugggucauagccccagucaaacuaauauucgccauaauaaagaaacugaugcguacgguaucgugccucaugggaaaacugauggaccgaggccgccaaguaauacacgaagaaaucggagaaaaccgagaaggaaaccaagacgacguccgaaucgaaauggcgcgcccccgacgcgucaggcauuggauguacucccccgucauccuaacgauccuagcaaucggccuagccgagagcugcgacgaaauggugcacgcagacucaaaacucgucagcugcaggcaagggagcggcaacaugaaagagugcguaacaaccggucgcgcccuucuacccgccgugaacccaggccaagaagcgugccuccacuuuacggcaccaggaaguccagacuccaaaugccuaaaaaucaaaguaaaacgaauaaaccucaaaugcaagaaaagcucaagcuacuucgugcccgacgcccgcucacgcugcacgagcguccgccgcugcagaugggcgggcgacugccaaaguggaugcccaccacacuucacuagcaacagcuucucagacgauugggccgguaaaauggacagggccgggcuagguuucuccggauguucagacggaugcggaggggccgcaugcggcuguuucaaugcagccccaagcugcaucuucuggagaaaaugggucgaaaacccacacggaaucauauggaaagucucacccugcgcagcaugggucccuagcgccgugaucgaacuaaccaugccguccggggaaguacggaccuuucaucccaugagcggcauuccaacacaagucuucaaaggcguaagcguaacauauuuaggcagcgacauggaggucagcggccucacagaccucugcgaaaucgaggaacucaaaucgaagaaacuagcccuggcaccaugcaaccaagccgggaugggcgucguaggaaaagucggggaaauacaguguucuucagaagaaagcgcacgaacgaucaagaaagacgggugcaucuggaacgccgacuugguugguaucgagcugcgagucgacgacgcggucugcuauucgaaaauaacauccguagaagcagucgcaaauuacuccgccauucccacaacgauaggcggucugagauucgaacgcucacaugacagucaagguaaaaucucaggcaguccccuagacauaacagcaauccgggggucguuuagcgucaacuacaggggacuacgacuaagucuaagcgaaauaaccgcaacaugcacaggcgaggucaccaacgucagcgggugcuauagcugcaugacaggcgccaaagucagcauaaaacugcacucuaguaaaaacagcacggcacacguaaggugcaaaggagacgagacagcuuucucaguccucgaaggcguccacagcuacaccgucucacucagcuucgaccaugcaguaguggaugaacagugccaacugaacugcggcggccacgaaucacaagucacccuaaaaggcaaccucaucuuucuagacgugccaaaauucgucgauggcagcuacaugcaaacauaccacagcacagucccaacuggggcuaacauacccagccccacggauuggcucaacgcgcuguucggcaacgggcugucacguuggauacuuggagucauaggaguccuccucggcggacuagcacucuucuucaugaucaugagucuauuuaaacuaggaacaaaacaagucuucagaagucgcacuaaacuagcguga

SEQ ID NO: 16423 - RNA, 3222 nt, Artificial Sequence
  derived and/or modified CDS sequence (opt11) from SFTSV(AHL/China/2011)__JQ670930.1__GP
augaugaaagucauaugguuuuccagucuaauaugucucgucauccaaugcagcggugauacaggaccgaucauaugcgcaggaccuauccacagcaacaaauccgccgacaucccacaucuccucggauacagcgagaaaaucugccagauagaccggcuaauacacguuaguuccuggcuacgaaaccacucacaguuccaaggcuacguaggacaaagagguggaagaagccaggucuccuacuacccggccgaaaacucuuauagucgaugguccggccuccuaucccccugugacgcugacuggcucggaaugcuugucgugaagaaagccaaagguuccgacaugaucguccccggccccucauauaagggcaagguauucuucgaacgaccaacauucgacggguacguaggcuggggcugcggaagcgguaagucccgaacggaauccggggaauugugcucgagcgacagugggacauccucgggacuccucccuuccgaccggguacuauggauaggagacguagcuugccaacccaugacccccauacccgaagaaacauuccuagaacucaagagcuucucccagagcgaguucccagacauaugcaaaaucgacggcaucguauucaaccaaugcgaaggcgagagccucccucagccguucgauguagccuggauggacguaggucacucacacaaaauaaucaugagggaacacaaaaccaagugggugcaagagaguagcuccaaagacuucguaugcuacaaagagggcacaggucccuguagugaguccgaagagaaaacgugcaagacuagcggcagcugccggggcgacaugcaauucugcaaggucgcaggaugcgaacacggggaagaggcauccgaagccaaaugucgaugcucgcuuguucauaaaccgggcgaagucguaguguccuacggaggcaugaggauacggcccaaaugcuacggauucuccagaaugauggcaacacuagaaguuaacccgcccgaacaacgaaucggacagugcaccggaugucaccuagaaugcaucaacggcggcgugagacuaaucacucucaccucggaacuaaaaagcgcgacaguaugcgcgagucauuucuguucuuccgcaacgucaggcaaaaagaacacagaaauccaguuccacagcggaucccuaguuggaaaaaccgcaauacacguaaaaggagcucucgucgacggaacagacuucacauucgaaggcucaugcauguuccccgauggaugcgacgcaguagacugcaccuucugccgagaguuccucaaaaacccacaaugcuacccagcaaagaaauggcuauucauaaucaucguaauccucuuaggcuacgcaggcuugaugcuacucacgaacguccucaaggcaauaggcguauggggaagcugggucauagcgccgguaaaacucauguucgccaucaugaaaaagcugaugaggagcguaucaugccucaugggaaagcucauggaccgcggcagacaaguaauccacgaagaaaucggcgaaaacagggaaggaaaccaagacgacguccgcaucgaaauggcaagaccacgaaggguccgacacuggauguauagccccgucauccuuacaauccuagccacaggacuggcggaaggaugcgaugagaugguccacgcagacucaaaacuugucucaugcagacaagggagcggaaacaugaaggaaugcguaaccacaggccgcgcccuucuacccgcagugaacccaggccaggaagccugccuccauuucaccgcgccggggagccccgacucaaaaugccucaaaauaaaggucaaaaggauaaaccucaaguguaagaaaagcucauccuauuucguacccgacgcccgcucaagguguacgucugugagacgaugccgaugggccggugacugccaaagcggaugcccaccccacuucacaagcaacagcuucagcgacgacugggcuggaaaaauggaucgagcaggacucggauucucaggcugcagcgacggcugcggcggagcugcgugcggaugcuucaaugcggccccgaguugcauauucuggagaaaaugggucgagaauccccacggcaucauauggaaaguaagccccugcgcagcguggguaccaucggcagucauagagcucacgaugccaagcggggaaguucgcaccuuccacccaaugagcggaaucccaacacaaguauucaaaggcguauccgucacauaccugggaucggacauggaaguauccggacucacggaucugugcgagauagaggaauugaaguccaagaaacucgcccuugcacccugcaaccaagcgggcaugggcgucgucggaaaagucggagaaauacaaugcagcuccgaagaguccgcacgcaccauaaagaaagauggcugcaucuggaacgccgaucuugucgggauugaacucagagucgaugacgcagucugcuacuccaaaauaaccucgguagaagccguggccaacuacuccgcaaucccaacaacaauaggcggccugagguucgaacgcagccacgauucucaaggcaaaauuucagggucgccacuggacauaaccgccauacggggguccuucucagucaacuaccgaggccuacgccuuucccuaagcgaaauaaccgcgacaugcacgggagaaguuaccaacgucagcgggugcuacagcugcaugacaggagcaaaaguauccgugaaacuacacucauccaagaacucaaccgcacacgucagaugcaaaggcgaugaaaccgcuuucuccguccuagaagggguacacagcuacacggucucacucagcuucgaccacgcuguaguugacgagcaaugccaacugaacugcggaggacacgaaagccaaguaacacucaaaggaaaucucaucuuccucgacgucccaaaauucgucgacggcagcuacaugcaaaccuaccacagcaccguccccaccggggcaaacauaccgucaccaacggauuggcugaacgcacucuucggaaauggccuaagcagauggauccuaggcguaaucggaguacuccuagguggccuggcacucuucuuccucauaaugagucuauucaagcucggaaccaaacaaguguuccgcucaaggacaaaacucgcuuag

SEQ ID NO: 16424 - RNA, 3222 nt, Artificial Sequence
  derived and/or modified CDS sequence (opt11) from SFTSV(AH-YTY/China/05/2012)__KR017849.1__GP
augaugaaagucauaugguucagcucgcuaauaugcuucguaauacaaugcagcggcgacaguggcccgauuaucugcgccggaccgauccacagcaacaaaucagcagacaucccacaccuacucggcuacucagagaaaaucugccagaucgaccgacugauacacguaagcagcugguuaagaaaccacucccaauuucagggguacguaggccaacggggaggacgaucccaaguauccuacuauccagcagaaaacaguuacucccgauggucaggccuacucucaccaugcgacgcagacuggcuaggcaugcucguaguaaagaaagccaaggguagcgauaugauagucccgggcccaucauauaagggcaagguauucuuugaacgaccgaccuuugacggauacguaggcuggggaugcgggucagguaagucgcgaaccgaauccggagaguugugcagcuccgacagcggcaccucguccggccuccucccaagcgacagaguacuauggauaggcgacgucgcgugucaacccaugacccccauccccgaggagaccuuucuugaauuaaaauccuuuagucaaagcgaguucccagauaucugcaaaauagacggcaucguauucaaucaaugcgaaggagaaagucuaccucagccuuucgacguggcauggauggauguuggccacagccacaaaauaauaaugcgcgagcauaaaaccaaauggguacaagaaucuagcuccaaggacuucguaugcuacaaagagggcacaggcccgugcuccgaauccgaagagaaaaccugcaaaacgagcggauccugccgcggcgacaugcaguucugcaaaguagccggaugcgaacacggagaagaagccuccgaagcaaaaugccguugcucccuaguccacaaaccaggggaagucguggugagcuacggcggaaugcggguacgacccaagugcuacggauucagcagaaugauggcgacguuagaaguaaaccagccagaacaacgaaucggacaaugcacagggugccaucucgaaugcaucaacggcggcgugcgacugauuacccuaacaagcgagcuaaaaagcgccaccgucugcgccucccacuucugcagcucugccaccagcggcaaaaagagcacagaaauccaguuccacuccggaucacucgucgggaagacggcgauacacgucaaaggagcacucgucgacgggaccgaguucaccuuugaaggcucguguauguuccccgacggcugcgacgccguggacuguaccuucugucgggaguuccucaaaaacccacaauguuacccggccaagaaaugguuguucaucauaauaguaauacugcuaggcuacgcgggccuaaugcuacucacaaacguccuaaaggccauaggcauauggggaagcuggguaauagcaccagucaaacuuaucuucgcaaucauuaagaaacuaaugcgcgccgucagcugccuaaugggcaaauugauggacagaggacggcaagucauacacgaagaaauaggcgaaaacagggaaggcaaccaggacgacgucagaaucgaaauggcacgcccacgucgagugaggcauuggauguacagcccaguaauacucacaauacucgccaucggccuggccgaaaguugcgaugaaaugguacacgcagacagcaagcuaguguccuguagacaaggcagcggaaauaugaaagagugcguuacaaccggccgagcccuccuaccggcggucaaccccggacaagaagccugccuacacuucaccgcacccgggagcccagacucuaaaugccuaaaaaucaaaguaaagcgaauaaaccuaaagugcaagaaauccucgagcuacuucgucccagacgcccgcucaagaugcaccagcguacgccggugcagaugggccggcgacugucaaucaggauguccgccccacuucacauccaauucguuuagcgacgacugggccggaaaaauggacagagccggacuaggauucuccggguguagcgacggaugcggcggcgccgcgugcggcugcuucaaugcggcccccucaugcauauucuggagaaaaugggucgagaacccccacggaaucauauggaaagugagccccugcgcggccuggguacccucagcagugauagagcuaacaaugcccuccggggagguccguaccuuccacccaauguccgggaucccaacccaggucuuuaaagggguaucugucaccuaccucggaagcgacauggaaguaagcggccucacagaccuaugcgaaauagaagaacucaaaagcaaaaagcuagcacucgcccccugcaaccaagccggaaugggagucguggggaaagucggagaaauccagugcagcuccgaagaguccgccagaaccauaaagaaagacggaugcauauggaacgcagaucucguagggaucgagcuccgcguagacgaugccguaugcuauagcaaaauaaccagcguagaagcagucgcaaacuacucagcgauacccacaaccaucgguggacuccgauucgaacgaucucacgauagccagggaaaaauaucaggaucaccccuagacaucacagcuauccguggcagcuucagcgugaacuaccgaggacuacgccucagccucagcgaaaucaccgccacguguaccggagagguaacaaacgucucgggaugcuacagcugcaugacgggcgcgaaagugagcauaaaauuacacucaagcaaaaauucgacagcccacguacgaugcaagggagaugaaaccgcauucuccguacucgaaggaguccacucauacacugucagccucagcuucgaccacgcagugguagaugaacaaugccagcuaaacugcggaggccacgaaagccaaguaacucucaaaggaaaucuaaucuuccuugacguaccaaaguucguagacgggucguacaugcaaacauaccacagcacgguccccaccggcgccaacauccccaguccaacagauuggcucaacgcacuauucggaaauggacugagcagauggauccugggagucauuggcgugcuauugggcggccucgccuuguucuucaugaucaugagccuauucaaacuaggcaccaaacaaguguuccgaagccgcaccaaacucgccuaa

SEQ ID NO: 16425 - RNA, 3222 nt, Artificial Sequence
  derived and/or modified CDS sequence (opt11) from SFTSV(AHZ/China/2011)__JQ670931.1__GP
augaugaaaguaauaugguucagcucgcuaauaugcuucgugauacaaugcuccggcgacucagggcccaucaucugcgccggaccaauccacagcaacaaaagcgcggacaucccccaccuacuggguuacuccgaaaagauaugccaaauagaccgacugauacacguaagcagcuggcuacgcaaccacucccaguuccaaggauacgucggacaacggggaggcagaagucaagucagcuacuauccagcggaaaauuccuacagccgaugguccggccuccuaucaccaugcgacgccgacuggcucggcauccuaguaguaaagaaagcaaagggaagcgacaugauagugcccgggccaucauacaaagguaaaguauucuucgagaggccgaccuucgacggauacgugggcuggggaugcggcagcggcaaaagccgaaccgagagcggagaacuaugcuccuccgacucaggaacgucaagcggccuacuccccucagaccgcgugcucuggauaggagacguagcaugccaacccaugaccccaauacccgaggaaaccuuccuagaacucaagucauuuagccaaagcgaguucccagacaucugcaagaucgacggaauagucuuuaaccagugcgaaggggagucccuaccacagcccuucgauguagccuggauggacgucggacacucgcauaaaauaaucaugagagaacacaaaacaaaauggguacaggaaagcagcucaaaagacuucgucuguuacaaggagggaacgggccccugcagcgaaagcgaggagaaaacgugcaaaaccucuggguccugccgaggagacaugcaguucuguaaaauagcagggugugaacacggcgaggaagcgucggaagccaaaugcagauguucgcuuguccacaaaccgggagaggucgucguaagcuacggcgggaugagaguacggcccaagugcuacggguucucgcgcaugauggcaacauuagaagugaaccagcccgaacaacggaucggacagugcaccggaugucaccuugaaugcaucaacggcgggguacgacuaaucacccugacgagcgaacucaaaucggcaaccguaugcgccucgcacuucugcaguucagccacaucggguaagaaauccacagagauccaauuccacucaggcucccucguuggaaaaacugcaauacaugugaaaggggcccuaguggacggcacagaguucaccuucgaagguagcugcauguucccagacggaugugacgcaguagacugcacuuucugcagagaguuccucaaaaacccccaauguuaucccgcuaagaaauggcuauucauaauuaucgucauucuacuaggauacgccggccuaaugcuccugacaaacguacucaaggcgaucggcauuuggggaagcugggucaucgcacccgucaagcugauauucgcaauaaucaagaaacucaugcgaacagugucgugccucaugggcaaacucauggaucgaggcagacaaguaauacacgaagagauaggcgaaaaccgcgaaggcaaucaagacgacguaagaaucgagauggcacgucccagacgaguacgccacuggauguacucacccgucauccugaccauacuagcaaucggacuagcggagagcugcgacgaaaugguacacgcagacagcaagcuagucucaugccggcaaggaucaggaaacaugaaagaaugcgugacaaccggaagggcauuacuccccgcaguaaaccccggccaagaagcaugccuccacuucaccgcccccgggagcccagacaguaaaugucucaaaauaaaaguaaaauggaucaaccuaaaaugcaagaaguccucaucauacuuugugcccgaugcccgaucaagaugcaccuccguacgaagaugccggugggcuggcgacugccaaagugggugcccgccacacuucaccucgaacucguucagcgacgacugggccggaaaaauggaccgagccggacugggcuucucaggaugcucagacgguugcggaggagccgcaugcgggugcuucaacgcagcaccaucaugcaucuucuggcgcaaaugggucgaaaacccacacggaauaaucuggaaagucagcccuugcgcagcaugggucccgucagccgugauagaacuaagcaugccaagcggagaaguucgaaccuuccaccccaugagcggcaucccaacccaggucuuuaagggcgucagcguaaccuaccuaggaucagacauggaagucucaggucucaccggccuaugcgagauagaagaacucaaaagcaagaaacucgcccuggcacccugcaaccaagcagggaugggaguaguaggcaaagugggggagauccaaugcuccagcgaagaaagcgcaagaacaauaaagaaagacggcugcaucuggaacgccgaccucguuggcauagaacuacgcguagacgacgcugucugcuacuccaaaauaacgagcguagagagcguggccaacuacuccgccauuccaacaaccauaggcggacuacgauuugaaaggagccacgauagucaaggaaaaauaaguggauccccgcuggacauaaccgcuauaagggggagcuucucgguaaacuaccgcggucuaagacugagcuuaucagaaaucacagcaaccugcaccggcgaaguaacaaacgucagcggcuguuauagcugcaugaccggagcgaaaguauccaucaagcuacacucaagcaaaaauagcaccgcacaugucagaugcaaaggcgacgaaacagccuucuccgucuuagaaggaguacacucauacaccgugucccucaguuucgaccacgccgucgucgacgaacaaugccagcuaaacugcgggggacaugaaucgcaaguaacacuaaaggguaaccucaucuuccucgauguaccaaaauucgucgacggcucauacaugcaaacguaucacagcacgguaccaacgggcgccaacaucccaucaccaaccgacugguugaacgcgcuauuuggcaacggccuaucacgcuggauacucggucucaucggcguccuucuaggaggcuuagcccuuuucuucaugaucaugucacuuuucaagcucgggacaaaacaaguauuccggagccggacuaaacuagccuaa

SEQ ID NO: 16426 - RNA, 3222 nt, Artificial Sequence
  derived and/or modified CDS sequence (opt11) from SFTSV(DS02/CHN/2013)__KR698332.1__GP
augaugaaagucauaugguucagcagccucauuugccuaguaauccaaugcagcggggacacgggcccaaucauaugugccggcccaauccacucgaacaaaucggccaacauuccccaucuacuaggcuacuccgagaaaauaugccaaauagacagacuuauacacguaagcucauggcuaaggaaccacucccaauuccaaggguacguaggacaaaggggcggacggagccaaguaagcuacuacccagcagaaaacagcuacagcagauggucgggguugcucuccccuugcgacgcggacuggcucggaauguuggucgucaagaaagccaaagggucggacaugauagugccuggccccagcuacaaaggcaaagucuucuucgaacguccaacauucgacggcuacguaggcuggggcugcggcucggggaaaagccgaacugaauccggcgaacucugcuccagcgacagcggaacaagcagcggccuccugccaucugacaggguccucuggauaggcgacgucgcgugccaacccaugacaccgauacccgaagaaaccuuucuggaacucaagagcuucucccaguccgaguucccagacauuugcaaaaucgacggcauagucuuuaaucaaugcgaaucagaaagccucccacaaccguucgauguggccuggauggaugugggucacucacacaaaaucauaaugcgagaacacaaaacaaaauggguccaagaaucaucaagcaaggacuucgugugcuauaaagaaggcacaggcccguguuccgaaagcgaagagaaaaccugcaaaacaaguggaucgugccggggcgacaugcaauucugcaaggucgcagggugcgagcacggagaggaagccucagaagcgaaaugccgcugcagccucgugcacaaaccgggagaggucgugguaagcuacggagguaugcgaguaagaccuaaauguuacggauucucgcggaugauggcaacucuagaagucaacccaccagaacaacgaauagggcaaugcacgggaugccaucuggaaugcaucaacggaggcguccgacucgucacacucacgucagaacugaaaucagcgacaguuugcgccucacacuucugcucaucagcaacuagcggaaagaaaagcacagagauacaauuccacagcggcucacucguaggcaaagccgcaauacacguaaaaggagcauuaguagacggaaccgaguuuaccuucgagggcagcugcauguuccccgacggaugcgacgcgguagacugcacguucugucgagaguuccucaagaaccuacaaugcuacccggcaaagaaaugguuauuuaucauaaucgucauccuacuaggcuacgcaggacuaaugcuccuaacaaacguacuaaaagcaaucggcgucugggggaguugggugauagcacccguaaaacucauguucgcgaucaucaagaagcugaugcgaucgguuaguugccugaugggaaagcuaauggaccgcgggcgccaaguaauccaugaagaaauaggagaaaacagagagggaaaccaggacgacgucagaaucgaaaugguccguccacgacgcguacggcacuggauguacagcccaguaauacucacaauccuagcaauaggccuaacagaaggaugugacgaaauggugcaugccgacaguaaacugguaaguugccgccaagggagcggcaacaugaaagaaugcguaacaacaggcagagcccuacuuccagcagugaaccccggacaagaggccugccuacacuucaccgcaccaggcagcccagacuccaaaugccugaaaaucaaagucaaacggauaaaccuaaaaugcaaaaaguccucaaguuacuucguccccgacgcacgcaguaggugcacgagcguacggagaugcagaugggccggagacugccagagcgggugcccgucccauuucacguccaacucauucagugacgacugggcaggaaaaauggaccgugcuggacuaggcuuuucgggcugcagcgacggcugcggaggagccgccugcggaugcuucaacgcagcaccuagcugcaucuucuggcgaaaauggguggagaauccccacggcauaauuuggaaagucuccccaugcgcagcauggguaccaucagccgugaucgagcucaccaugccaagcggcgaagugagaacauuucacccaauguccgggaucccaacucaagucuucaaaggcguaagcgucacauaccucggcagcgacauggaagugagcggguuaacagaccuaugcgaaauugaggaacuaaaauccaaaaagcucgcacuagcacccugcaaccaggcaggaaugggagucgucggaaagguuggcgaaauccaaugcagcucggaagaaagcgcacgaacaauuaagaaagacggcugcauauggaacgcggaccuggucggaaucgaacuaagaguggacgacgcaguauguuacucaaaaaucacaucuguugaggcaguggcgaauuacagcgccaucccgacuacgauaggcggccuuagauuugaaagaagucacgacucccaaggaaagaucucaggaucaccccucgacaucaccgcaaucagaggcuccuucagcgucaacuaccgaggccuuagguuaucacugagcgaaaucacggcaacaugcacaggagaaguaacuaauguaagcggaugcuauuccugcaugacgggcgcaaaagugagcauaaaacuccacagcagcaagaacuccacagcucacguacgaugcaaaggagacgaaacggcguucagugucuuggaagggguccacagcuacaccgucaguuuaucguucgaccacgccgucguugacgaacagugccagcucaacugcggcggacacgaaagucaagucacccucaagggcaaccucauauucuuagacguacccaaauuugucgacgggagcuacaugcagacauaucauucauccguuccgaccggggcuaacauaccguccccaacagacuggcucaacgcccuauucggaaauggacucagccgcuggauacucggagucauuggcguacuacugggaggccuagcccuguucuuccugaucaugagucuauucaagcugggaaccaagcaaguguucagaagccgcacuaaacuugcauga

SEQ ID NO: 16427 - RNA, 3222 nt, Artificial Sequence
  derived and/or modified CDS sequence (opt11) from SFTSV(DS03/CHN/2013)__KR698333.1__GP
augaugaaggucauaugguucagcucacucauauacuuagucauacaaugcagcggggacagcggcccaauaaucugcgcugguccaauacacagcaacaaaucggcaaauaucccgcauuuguuaggauacucagaaaagauaugccaaaucgacaggcucauccacgucagcagcugguuacgcaaccacucgcaauuccaaggcuacguaggccagcgaggagggaggucacaagugucauacuaucccgcggaaaacagcuacucaagguggucgggccugcugucacccugcgacgcggauuggcuggggaugcucguagugaagaaagcgaagggcucagacaugaucguucccggucccagcuacaaaggcaaaguuuucuuugaacgccccaccuucgacggcuacgugggcugggggugcggcuccggaaaaaguagaacagaaagcggagaauuaugcuccucagacaguggaaccucaagcggacuucucccaagugacagaguccuauggaucggagacguggcaugucagccaaugacgccgauccccgaagagacauuccucgaacuaaaauccuucucccagagcgaguucccggacauuugcaaaauagacgggauuguauucaaccaaugcgagcgugaaagccuaccgcaaccguuugacguggcauggauggaugucggacacucgcacaagaucaucaugcgagaacacaaaacaaaguggguccaagaaucaagcuccaaggacuucgucugcuacaaggaggggacaggaccaugcucggaauccgaagagaaaacgugcaagaccagcggcucaugcaggggcgauaugcaauucugcaagguagcaggaugcgagcacggcgaggaggcuagcgaagccaagugccgcugcucccuaguccacaaaccaggggagguugugguaucauacgggggcaugcgagugcgacccaagugcuacgguuucucccgcaugauggcgacccucgaagucaacccgccagaacaacgcaucggucagugcacaggaugccaccucgaaugcauaaacggggguguacgacucauaacacuuacaagcgaacucaaaagugccacuguuugcgccucccacuucuguagcagugcgacaagugggaaaaagucaacugaaauccaauuucacucagggagccuaguaggcaggacagccauacaugucaagggagcccuaguugacgggacagaguucacguucgaagguucaugcauguucccggacggaugcgaugcaguggacuguaccuuuugcagagaguuccuuaagaacccccaaugcuaucccgcaaagaaauggcuguucauaauaaucguaauauugcuaggcuacgcgggacuaauguugcuaacgaacguccuaaaagccauaggcguguggggauccugggugaucgccccaguaaaauuaauguucgccauaaucaagaaacucaugcggucgguaucgugccuaaugggaaaacucauggaccgcggacgccagguaauucacgaagaaaucggugaaaaccgugaaggcaaccaagacgacauccgcaucgaaauggcgcgcccacgaagaguccggcacuggauguacucgcccgucauacucacgaucuuggcaguagguuuggccgaaggaugcgacgaaaugguacacgcggacucgaaacuugucucaugcaaacaaggaagcggaaacaugaaagaauguguaacaaccgggcgggcacuacucccggcaguaaacccggggcaagaagcgugcuugcacuucacagcuccgggaagccccgacagcaaaugccuaaagaucaaagugaaaagaauaaacuugaaaugcaagaaauccucguccuacuucguacccgacgcuagaagccggugcacgagcgugcgacgaugcagaugggccggcgauugucaaagcggauguccgagccacuucaccaguaacagcuucagcgacgacugggccgggaaaauggacagggccggacugggcuuuuccggaugcuccgacggcugugggggagccgcgugcgggugcuucaacgcggcccccagcugcaucuucuggaggaaguggguagaaaacccacauggcauaaucuggaagguuagcccuugcgcagcgugggugcccuccgccguaaucgagcucacaaugccgagcggagaggugagaacauuucaucccaugaguggcaucccgacacaaguauuuaaaggggugucagucacguaccugggaucggacauggaagugagcggccugaccgaccuaugcgaaaucgaagaacucaaaagcaaaaaguuggcacucgcgccaugcaaccaagcaggcaugggcguaguaggaaagguaggggaaauacaauguagcagcgaggaauccgcacggaccauaaagaaagacggcugcauauggaacgcagaccuaguagggaucgaguuacggguggacgacgcaguauguuacagcaaaauuaccagcguagaagcuguagcaaacuacuccgccauacccacaaccauaggcggucuccgauuugaaagaucgcacgacagccaaggcaaaauaucaggcucaccacuagacauuacagcaauccguggcagcuucucgguaaacuaccggggccuccgccuaucccuaagcgagaucaccgcaacaugcaccggagaagucacuaauguaagcggaugcuacucgugcaugacgggagcaaaaguaucaauaaaacuacacucguccaaaaacucaaccgcccacgugcgaugcaaaggggacgaaaccgcauucucaguacuagaaggaguacacagcuauacaguaagucugucuuucgaccacgccguaguagacgaacagugccagcuaaacugcggaggccacgaaucccaagugacacuaaaagggaacuuaauauuucucgauguacccaaauucguagacggcucauacaugcaaacguaccacagcucggucccgaccggggcaaacauccccucaccaacagacuggcuaaacgcucuauucggaaauggauuaagcagauggauacucggcguaauagggguacuauuaggcggacucgcucucuucuuccugauuaugagucuuuucaaacucgggaccaaacaaguauuccggagccgcacaaaacucgcauaa

SEQ ID NO: 16428 - RNA, 3222 nt, Artificial Sequence
  derived and/or modified CDS sequence (opt11) from SFTSV(DS04/CHN/2013)__KR698334.1__GP
augaugaaaguaauaugguucaguagccucaucugucuaguuauacaauguagcggagacaccggccccauaauaugcgccggaccgauccauuccaacaaauccgccaacauaccacaucuacucgguuauuccgagaaaaucugccaaaucgacaggcugauacacgucagcucguggcuccgcaaccauucccaauuccaaggguacgugggccaacgcgguggccgaagccaggucucauacuacccagcggaaaacagcuauucacgauggucaggacuucucagcccaugcgacgccgacuggcuaggaaugcucguaguaaagaaagcuaaagguucagacaugaucguacccggccccuccuacaaaggaaaaguguucuucgagcgacccacauucgacggauacguaggauggggcugcggcucaggcaaaagucggacugaauccggagagcuaugcucaagugacucgggcacaagcagugggcuccuccccuccgacagagugcuauggauaggcgacguagccugccaaccaaugacaccgauaccagaagaaaccuuccucgagcucaagucauucucccaguccgaguucccggacauaugcaagaucgacggcaucguauucaaccagugcgagucagaaagucugccccaacccuucgacgucgccuggauggacguaggccacucccauaagauaauaaugcgagaacacaaaaccaaauggguccaagaaucgagcucgaaagauuucguaugcuacaaagaagggacaggaccgugcuccgaauccgaagagaaaacaugcaagaccagcggcaguugccgaggcgacaugcaauucugcaagguggcaggcugcgaacacggagaagaagcgucagaagcaaaauguaggugcucccugguacacaagccuggcgaagucgucguaagcuacggcggcaugcgaguccgcccaaaaugcuauggauuuagccgcaugauggcaacacucgaaguaaauccaccagaacaaagaauuggacaauguaccgguugccaccuagaauguaucaacggcgggguacgccugauaacgcugaccagcgaacuaaagucagcaacaguuugcgccucccacuucugcagcuccgccacaagcggaaagaaaagcacagagauccaguuccacucaggaagccuggugggaaaagccgccauccacgugaaaggagcgcuagucgacgggacagaguucacguucgaaggcucuugcauguuccccgacgggugcgacgccguagacugcaccuucugccgugaguuccucaaaaacccccagugcuacccagccaaaaaguggcuauucauuaucauagucauccuacuaggauacgcaggcuuaaugcugcucacaaacguacuuaaggccauaggaguauggggaagcuggguaauagcacccgugaagcucauguucgcaaucauaaagaaacuaaugaggucagucucuugccuaaugggcaaacugauggaccgcggcagacaaguaauccacgaagaaaucggagaaaaccgggaaggcaaccaggaugacgucaggauugaaauggugcgcccacgccgcgucagacacuggauguacagcccgguaauacuaacaauccucgccauuggauugaccgaaggaugcgacgaaaugguacacgccgacaguaaacucguaucaugcaggcaaggaagcggaaacaugaaggaaugcguaacuacagguagagcacuccuccccgcggucaauccgggacaagaagcaugccuccacuucacggccccaggcucccccgacagcaaaugccuaaaaauaaaggucaaacgcauaaaccuaaaauguaagaaaagcagcucguacuucguacccgaugcacggucgcgaugcacgagcguucgccgcuguaggugggcaggagacugccaaagugguugccccagccacuuuacaaguaacagcuuuuccgacgacugggccggaaaaauggacagggcuggccuaggcuucagcggaugcagcgacggcugcggcggagcggccugcggaugcuuuaacgcagcacccucaugcauauucuggcgcaaaugggucgaaaauccacacggcaucauauggaaagucucaccaugugccgcauggguccccagcgccgucauagaacugacaaugccaagcggagaaguacgaacauuccguccaaugagcgggauaccgacccaaguauucaaaggaguauccgucacuuaccucggcucagacauggaagucagcggacuaaccgaccuaugcgaaauagaggaacuaaaaucaaagaaacucgcccuagcaccaugcaaccaggcaggaaugggagucguaggcaaaguuggugagauacaauguagcagcgaagaaagcgcccgaaccauaaagaaagaugguugcaucuggaaugcagaccugguaggaaucgaacuccgcgucgaugacgccguaugcuacucuaaaauaacauccgucgaagccgucgucaacuacucggccauaccuaccaccauaggagggcugagguucgagcgcucgcacgauagccaagguaaaaucagcggaagcccacuggacauaacagcaauccguggguccuucagcgucaauuacagaggacugcgccugagccucagcgagaucacugcaaccugcacaggcgaggucacuaacgugucuggaugcuacagcuguaugaccggcgccaaagucagcauaaaacuacacagcucgaaaaacucaaccgcacacguccgcugcaaaggagacgaaacagcauucagcgugcuugaaggaguccacagcuauaccguaucgcuaucauucgaucacgcagugguagacgaacagugccagcucaacugcggaggccacgaaagccaagucacucuaaaaggaaaccucauauuccucgacgucccgaaauuugucgacggcucguacaugcaaacauaccacuccagcgugcccacaggggccaacaucccauccccaacagacuggcucaacgcccucuucggcaauggccuauccagguggauacucggaguaaucggcguacugcucgggggacuagcccuguucuuccuaauaaugagccuauuuaaacucggcaccaaacaagucuucaggagcagaaccaaacuggccuaa

SEQ ID NO: 16429 - RNA, 3222 nt, Artificial Sequence
  derived and/or modified CDS sequence (opt11) from SFTSV(DS05/CHN/2013)__KR698335.1__GP
augaugaaagugaucugguucagcucgcuuaucugccuagucauccagugcucaggagacacuggcccaauaauaugcgcuggaccaauccacagcaacaaauccgcgaacaucccccaccucuuaggcuacucagagaaaaucugucaaauugacagacuaauacacguaagcucguggcuacgaaaccacagccaauuccaaggauacgugggccaaagaggcgguaggucccaagucucauacuacccggcggaaaacucauauucccgcuggucaggacugcuaagccccugugacgcggauuggcucggcaugcucguggugaagaaagcaaaaggaucagacaugaucgucccaggaccgucauacaagggcaaagucuucuucgaacggccgaccuucgacggauaugucggcuggggcuguggcucaggcaagucaaggacagaaucgggagaacuaugcucaucugacucagggacaucgagcggacuacucccauccgaccgcguccuauggauaggugauguagccugccaaccaaugacacccauccccgaagaaacguuccuagaacucaagagcuucagucaauccgaguuccccgacaucugcaaaaucgacgggaucgucuucaaucaaugugaaucagaaagucuaccacaaccauucgacguagccuggauggaugucggacacagccacaaaauaauaaugcgcgaacacaaaacaaaguggguccaagaaucaucaagcaaagacuucgugugcuacaaagaaggaaccgggccaugcuccgaaagcgaagagaaaacauguaaaacauccggcucaugccggggagauaugcaauucuguaagguggccggcugcgaacacggagaagaagcgucagaagcgaaaugccgcugcagccucgugcacaaacccggggaagucgucgugagcuacgguggaaugagaguacgcccgaaaugccauggauucagcagaaugauggcaacccucgaaguaaaucccccagaacaacgcaucggacaaugcacggggugccaccucgaaugcauaaacgggggaguacgccuaauaacgcucacaucggaacuaaagagcgccacaguaugcgccucacacuucugcucaucagccacauccgggaagaaaagcaccgagauacaguuccacuccggaagucuagugggcaaagcggccauccacguaaaaggcgcgcucguagacggaaccgaguucaccuucgaaggcagcugcauguucccagacggaugcgacgccguggauuguacuuucugccgggaguucuugaaaaacccacaaugcuacccagcaaagaaauggcuauucaucaucauagucauccuacucggguaugccggccuaaugcuacugacaaacguucucaaggccauaggcguauggggaucauggguaauagccccugucaaacuuauguucgccauaaucaaaaagcucaugcguucaguuucaugccuaaugggcaaacugauggaccguggacgccaagugauacacgaagaaauaggcgaaaaccgagaaggaaaccaagacgacguacggaucgaaaugguccgaccacgacgaguaagacacuggauguacucccccguaauccucacgauccuagccauugggcugaccgagggaugcgacgagaugguccaugccgacucaaaacuggugagcugucgacaaggaagcggaaacaugaaagaaugcgucacaacaggccgcgcucuccucccggcggucaacccgggacaggaagccugccugcacuucacagcaccaggcagccccgacucaaagugccucaaaauuaaagucaagcgaaucaaccucaagugcaagaaauccagcagcuacuucguacccgacgcucgaagucgcugcacaucugugcgcagaugcagaugggcgggagacugccaaucaggaugcccgagccacuucaccucaaauaguuucucagacgauugggccggaaagauggaccgagccggcuuaggcuucagcggauguagcgacggaugcggcggugccgccugcggcuguuucaacgcagccccuagcuguauauucuggcgaaaaugggucgagaacccacacggaauaauauggaaggucagccccugcgcagcaugggugccgagcgccgucauagaacuaacgaugccgagcggcgaaguacgaacguuccaccccauguccggaaucccgacacaagucuuuaagggagugagcguaaccuacuuagguucggacauggaaguaagcgggcucacagaccucugcgaaauagaggaacuaaaaagcaaaaagcucgcccucgcaccgugcaaucaagcuggcauggggguaguagggaaagucggggaaauccaaugcuccucagaagagagcgcaagaacuaucaagaaagacgggugcauauggaacgcggaccuagucggaaucgaacuaagaguagacgacgccguaugcuauagcaaaauaaccucgguugaagccguagcuaacuacucugcgaucccaacgaccauaggcggacuccgcuucgaaagaucacacgacucacaagggaaaauaucaggcucgccauuggacauaaccgcaauccgagggagcuucucagugaauuacagaggccuaagacuaagccuaagcgaaauaaccgcgacgugcaccggagaggucaccaacgucaguggaugcuacagcugcaugacaggagccaaagucagcauaaaacuucacucguccaaaaauagcaccgcacacgucaggugcaaaggcgacgaaacugcguucucuguccuagaagggguacacagcuacaccgucagccuaucauuugaccaugcagucguugacgaacagugccagcuuaacugcggagggcacgagagccaaguaacccuaaagggaaaccucaucuuccuagacguaccaaaauucgucgacggcuccuacaugcagacguaccacagcuccgugccgacgggcgccaacaucccaagcccaacagacuggcugaacgcccuuuucggcaacggacucucccgauggauacucgggguaaucggggugcuacugggcgggcuagcacuauucuuccucauaaugucccuauucaaacuaggaaccaaacagguguuucgcuccagaaccaaacuugcguag

SEQ ID NO: 16430 - RNA, 3222 nt, Artificial Sequence
  derived and/or modified CDS sequence (opt11) from SFTSV(HB154/China/2011)__JQ733560.1__GP
augaugaaaguaauaugguucagcagucuaauaugccuggucauccagugcagcggagacaguggcccaauuauaugcgcaggccccauccacucgaacaaauccgccgggauaccgcaccuacucggauacucugaaaagauuugccaaaucgacaggcuaauacacguaucauccuggcugcggaaccacucgcaguuccagggauacguuggccaacgaggaggaaggagucagguaucauauuauccagcagaaaacaguuacucaagguggagcgggcugcucucccccugcgacgcggacuggcugggcauguugguugugaagaaagcaaaagaaagugacaugaucguaccaggacccucguacaaaggaaaagucuucuucgagcgcccgacguucgacggauacgugggcuggggaugcggaucaggcaaaagccggacagagucaggggagcucugcagcuccgacucagggacaucaaguggacuacuucccuccgaccgcgucuuguggauaggagauguagcgugccagccgaugacgccaaucccagaagagaccuuccucgaacugaaaucauucagccaaagcgaguucccagacauauguaaaauagacggcauagucuuuaaccaaugcgaaggcgaaagccuaccacagcccuucgacgucgccuggauggacgugggacacucacauaagauaaucaugagggaacacaaaaccaaauggguacaggagaguagcuccaaagacuuuguauguuacaaagaagggaccgguccgugcucagaaucggaagaaaaagcgugcaagacauccggauccuguagaggcgacaugcaauuuugcaaaguggcaggcugcgaacacggggaagaagccucagaagcaaaaugccgcugcagcuuaguccacaaaccaggcgaggucguggugagcuauggaggcaugagagugcgcccaaaauguuacggcuucucccgaaugauggcgaccuuagaagugaacccaccggaacaaagaauagggcaaugcaccggcugccaccuagaaugcaucaacgggggaguacgccucaucacccucacguccgaacuccggagcgcaaccgugugcgccagccauuucugcagcuccgcgacuagcggcaagaaaagcaccgagauccacuuccauucaggcagccuaguaggaaaaaccgccauucauguuaaaggagcccucguagacggaaccgaauuuacauucgaagguuccuguauguucccggauggaugugacgccguggacugcacauucugcagagaguuccucaaaaacccacaauguuacccggcgaaaaaguggcuauucauaauaauagucauccuacuaggguacgcaggccugaugcuccuuacaaacguacuaaaagccaucggcguguggggaagcugggucauagccccagucaaacucauguucgccaucauaaagaaacugaugcgaacagucucgugccucgucggaaaauugauggaccgaggcagacagguuauaaaugaagaaauaggagaaaacggugaaggaaaccaggacgacguaagaaucgaaauggcccgcccacgcagagucagacacuggauguauagcccuguaauacuuaccauccucgccauagggcuggccgaagggugcgacgaaaugguccacgccgacuccaagcuaguaagcugccggcagggaagcggcaacaugaaagagugcauaacaaccggcagagcccugcuucccgccgugaacccgggacaagaagcaugccuacauuucacagcacccggauccccagacuccaaaugccuaaaaaucaaaguaaaacgcaucaaccucaaaugcaagaaaagcagcagcuacuucguccccgacgcacgaucccggugcacgagcguacgaagaugcagaugggccggggacugccaaucuggcugcccaccccacuucacauccaacagcuucucggacgacugggcuggcaaaauggacagagcaggccucggguucucuggaugcuccgacggcugcggaggcgcagccugugguugcuucaacgcggcacccuccugcaucuucuggaggaaauggguugagaacccccacgggaucaucuggaaagugucaccaugcgcagcaugggugccuuccgcugugauagaacucaccaugccaagcggagaagugcgaacauuccaucccaugagcgggaucccaacacaaguuuucaaaggcgugucagucacuuaccucggaucggacauggaggugagcgggcugacagacuugugugaaauagaggagcuaaaaagcaagaaacuagcacuagcgccaugcaaccaggccggcaugggaguagugggcaaagugggagagauacaaugcagcagcgaagaaucagcacgaaccaucaagaaagacggcugcaucuggaacgcagaccucgucggcaucgaacuccggguggacgaugcagucugcuauucaaaaaucacgucgguagaagccguagccaacuacagcgccauccccacaacaauaggcggacuaagguucgaacgaucacacgacucgcagggcaaaauaucaggcucgccacuagacauaaccgcgauccggggcucauucucuguaaacuaucgcggacuuagacucagccuaucagaaaucacagccacgugcacuggagaaguuacaaacguaagcggcugcuacagcugcaugacgggcgccaaagugagcauaaaacuacauucaagcaaaaacuccaccgcacauguacggugcaaaggggacgaaaccgcguucuccguacuggaagggguccauagcuacauagugagccugagcuucgaccacgccguugucgacgagcagugucaacuaaacugcggaggccaugaaagccaaguaacacugaagggaaaccucauauuccuagacgugccgaaauuuguagacggaucguacaugcaaacguaccacuccaccguaccaaccggcgcaaacauaccaagcccaaccgacuggcucaaugcacuguucggcaacggccucagcagauggauacucggggugauaggaguacuccugggaggacucgcgcuguucuccuuaauaauguuccuacuuaaacucggcaccaagcaaguauuuagaucaaggacaaagcucgcauga

SEQ ID NO: 16431 - RNA, 3222 nt, Artificial Sequence
  derived and/or modified CDS sequence (opt11) from SFTSV(HB155/China/2011)__JQ733563.1__GP
augaugaagguaauaugguucagcucucucauuugccucgucauacaauguuccggagacagcgguccaauuauaugcgcagggccaauacacagcaacaaauccgcgggcaucccccaucuucucggcuacuccgagaaaauaugccaaauagaccgacucauacacguaagcucuuggcuccguaaccacucccaauuccaaggcuacgucggccaacgaggcggcagaagccaagucucauacuaccccgcggaaaacuccuacagccgcuggagcggccuacucucaccaugcgacgccgacuggcucggaaugcucguagucaagaaagccaaagagucagauaugauaguacccggaccaucguauaaagggaaaguauuuuucgaacggccgacauucgacggguacguaggcuggggauguggaagcggcaagagcaggacggaaagcggagaacugugcucaagugacagcggcacaaguagcgggcuucuucccagcgacaggguccucuggauaggagacgucgcaugccaaccaaugacgcccaucccagaggagaccuuccuagaacuaaaaucauucagucaaucugaauuuccggauauaugcaaaaucgacgggauaguauucaaccaaugugaaggagagagcuugccccagccguucgacgucgccuggauggacgucggucacucacacaaaauaauaaugagggagcauaaaacaaaauggguccaagagaguaguagcaaggacuucgucugcuacaaagagggaacgggcccaugcucagagagcgaagaaaaagcgugcaaaaccagcggcucaugcaggggagacaugcaauucugcaaaguugcaggaugcgaacacggcgaggaggccucggaggccaagugccgcugcagccugguacauaagccuggcgaaguaguagugaguuacgggggcaugaggguacgcccgaagugcuacggauucucccgcaugauggcaacacucgaagugaacccacccgaacaacgaauagggcaaugcaccggaugccaccuggaaugcauuaacggaggaguccgccuaauaacacucacaagcgagcuccgaagcgccacagucugcgcaagucacuucugcuccuccgccacgagcggcaaaaagagcacugaaauccacuuccauucaggaucccuugucgggaaaaccgcaauacacguaaagggagcgcuaguagacggcacagaguucaccuucgaaggcucaugcauguucccagacggaugcgacgccgucgacugcaccuucugccgugaguuccucaagaacccucaaugcuaucccgccaagaaauggcuauucauaauaaucgucauacuucuaggauacgcagggcuaaugcuacucaccaacguacugaaagccaucggcgucuggggaagcugggucauagcaccagucaagcucauguucgccauaauaaagaaacugaugagaaccgucucaugccugguaggcaagcugauggaccgcgggcgacaagucauacacgaagaaauaggugaaaacggagaagggaaccaggacgacgugagaauagaaauggcacguccccgccgcguaaggcacuggauguacucacccgucauacuaacuauauuagccauaggacuggccgaaggcugugacgaaaugguacaugcugacagcaagcuaguuagcugucggcaagggagcgguaacaugaaagaaugcaucacaaccggccgugcccucuuaccagcagucaauccgggacaagaggcaugccuacacuucaccgcgccaggcucacccgacucaaaaugccucaaaaucaaagucaaacgcauaaaccugaaauguaagaaauccuccucuuacuucguucccgacgccagaagccgcugcacaucagugaggaggugccggugggcaggcgacugucaaucggggugcccaccacacuucaccagcaacaguuucagugaugacugggccggaaaaauggaccgagccggccuaggcuucagcggcugcagcgacggaugcggcggcgccgcaugcggaugcuucaaugccgcacccucaugcaucuucuggcgcaaauggguggaaaacccccauggaaucaucuggaaggucaguccaugugcagccuggguaccauccgcaguaaucgaauuaacaaugccaagcggagaaguacgcaccuuccaucccaugucuggcaucccuacccaggucuuuaaaggcgucagcguaacuuaccucggaucagacauggaaguaagcggucucacggaccucugcgagauugaagaacucaaaucgaaaaagcucgccuuagccccaugcaaccaagcagggaugggcgucgucggaaagguaggggaaauccaaugcuccucagaggagagugcacgcacaaucaagaaagacggaugcaucuggaacgcggaccuuguaggaaucgaguuacgcguggacgacgcaguaugcuacucaaaaauaacaucagucgaagccguagccaacuacuccgcaaucccaacaacaaucggcgggcucagguucgaacgcucccacgacucccaaggcaaaaucagcgggucaccacuugacauaaccgcgauccgcggcuccuucucgguuaacuaccgaggacuacgacuauccuuaagcgaaaucacagcaacgugcacgggagaagucaccaacguauccggaugcuacaguugcaugacaggagcuaaaguaaguaucaaacuacacuccagcaaaaacagcacugcccacguacgcugcaaaggggacgagacagccuucagcguccuagaagguguacacagcuacauagucagcuuguccuucgaccaugcggugguagaugaacaaugccaacucaacugcgggggacacgagucacaaguaacccugaaaggcaaccuuauauuccucgacgucccacgauuuguggacggcuccuacaugcaaacauaccauagcaccguaccaaccggagcaaauaucccguccccaacagauuggcuaaacgcacucuucggcaauggacugagccgauggauccucggagugaucggcguacuacuaggcggccucgccuuauucuuccugauaauguuccugcugaaacuaggcaccaaacaaguauucagaucacgcacaaagcuagcguaa

SEQ ID NO: 16432 - RNA, 3222 nt, Artificial Sequence
  derived and/or modified CDS sequence (opt11) from SFTSV(HB156/China/2011)__JQ733566.1__GP
augaugaaggugauaugguuuagcucacucauaugccuagucauccaaugcaguggggacucaggacccauaauaugcgcggggcccauacacucaaacaaaucggcaggaaucccccaucuucucgguuacucugagaagauuugccagaucgacagacuuauacacguauccagcuggcuaagaaaccacucccaauuccaggguuacguaggacaacgcggaggcagaagccaggucuccuacuaccccgcagaaaacuccuacagccgguggucaggacuccucucgccaugcgacgcagauugguugggcauguugguaguaaagaaagccaaagaaagcgacaugauuguaccaggaccaucguacaaaggcaaaguuuucuucgagcgcccaacauucgacgguuacgucggcuggggguguggcuccggaaaaagcaggacugaaucuggggaacuaugcucaagcgacagcggcacuucgaguggccuccucccgagcgacaggguacucuggauuggcgacgucgccugccaacccaugacacccaucccagaagaaaccuuucucgaacuaaagagcuucucccagagugaguucccagacaucugcaaaaucgacgguauagucuucaaccaaugcgagggggagucucugccgcagcccuucgacgucgccuggauggacgucgggcacagccauaaaauuauaaugcgagaacacaaaacaaaauggguucaggaaagcagcucuaaagauuucgugugcuacaaagaaggaacgggcccgugcucagaaucggaagaaaaagcaugcaaaacaucgggaucgugccgcggcgacaugcaguucugcaaagucgcgggaugcgagcacggcgaagaagcgucggaagccaaaugccgaugcucacuuguacacaaacccggcgaagucguggucuccuacggaggcaugcgcgucagaccaaaaugcuacggauucagcagaaugauggcuacacucgagguuaacccacccgaacaaagaaucggacaaugcaccggaugccaucuggagugcaucaacggcggaguacgacuaauaacgcucaccucagaacucagaucagcuacaguaugcgccucccacuucugcagcuccgccaccagcggcaaaaaguccacggagauccacuuccacucaggcucccuggugggcaaaacagccauacacgucaagggcgcacucguagauggaacagaguucacauuugaaggcucgugcauguucccggacggcugugacgcaguagacugcaccuucugcagagaguuccuuaaaaacccacaaugcuacccggcuaagaaauggcucuuuauuauaauaguaauucuacugggauacgcagggcuaaugcugcucacaaacguccuuaaagccauaggaguauggggcaguugggucaucgcaccagucaaacuaauguucgccauaaucaagaaacuaaugcgaacgguuuccugccuggucggaaaacugauggaccgagggcgacaagucauacacgaagagaucggcgagaacggugaaggcaaccaagacgaugucaggaucgaaauggcccgacccaggagagucaggcacuggauguauucacccgucauacucacaauccuggcaaucggguuagccgaaggcugcgacgagaugguacacgccgacagcaaacucgucucauguaggcaaggaagcggcaacaugaaagaaugcauaaccacgggccgggcccuucucccagcgguaaaccccggacaagaagccugccugcacuucacagcaccaggaagccccgacagcaaaugccucaaaaucaaagucaaacggauaaaccucaaaugcaagaaaaguagcagcuacuucgugcccgaugcccgauccaggugcacauccgugcggagguguaggugggccggagacugccagagcggaugcccuccccauuucaccaguaacuccuucagcgaugacugggcaggaaaaauggacagggccggccuaggcuucucaggcuguagcgacggcugcggcggcgcagcaugcggaugcuucaacgccgccccaagcuguauauucuggcgaaaauggguagagaacccgcacggcauuauauggaaagucucacccugcgcagccuggguaccaagugccguaauagaacuaaccaugccgaguggggaaguccgaacauuccauccuaugagcggaauaccaacacaagucuucaaaggggucucggucacauaccuaggcucagacauggaggucagcggccucacugaccuuugcgaaauagaagaguugaaaagcaagaaacuagcgcucgcccccugcaaccaggccggaaugggcgucguaggcaaagucggagagauacaaugcuccuccgaggaguccgcuagaaccauuaagaaagacggaugcauauggaacgccgaccuggucggcauagaacuccggguggacgacgcagucugcuacucgaaaauaacaucagucgaagcugucgccaacuacagcgccauaccaacaaccauaggaggacugagauucgagcgcauccaugacagucaaggcaaaaucuccggcuccccacuggacaucacagcgauccgcggcuccuucucggucaacuacagaggccuucgccugagucucagcgagaucaccgcaacguguaccggcgagguaacaaacguaucaggaugcuacucauguaugacuggggcgaaaguaucuauaaaacuacacucauccaaaaacucaacagcccacgucaggugcaaaggagacgaaacagcguucucaguucuggaaggagugcacucauauaucguaucgcuaucauuugaccacgccgucguugaugaacaaugccagcucaacugcggaggccacgaaucacaagugacccucaaagggaaccucauauuccucgacguaccgaaauucgucgauggcucauauaugcaaacauaccacucaacagucccuaccggggccaacaucccgucaccaaccgacugguuaaacgcacuguuuggcaacggcuuauccagauggauacuaggagucaucggaguacucuuaggaggccuagcacuauucuuccuaauaauguuccuacuaaagcucggcaccaaacaaguauuccgguccagaaccaagcucgcauga

SEQ ID NO: 16433 - RNA, 3222 nt, Artificial Sequence
  derived and/or modified CDS sequence (opt11) from SFTSV(HB2014-04)__KR080475.1__GP
augaugaagguaauaugguucccaucacucauaugcuucguaauucagugcuccggcgacucaggacccauaauaugcgccggcccgauccacagcaacaaaucggccgacaucccccaccuacucggcuacucggagaaaauaugccagaucgacaggcucauacacguaagcucgugguuacgcaaucacucacaguuccaaggcuacguaggccaacgcgggggcagaagucacguaaguuacuacccagcagaaaacaguuacagcagauggucaggccuccucagcccaugcgaugcagacuggcuugggaugcugguagugaagaaagcgaaaggaagcgacaugauugugccgggcccgagcuacaaaggaaaagucuucuuugaacgcccaacauucgacggcuaugugggcuggggcugcggaagcggaaagagccgaacagaaagcggagaacucugcagcagugacuccgggaccuccagcggccucuuaccaucggaucgagugcucuggauaggcgacgucgcaugccaacccaugacacccauaccggaggagacauuucuagaacuaaagucuuuuagccagucggaguuccccgacauaugcaaaaucgacggcaucguauucaaccagugcgaaggagaaucccucccacaaccauuugacgucgcauggauggaugucggacacucacacaaaauaauaaugagggaacauaaaacaaaguggguacaggaaaguagcuccaaagacuucguaugcuacaaagagggcacaggcccaugcagcgaaucagaggagaaaacaugcaaaaccucaggcaguuguaggggagacaugcaauucugcaaaguugccggaugcgaacacggagaagaagccagcgaggcaaagugccgcugcucacucguccacaaaccaggagaggucguagucucauacggcggaaugcgugugcgaccaaaaugcuacggauucucacgcaugauggcgacgcucgaggucaaccaaccagaacaacggaucggacagugcacaggaugccaccuagaaugcaucaauggcggcgugcgccuaaucaccuugacgagcgagcuaaagagcgccaccguaugcgcgucccacuuuugcaguagcgcuacgagugggaaaaagagcaccgagauacaauuccacuccggcucacuggucggcaaaacagcaauacauguaaaaggcgcgcucgucgacgggacugaguucaccuuugaaggcaguugcauguucccggauggaugcgacgcgguagacugcacauucugcagagaauuucucaagaacccucaaugcuacccggcaaagaaauggcuuuucauaauaaucgucauccugcucggauacgcaggucuaauguuacuaacgaacgugcucaaggccauaggcaucugggguucauggguaaucgcaccggucaaacugauauucgccaucaucaaaaagcucaugcgaaccgucucgugcuuaaugggaaaauugauggaccgaggacgacaagucauacacgaagaaauaggcgaaaacagggaggggaaccaagaugacgucagaaucgagauggcccgaccaagacgagucagacacuggauguacaguccagucauacugacaauacucgcaaucggauuggcugaaaguugugacgaaaugguacacgcagacucaaagcuaguaucaugcaggcaaggcuccggaaacaugaaggagugcgugaccaccgggagagcccuccugcccgccguaaacccaggccaggaagccugccuccacuucaccgcccccggcucacccgacucgaaaugccucaaaauaaaaguaaagcgaauaaaccucaagugcaaaaagagcuccagcuauuucgucccagacgcacggucaaggugcacaagcgugcgucgcuguagaugggcaggcgacugccagagcggcugcccgccacacuucacaagcaacaguuucagcgacgacugggcaggcaaaauggacagagcggggcuaggguuuuccggcugcagcgacggcuguggaggcgccgccugcggaugcuucaaugcggcccccagcugcauauucuggaggaaauggguagaaaauccacacggaauaauauggaaagucucaccaugcgccgcauggguccccucggcaguaaucgaacugacaaugccgucaggggaaguaaggaccuuccaucccaugucagguauaccgacgcaaguauucaaaggaguaagcgucaccuaucugggaucagacauggagguauccggccucacggaccuuugcgaaauugaggaacugaaauccaagaaauuagcccuggcaccgugcaaccaagcaggaaugggcguaguuggaaaaguuggggagauccagugcaguuccgaggaaucagcccguaccauaaagaaagacggcugcaucuggaacgcagaccuaguagguauagagcuccgaguggacgacgcgguaugcuacagcaaaaucacaucaguagaggccgucgccaacuacagcgccauaccaacaaccauaggaggccucagauucgagcgaagccacgacucccaaggcaaaaucucaggaucaccucuugacaucacggccaucagaggcucauucucaguuaacuacagggggcuucgccuaagccugagugaaauaaccgcaaccugcacgggcgaagugacaaacguaagcggaugcuacucaugcaugacgggugcgaaagucuccaucaaacuacacuccagcaagaacucaaccgcucacguccgauguaaaggggacgaaaccgccuucagcguccuugagggagugcacagcuacacagugagccucagcuucgaccacgccguaguugaugaacaaugccaauuaaacugcggaggacacgaaagccaagugacuuugaaagggaaucucauauuucuagacguaccaaaguucgucgacggcucguacaugcagacguaucacagcacgguuccaacgggagcuaacaucccgucuccaaccgacuggcuaaacgcccucuucgggaacggccuauccagguggauccucggaguaauuggaguucuacucgguggacucgcgcuauucuucaugauaaugagccucuucaagcucggaaccaaacaagucuuuagaagcagaucaaagcuagcauaa

SEQ ID NO: 16434 - RNA, 3222 nt, Artificial Sequence
  derived and/or modified CDS sequence (opt11) from SFTSV(HNXH)__KT254590.1__GP
augaugaagguaauaugguucagcucacucauauguuugguuauccaguguggaggagacaccggaccgauaaucugcgccggaccaauccacagcaacaagagugccgacauaccucacuuacucggauacucggagaaaaucugucaaauagacaggcucauccacgugagcuccuggcuacgcaaccacucgcaguuccaaggauauguaggucaacgcgggggccgcucccaagucucguacuauccagcagaaaacagcuacaguagauggucaggccuccuaucccccugcgacgcagacuggcuagggaugcuggucgugaaaaaggccaagggaucagacaugaucguacccggcccaucguacaaaggaaaggucuucuucgagaggcccaccuucgacggcuacguaggcuggggcugcggaucgggaaaguccagaaccgaaaguggagaacugugcucaagcgauucggggacaucgagcggccuacuaccuuccgauaggguauuauggauaggagacgucgcaugccaaccuaugaccccgauucccgaagagacuuuucucgagcugaagucauucucccaaagugaauuuccggacauaugcaaaaucgacggcauagucuucaaccaaugcgagggcgaguccuuaccccagccauuugacguagcauggauggaugucggacacucccacaaaauaauaaugagagagcacaaaacaaaguggguucaggaauccuccucaaaagacuucgucugcuacaaagaaggcacggggccaugcucagaaucagaagagaaaacgugcaaaacaucaggaagcugccggggugacaugcaauucuguaaagucgcagggugcgagcacggugaggaggccucagaggcgaaaugcagaugcagccuaguccacaaaccaggagaagucguggucagcuacggaggcaugcgagugaggccaaaaugcuacggauucucccggaugauggccacccuagaaguaagccagccggagcaaaggaucggccagugcaccggaugccaccuagagugcauaaacggagguguccgacuuauaacccugacaagcgaacuaaaguccgcaaccgugugcgccagccacuucugcagcuccgccacgagcggaaagaaaaguacagaaauacaauuccauagcggaucgcugguuggcaaaacugcuauacacguaaagggagcgcucguagauggaacagaguucacguucgaaggaucgugcauguucccagacgggugcgacgcaguggacuguaccuucugcagggaguucuugaagaacccacaaugcuacccagccaaaaaguggcuauucaucauuaucgugauucuacuaggauaugcaggauuaaugcuccucacgaacgugcuuaaggcaauaggcgucuggggcagcugggugauagccccgguaaagcucguguucgcacucauaaagaaacuaaugcgcgcaguaaguuguuuaaugggaaaacugauggaccgcggacgccaggugauacacgaggagauuggggagaaucgcgaaggcaaccaagaugacguaaggauagagauggcgcgcccgagacggguaagacacuggauguacagcccaguuauucuaacgauacuggccauaggcuuagcagaaggaugcgacgaaaugguucacgcagauucgaaauuagucucgugcaggcaaggcagcggaaacaugaaagagugcgugaccacugggagagcacuguuaccagcagugaacccaggccaagaagccugccugcacuuuaccgcacccggaagccccgacucaaaaugccucaagauaaaagucaaacgcauaaaccuaaaaugcaaaaagagcucaaguuacuuuguaccagacgcuagaagccgaugcaccagcgugcgcagaugccggugggcaggagacugccagagcggcugcccaccacacuucacaucaaauagcuucucagacgauugggcuggcaaaauggacagagcuggccuagguuucucgggcugcagcgacggaugcggcggagccgcgugcggaugcuucaacgcagccccauccugcauauuuuggcggaaauggguagagaacccacacggaaucauauggaagguaucgcccugcgccgcaugggugcccagcgccgugauagaacucacgaugccguccggagaggugcgcacauuccacccaauguccggaaucccgacacagguauucaaaggaguaucagucacauaccugggcagcgacauggaagugagcggccuaacggaccuaugcgagaucgaggaacucaaaucaaagaaacucgcccucgcgcccugcaaccaagcggguaugggaguuguaggcaaagucggggaaauacaaugcagcucggaagagagcgccagaacaauaaagaaagacggaugcaucuggaacgcggaucuaguaggaaucgaacuaagggucgaugaugccgucugcuauuccaaaaucaccucgguagaagcaguagccaacuacuccgcaaucccgacaaccauaggcggccugagauuugagagaucacacgacagccaagggaagaucagcggaucgccccuggacauaacagcgauaagagguuccuuuuccguaaacuaccggggacuaagacucagcuuaagcgaaauuacggcaaccugcacaggagaagucacgaacgucagcggcugcuacagcuguaugacgggcgcaaaagugagcauaaaacugcacucgagcaaaaacaguacugcacacguacgauguaaaggagaugagacagcauucuccguucuagaggggguccacaguuacuccgucagccuaaguuucgaccacgcggucgucgaugagcagugucaacucaacugcggaggccaugaaagccaaguaacauugcgcggaaaccugauauuccuugacgucccaaaguuuguugacggaucguacaugcaaacauaccacagcaccgugccgaccggcgccaauauaccaagcccgaccgauugguuaaaugcacuauucggaaacggacugucacgguggauccuuggagugacggguguccuccuaggcggccuagcccuguucuuucuaaucaugagccuauuuaagcugggaacaaaacaaauuuuccgaagcaggacuaagcucgcguga

SEQ ID NO: 16435 - RNA, 3222 nt, Artificial Sequence
  derived and/or modified CDS sequence (opt11) from SFTSV(JS2012-goat01)__KC473538.1__GP
augaugaaaguaaucugguucagcucccuaaucugcuucgugauucaaugcucaggagacagcggcccaaucauaugcgcggggccaauacacuccaacaaaucggcagacaucccacaccuucuaggguacucggagaaaaucugccagauagaccgguuaauccacguaucaucaugguuacgaaaucacucccaauuccaaggguacgucgggcaacgcggcggaaggucacaagucagcuacuacccagcagagaacagcuacucacgauggucuggccuacucucacccugcgacgcggacuggcucggcaugcugguggucaaaaaggcaaaagguuccgacaugauaguaccaggucccucguacaaaggcaaggucuuuuucgaaagaccaaccuucgauggcuauguaggauggggcugcggaagcggaaaaagccggaccgagagcggcgagcucugcucaagcgacagcggcaccagcagcggacuucucccauccgacagaguccuauggauaggcgauguggcaugccagcccaugacccccaucccagaagaaaccuuccucgaguuaaagagcuucagccaauccgaguucccagacauaugcaaaauagauggcauaguauucaaccagugcgaaggagagagccuaccccaacccuucgacguggccuggauggaugucgggcacagucauaaaaucauaaugagagagcauaaaaccaaauggguccaggaguccucauccaaagacuucgugugcuauaaagaggggacgggaccaugcucagagucagaagagaaaacaugcaaaacguccgggucgugccgcggagacaugcaauucugcaaagucgccgggugcgaacacggagaagaggcaagcgaagcgaagugccgcugcagucuaguacacaaaccaggcgaaguggucgugagcuacggaggcaugagaauaagacccaagugcuacggguucagccggaugauggcgacccucgaaguaaaccaaccagaacagcgacucggccaaugcaccggcugccaccuggaaugcauaaacggcggcgucagacucaucacccugacaagcgaacucaaguccgcuaccgucugcgcaagccacuucugcucgagugcaacgagcggcaagaaaaguacagagauccaauuccacuccgggucacucguaggcaaaacggcaauacaugugaaaggagcccuagucgacgggaccgaguucacuuucgaaggcuccugcauguuuccagacggaugugacgcaguggauugcaccuucugcagagaguuccuaaagaacccccaaugcuacccggcaaagaaauggcuauucaucaucaucgugauccuccucgguuacgcaggauuaaugcuauuaacaaacgugcuaaaagcaaucggaauauggggaagcuggguaauagcccccguaaaacugauguuugcaauaauaaagaaacucaugcgcacgguauccugccuaaugcggaaacuaauggaccggggacgccaggucauacacgaagaaauaggagaaaaccgagaaggcaaccaggacgacguccgcauagaaauggcucgacccagaaggguuagacacuggauguauagccccguaauacuaacgauccuggccaucggauuggccgaaucaugcgacgaaaugguacacgcagacucgaaauuagucuccugcagacaaggaagcggcaacaugaaagaaugcgucacgaccggccgugcacuacucccggccguaaaccccggccaggaggcuugccuccacuucaccgcacccggauccccagacucaaaaugucuaaaaauaaagguaaagcgcaucaaccucaagugcaagaaaucauccagcuacuuugucccagacgcgagaagcagaugcacuagcguacggcguuguaggugggcaggcgauugccaaucaggcugcccgccccacuuuacauccaacaguuuuagcgacgacugggccgggaaaauggauagagcuggacucggauucucgggcugcagcgacggcugcggcggcgcggcuugcggaugcuucaacgcugcccccucaugcaucuucuggcgaaaauggguagaaaacccgcacggaauaauauggaaagucuccccaugcgccgccugggugccaagcgcagugauugaacucacgaugccaagcggcgaaguaagaacauuccaccccaugagcgggaucccaacccaaguauucaaaggagugagcguaaccuaccucggcagcgacauggaaguaagcggacuaacggaccuaugcgaaauagaggaacucaaaagcaaaaagcucgcacucgccccuuguaaccaggcaggcaugggcguaguaggcaaggucggcgaaauccaaugcaguucagaagagagcgcaagaacuauaaagaaagacggcuguauauggaacgcagaccucguaggaaucgaacugcgcguagacgacgcaguaugcuacucaaaaaucacgagcguagaagccguagccaacuacagugcaauacccaccaccaucggcggacuccgguuugaaagaucgcuagauagccaaggcaaaauuagcggcucaccccucgauaucacagccauaagagguucauucagugugaauuaccggggccuacgcuuaucgcugagcgagaucacagcaaccugcacgggcgaggucacgaacgucagcggcugcuacucauguaugacgggcgccaaggugucaaucaaacuccacagcagcaaaaacucaacagcacacguccgcugcaaaggggaugagaccgcguucucgguacuggaggggguccacagcuacaccguaagucugagcuucgaccaugcaguggucgacgaacaaugccaacucaacugcggcggacacgaaucacaaguuacacucaaagggaacuugauauuccucgacguccccaaauucgucgacggaucauauaugcaaacguaccacagcaccguaccaacaggggcaaacauccccucaccgaccgacuggcugaacgcgcuguucgggaacggacugucuagguggauucugggcgucaucggugucuuacugggcgggcuagcgcuauucuucaugauaaugagccuguucaaacucggcaccaaacaaguuuuccgcagcaggacuaaacuagcuuaa

SEQ ID NO: 16436 - RNA, 3222 nt, Artificial Sequence
  derived and/or modified CDS sequence (opt11) from SFTSV(JS2012-tick01)__KC473541.1__GP
augaugaaaguaauaugguucuccucacucauaugcuucgucauccaaugcagcggagacuccggccccauaauaugcgcaggucccauacauagcaacaagucagccgacauaccacaccuacuaggauacucugagaaaauaugccaaaucgaccgacuaauacacguaagcucauggcugcggaaccauucccaauuccaaggauacguaggacaacgaggcggacgaucccaagucucuuacuaccccgccgaaaacucuuacaguagauggucgggccucuugucaccaugcgacgccgauuggcucgguaugcucgugguaaagaaagccaaaggauccgacaugaucguaccagggcccucauauaagggaaaggucuucuucgaaagaccaaccuucgacggcuacgucggcugggggugcggcucaggaaagaguagaacggaaaguggcgaacuauguucgucugacuccggaacaaguuccggcuuacuucccagcgaccgaguacuguggaucggcgauguugcuugccagccgaugacucccaucccggaggaaacauuccuagaacugaaaucauucagccaaagcgaguuccccgacaucugcaaaaucgacggaauagucuucaaccagugcgaaggcgaaagccucccucagcccuucgacgucgcauggauggacgugggccacucucacaaaauaauaaugagagaacacaaaaccaaguggguacaggaaucgucgagcaaggacuucguaugcuacaaagaagguaccggcccaugcuccgaaagcgaagagaaaacgugcaaaacuagcgggucaugccgaggagacaugcaauucugcaaagucgcuggaugugaacacggagaagaagccuccgaagcaaaaugucgcugcucacucguacacaaacccggagaagucguaguaucuuacggcgguaugagagugcgccccaaaugcuacggauucucgcgcaugauggcuacccucgaggucaaccaaccggaacaacgacugggccaaugcacaggaugccaccucgagugcauaaacggcgggguccgguuaauaacgcuuacgucagaacucaaaucagcgacagucugugcaagccacuucugcucaucggccacaagcgggaagaaauccaccgaaauccaauuccacuccgggagucuagucggcaaaacagcaauacacgucaaaggcgcccuaguagacggcaccgaguucacauucgaaggcuccugcauguucccagacggcugcgacgcgguagacugcacauucugccgagaguuccuuaaaaacccgcaaugcuacccagccaagaaauggcuauuuaucauaaucguaauauuacucggguacgcuggccucaugcuccuaaccaacguccugaaagccauaggcauaugggggaguuggguaaucgccccagucaaacuuauguucgcaaucaucaagaaacuaaugcgcaccgucuccuguuuaaugagaaaacuaauggaucgcgggcggcaaguuauccacgaagaaaucggagaaaacagagaaggcaaccaagacgacguucgcauagaaauggcacgaccccgccgaguccgccacuggauguacagcccagucauacuaacgauccuggcaaucggcuuggccgaaucgugugacgaaaugguacacgcggacuccaaacucguaagcugccgccagggcuccgggaauaugaaagaaugcguaacaacaggucgcgccuuacucccagcgguaaacccgggacaagaagcgugucuacauuucaccgcaccaggcuccccagacucaaaaugccucaaaaucaaggucaagcgcauaaaccuaaagugcaagaaaagcagcagcuacuucgugcccgacgccagaagcagaugcaccuccguucgccgcuguagaugggccggcgacugccaauccggcugcccgccccauuuuacaucuaauucuuucucugacgacugggcaggcaaaauggaccgcgccgggcucggguucucggguugcagugauggcugcggcggagccgcaugcggcugcuucaaugccgcccccuccugcaucuucuggagaaaauggguggaaaacccccacggcauaauauggaaaguuucacccugugcagccuggguuccauccgccgugauugagcuaacaaugccgagcggggagguacgcacauuccaccccauguccggcaucccuacccaaguauucaaaggcguauccgugaccuaccucggcucggauauggaagugagcggccuaacagaccuaugcgaaaucgaggaacuaaaaucgaagaagcucgcccuagccccaugcaaccaagccggaaugggagucgucggcaaaguaggagaaauacaaugcagcucagaggaaucagcacgaacaaucaaaaaggacggcugcauauggaacgccgaccucguaggcauagaacucagagucgacgaugccguauguuacuccaagauuaccagcgucgaagcggucgccaacuauuccgcaauacccacaaccaucggcggacuaagauucgagcgcucacacgacagccaaggcaaaaucucaggcucaccucucgacauaaccgcgaucagaggcagcuucuccguaaacuaccggggcuugcgucuaagccugagcgaaauaaccgccacaugcaccggcgaaguuaccaacguaagcggcuguuacagcugcaugaccggagccaaagugucaaucaaacuucacucauccaagaacucaacagcccacguccgcugcaaaggcgacgagacagccuucucuguacuggaaggaguucacagcuacaccguaagccucucguucgaccaugcaguaguggacgagcaaugccaauuaaauugcgggggacacgaaucccaaguuacccuuaaaggaaaccuaaucuuucucgacguacccaaauucgucgacggcucguacaugcagaccuaccacagcacaguaccaacaggcgcaaacaucccauccccuacagacuggcuaaacgcccucuucggcaacggacuaagccgguggauccucggcguuauaggagugcuccuaggcggauuagcgcuauucuucaugaucaugucucuauucaaauuaggaaccaagcaagucuucagaucgagaaccaagcucgcguga

SEQ ID NO: 16437 - RNA, 3222 nt, Artificial Sequence
  derived and/or modified CDS sequence (opt11) from SFTSV(LN2012-14)__KF887436.1__GP
augaugaaggugaucugguucuccucccucaucugcuucgugauacaaugcucuggagacuccggcccaauaaucugcgcggggccaauucauuccaacaaaucagcugauauaccccaucuccuugguuacucagaaaagauaugccaaauugaccgacuaauacacgucuccuccuggcuaagaaaccacagccaauuccagggauacguaggacaacgcggcggucgaucccaggugucauacuaccccgcagaaaacuccuacagcagauggucagggcuacucucacccugugacgccgauuggcucggaauguuaguaguaaagaaagcuaaaggaucugauaugauaguccccggccccaguuauaaggggaaagucuucuucgagcgaccaacauucgacggcuacguaggauggggcugcggcucagggaaaucgaggacggaguccggagaauuaugcuccagcgacagcggcacaagcagugggcuacugccaagcgaccgaguacuauggaucggcgacgucgcgugccaacccaugaccccaauccccgaagaaaccuuucuagaacuuaagagcuucucccagucggaguucccagacaucugcaaaauugacggcauagucuucaaccaaugcgaaggcgaaagccucccacaacccuucgaugucgcguggauggaugucggccacagccacaaaaucaucaugcgcgaacacaagacaaaauggguacaagaauccagcagcaaagacuucguaugcuacaaagaagggaccggcccaugcuccgaaucagaggagaaaacgugcaagacauccggaucaugcaggggagacaugcaguucugcaaaguggcaggaugcgaacacggcgaagaagcaucggaagccaaaugccgaugcagccucguccacaaaccaggagaaguaguggucucauacgggggcaugcggguccgcccaaagugcuacggauuuucacgcaugauggccacgcuagaagugaaucaaccagaacagcgcaucggccaaugcacaggaugccaccuggaauguaucaaugggggcguccgacucaucacacucacauccgaacuaaaaucagcaaccguaugcgcgagccacuucugcuccuccgcaacauccggaaagaaauccaccgaaauccaguuucacucgggcagucucguuggaaaaacagcaauccacguaaaaggcgcacucgucgacggcacggaguucacguucgaaggaaguugcauguucccggacggaugcgaugccguugacugcaccuucugcagagaauuucucaaaaacccccagugcuacccagccaagaaauggcucuuuauuaucaucgugauacugcuaggcuacgccggccuaaugcuucucacgaacguccucaaagcgaucgguauauggggcuccuggguaaucgcccccgucaaacuaauauucgcaaucaucaaaaagcuaaugagaacagucagcugccugaugggcaaacuaauggaccgaggacgucaaguaauacacgaagaaauuggcgaaaauagagaaggaaaccaagacgacguauggaucgaaauggcgcgaccccgaagggucagguauuggauguacaguccaguaauccuaacaauccucgccguaggccuagccgagagcugugacgaaaugguacacgcagacucaaaacucgucucaugucgacaaggaagcgggaacaugaaagaaugugucaccaccggccgcgcccuacuacccgccgucaacccaggccaggaagcgugccuccacuucacagccccaggguccccggacucaaaaugccuuaagauaagagucaaaaggauuaaccuaaagugcaagaaauccagcuccuacuucgucccagacgcacgaucccggugcacaagcguucgacgaugccgcugggcaggagacugccaaucaggcugucccccacacuucacauccaacagcuucagcgacgacugggucgguaaaauggaccgcgccgggcucggauucucaggaugcagcgacggcugcggaggagccgcaugcgggugcuucaacgcugcgccgagcugcaucuucuggagaaaaugggucgaaaacccacacggcaucaucuggaagguaucaccaugcgccgcaugggugcccucggcagugauagaacuuacaaugccaaguggcgaaguacgcacguuccacccaaugucggggauaccuacccagguauuuaaaggcguaucaguaacguaucucggauccgauauggaaguaagcggacuaaccgaccuaugcgagaucgaggaacugaagucaaagaaacucgcacucgcgccaugcaaccaggccgguauggggguaguaggcaaagucggcgagauccaauguuccuccgaagagucggccagaacaauuaagaaggacggaugcauauggaacgccgaccuaguagguauugaacucagaguagacgaugccguuugcuacagcaaaauaaccagcgucgaggcgguagcaaauuauucagccauccccacaacaaucggcggacuaagauucgagcgaucccacgacagccaaggcaaaaucuccggauccccacuagacauaaccgccauccgagggagcuuuucaguaaacuaccgagggcuccgccugucccucuccgagauaacggcgaccugcacaggugagguaacaaacgugaguggaugcuacaguuguaugacaggagccaaaguaagcauaaaacuacacuccaacaaaaauuccaccgcccacguccgcugcaaaggagaugaaaccgcauuuagcgugcuagaaggcguccacagcuacaccguauccuugaguuucgaccacgcugucgucgacgagcaaugccaacucaacugcggcggacacgaaagccaagucacacuaaaaggcaaucucauauuccuugaugucccaaaauucgucgacggcagcuacaugcaaacauaccacucuacaguuccaaccggggcaaacauccccucccccacugacuggcucaacgcucucuucgguaauggacuaucgagauggauacucggaguaaucggcguacugcugggcggacucgcccuauuuuucaugaucaugagccuauucaaacuaggcaccaagcaaguguucagaagccgcaccaaacucgcauaa

SEQ ID NO: 16438 - RNA, 3222 nt, Artificial Sequence
  derived and/or modified CDS sequence (opt11) from SFTSV(LN2012-34)__KF887437.1__GP
augaugaaagucauaugguuuuucagccugauaugcuucguaauacaaugcuccggugacucgggcccaauaauaugcgcgggccccauacacuccaacaaaucagccgauaucccacaccuacuaggcuacucagaaaagauaugccaaaucgaccgacuuauccauguaucuucauggcuucgcaaccacucacaauuucaaggauauguaggacagagagggggcagaagccaggucagcuauuacccagccgaaaacagcuacucccgcugguccggcuugcucucacccugcgacgcagacuggcucgggaugcuaguagugaagaaagcaaaggggucugacaugauagugccaggacccuccuauaaggguaaggucuucuucgaacgacccaccuucgacggguacgucggcuggggcugcggaucaggcaaguccaggaccgaaagcggggaacugugcagcagcgacuccggcaccucgagcgggcuacuccccagcgacaggguccuguggauaggcgacguggcgugccaaccaaugacccccauaccggaagagaccuuccucgagcugaagucauucucacaauccgaguucccggacaucugcaagauugacgguauaguauuuaaccaaugcgaaggcgaaagccugccccagcccuucgacguagccuggauggacgucgggcacucccacaagauaauuaugcgagaacacaaaacaaaauggguacaggaauccagcaguaaagacuucguauguuacaaagagggcaccggcccaugcucagagucagaagaaaagacuugcaaaacgucgggcucuugccgaggggacaugcaauucugcaaagucgccggcugcgaacacggagaagaagccagcgaagccaaaugucgaugcagcuuaguacacaaacccggcgaagucguggugucauacggcggcaugcgcauaagaccuaaauguuacggguucucgagaaugauggcgacccuagaagucaaccagcccgaacaacgaaucggccaaugcacaggcugucaccucgaaugcauuaacggcggagucagacucaucacacucacaagcgaacucaaaagugccaccguaugcgccagucacuucugcagcucagccaccagcgggaagaaauccacagaaauacaguuccacucgggcucacucguaggcaaaacggcgauacacguuaaaggagcgcucguagacgggacugaguucaccuucgaagggucaugcauguucccggacggaugcgacgccgucgacuguacauuuugccgagaguuccuaaagaacccgcagugcuacccagcuaagaaauggcuauucaucaucaucguaauccuacuaggcuacgcaggacuaaugcuccucacaaacgugcucaaagcaauagggauauggggguccugggucauugcuccggucaaacugauauucgccaucauaaagaagcucaugcgcacgguauccugccuaauggguaaacugauggaccgcggcagacaggugauccacgaagaaauaggcgaaaaccgagaagggaaccaggacgacgucagaaucgaaauggcacggccccgaaggguacgccacuggauguacagcccaguuauccuuaccauccuagccauaggccuggccgagaguugcgacgagaugguccacgcagacuccaaacuggucucaugccgacaaggcagcggaaacgugaaagaaugcgugaccaccggcagagcacuccucccagccgugaacccuggucaggaagcgugccuccacuucaccgccccaggaucccccgacucuaaaugccugaagauucgagugaagaggaucaaucugaaaugcaaaaagaguagcuccuacuucguacccgacgcaagguccagaugcacaucagugcgcagaugccgcugggcaggcgacugucagagcggcugcccaccccauuucaccuccaacuccuucucagacgacugggcagggaaaauggaccgcgcaggacuuggguucuccggcugcagcgacggcugcggaggcgccgccugcgggugcuucaaugcagcaccaaguuguauauucuggcgaaaaugggucgagaacccgcaugggauaauuuggaagguaucgcccugugccgcguggguaccgucagccguaauagagcuuaccaugccgagcggagaggucagaaccuuccacccaaugucaggcauaccgacccaaguauucaaaggaguaucaauaaccuaccuagguagcgacauggaaguaagcggacuuaccgaccucugcgagauugaggaacuaaaaagcaagaaacuagcccucgcuccaugcaaccaagcggggaugggagucguggggaaggucggcgaaauccaaugcuccagcgaagagagugcacgaaccaucaaaaaggacggcugcauauggaacgccgaccuagucggaaucgaacuccgggucgacgacgccgucugcuacucuaaaaucaccuccgucgaagccguggccaacuacagcgccauacccacaaccaucggcggccucagguucgaacgcucccacgacagccagggcaaaaucagcggcucgccucucgacaucacggcaauacggggcagcuucucaguaaacuaccgcggccuacgccugagccucagcgagauaacagcaaccugcaccggagaagucaccaacguaaguggcugcuacaguugcaugacaggcgccaaaguauccaucaaacuccacucaaauaaaaauuccaccgcacacgugcgaugcaaaggggaugaaacagcuuucucaguccuggaaggaguacacuccuauacuguaucccucagcuuugaccacgccguaguagacgagcagugccagcuaaauugcgggggacacgaaagccaggucacccuaaaaggaaacuuaauauuccuugacgucccaaaauucgucgacggaucauacaugcaaaccuaccacucaaccguccccacaggcgccaacaucccaagcccaaccgacuggcuaaacgcgcuguucggcaacggacuaagcagauggauacucggcguaauaggaguccuccuaggcggccucgcgcuguuuuucaugaucaugaguuuguucaaacuagggacaaaacaggucuuucgaagccgcaccaaacuagccuga

SEQ ID NO: 16439 - RNA, 3222 nt, Artificial Sequence
  derived and/or modified CDS sequence (opt11) from SFTSV(LN2012-41)__KF887438.1__GP
augaugaagguaauaugguucagcucacugauaugcuucgucauccaaugcucgggcgauucaggaccgaucauaugcgcgggacccauccacaguaauaaaagugcggacaucccgcaccuucuuggauacucagagaaaaucugucaaaucgacagacucauacaugucucaucauggcuucgcaaccacucccaauuccaaggguacgucggucagagagggggccggucccaagugucguacuacccagcagaaaacucuuacagcagauggagcggccuacuaucccccugcgacgcagacuggcuagggaugcucguuguaaagaaagcgaagggcagcgacaugaucgugcccgggccauccuacaaaggcaaagucuucuucgaacgccccacauucgacgguuacguaggaugggggugcggauccggaaaaagcagaacagaaagcggggaacuaugcagcuccgacagugggacaagcucaggccugcugcccagugacagaguacuauggaucggagacguagcaugccaacccaugacaccaauacccgaggaaacauuccuagaacuaaaaucauucagccaaucggaguucccggacauaugcaagauagacgggaucguauucaaccaaugcgaaggcgagagccugccgcaaccauuugacguagcauggauggacguagggcacagccacaagauaauaaugagagaacacaaaacgaaaugggugcaggaaucuagcucaaaagacuucguaugcuacaaagaaggaaccggaccguguucggaaagcgaagagaaaaccugcaaaaccaguggcagcugccgcggagauaugcaguucugcaaaguggccggaugcgaacacggcgaagaagcaagugaagcaaaaugccgcugcagccucguccacaaaccaggcgaaguggugguaagcuacgggggaaugagagugcgcccgaaaugcuacggauucucgcgaaugauggcuacacuagaaguaaaccaaccggaacagaggaucggacagugcaccgggugccaccuugaaugcaucaacggaggcguaagauuaaucacgcucacaucggaacucaaauccgcgacagugugcgcgagccacuuuugcagcucagcaacuuccggaaagaaaagcacagagauacaauuccacucgggcagccuaguaggaaaaacagccauucacgucaaaggcgcacuuguagacggaaccgaguucacauucgagggaucauguauguucccggacggcugcgacgcaguggauugcacauucugcagagaguuccuaaagaacccacaaugcuaccccgccaagaaauggcucuuuauaauaauaguaauccuauuaggguacgcaggccucaugcuacucacaaacguacuuaaggcuauaggcauauggggcaguugggucaucgccccaguaaagcucaucuucgcgaucaucaagaaacugaugaggacgguaucaugccucaugggaaaacugauggacagagggcgacagguuauucacgaagaaauaggcgaaaaccgagaaggaaaucaagacgacgugcgcaucgaaauggcacgcccccgccguguccgacacuggauguacucccccgucauacucaccaucuuggccaucggcuuggccgagagcugcgacgagauggugcaugcagacucaaagcuagucucgugcaggcaaggaucaggaaacgugaaagaaugcgugaccacaggcagagcauuacugccggccguaaauccgggccaagaggcuugccuccacuucaccgcacccggaucccccgacucaaaauguuuaaaaaucagggucaaacguauaaaccuaaaaugcaagaaaucaaguagcuacuucguaccggacgccagaagcagaugcaccuccgucagacgauguaggugggccggugacugccaaagcggcugcccaccgcacuucacaaguaacaguuuuagcgacgacugggcagggaaaauggaccgcgcaggacuuggcuucucggguuguagcgacggaugcggcggcgccgcgugcggaugcuuuaaugccgccccaagcugcaucuucuggagaaaauggguggaaaauccccacggcauaauauggaaaguaucacccugcgcagccugggucccaagcgcuguaauagaacuaacuaugccaagcggcgaagugcggacauuccaccccaugagcggaaucccaacgcagguauucaagggagucuccguaacguaccugggcuccgacauggaagucagcggacuaacagaccugugcgaaaucgaagaacucaaaucgaagaaacucgcgcucgcccccugcaaccaagccggcaugggcgugguaggcaaaguaggagagauccaaugcaguuccgaagaaucggcaagaacaaucaaaaaggauggcugcaucuggaacgcggaccuugucggaauagaacucagaguggacgacgcaguaugcuacucgaagaucaccucugucgaggcuguuguuaacuacucagccauaccaacgacaauaggagggcuaagauucgagcgaucccacgacucccaaggaaaaaucucgggcucgccccuagacaucaccgcaauccgaggaucauucucagucaacuaccgaggacuacguuuaucccugucagagauaaccgcaaccugcacgggagaaguaaccaacguauccgggugcuacagcugcaugaccggcgcaaaaguaagcaucaaacuacacucgaacaaaaauucaaccgcacacguccgcugcaaaggagacgaaaccgcauucagcguccuagagggaguccauucauacaccguaagccucagcuucgaucacgccgucgucgacgaacaaugccaacuaaacugcggcggacacgagagccaagucacccucaagggcaaccuaaucuuccuggacguacccaaauucgucgacggcucauacaugcaaacauaccacaguacaguaccaaccggagccaacauuccgagcccaaccgacuggcucaacgcacucuucggcaacggccucucccgcuggauccuaggagucauaggaguacucuuaggcggacuagcacuauucuuuaugauaaugagccuauucaaacuuggaaccaagcagguauuccgaagccgcacgaaacuagcauga

SEQ ID NO: 16440 - RNA, 3222 nt, Artificial Sequence
  derived and/or modified CDS sequence (opt11) from SFTSV(LN2012-58)__KF887440.1__GP
augaugaaagucaucugguucagcucauuaaucugcuucgugauacaaugcagcggagacagcggcccgaucaucugcgcagggccuauccauuccaacaaaucggccgauaucccccaucugcucggauacucggagaaaauaugccaaauagacaggcucauacacgugucguccuggcuaagaaaccacucucaguuccaaggauacgugggccagagagguggacgaagccaggucucauacuacccagccgaaaacagcuacagccgaugguccggcuuacuaucccccugcgaugcggacuggcuggguaugcuggucguaaagaaagcgaagggaucugauaugaucguacccggcccuuccuacaaaggcaaagucuucuucgaacgacccacguuugacggauauguaggauggggcuguggcucaggcaagagccgcaccgaauccggagaacucugcagcucagacagcgggacaucauccggauuacucccaagcgacagaguccuauggaucggagacguagcaugccaacccaugacccccauaccagaagaaacauuccuagaacuaaagucguucagucaguccgaguuccccgacaucuguaaaaucgacggcaucgucuuuaaucaaugugagggcgaaucccuuccacaaccauucgacgucgccuggauggauguuggccacucccacaagaucauaaugcgagagcacaaaacuaaauggguccaagaaucaaguagcaaagacuucguuugcuacaaagaaggcacagguccgugcagcgaaagcgaagagaaaacaugcaaaacaucaggaucaugccgcggagacaugcaauucugcaaaguagccgguugcgaacacggcgaagaggcaucagaagcaaagugccgcugcagccucguccacaaaccaggagaaguaguagucagcuacgggggcaugcgcguacgacccaaaugcuacgguuucucacgcaugauggccacucuugaggucaaccagccagugcaacgaauaggccaauguacaggcugccaccucgaaugcaucaacggagggguacgcuuaaucacacucacuucagaacuaaaaagcgccaccguuugcgccagccacuucuguagcagcgcaaccagcggaaagaaaagcaccgagauacaauuccacuccggcagucuaguuggaaaaaccgcgauacacguaaagggggcacucguagacggcacagaguuuacauucgaaggaucaugcauguucccagauggaugcgacgcaguagacugcaccuucugccgggaguuccugaaaaauccccaaugcuauccggcaaagaaauggcuauucaucauaaucgugaucuugcuaggauacgcaggccuaaugcuccuaaccaacguacuuaaagcuauuggcauauggggaagcuggguaauagcacccgucaaacuuauauucgcgauaauaaagaaacucaugaggacagucucgugccugauggggaaacuaauggaccgaggccgccaaguaauccacgaagaaauaggggaaaaccgagaaggcaaucaagacgaugugcggauagaaauggcacgcccgagacgaguucgccacuggauguacagcccagucauacucacaauucuaguaaugggucuggcagaaucaugcgacgaaauggugcacgcggacucaaaacucguaagcugcagacaaggaagcggcaacaugaaagaaugugucaccacgggccgagcccuacugcccgccguaaaccccggccaagaagcaugcuugcacuucaccgcaccagggagcccugacagcaaaugccuuaaaaucaaagucaaacgaaucaacuuaaaaugcaaaaaguccucaagcuauuuuguaccugacgcaagaucacgaugcaccuccguucgaagaugccgaugggcuggagacugccagagcggcugucccccacacuucacgagcaacagcuucagcgacgacugggccggcaagauggacagagccgggcuaggcuucucaggcugcagcgacggaugcggaggagccgcaugcggcugcuucaacgccgcgccuagcugcaucuucuggcguaaguggguagaaaacccucacggcaucaucuggaaagucucccccugcgcagccugggucccaucagcagugaucgagcugacaaugccaucaggggaggugcgcaccuuccacccuaugucagguaucccaacacaagucuucaaagggguauccguaacauaccucggcagcgauauggaggugagcggccugacggaccugugcgaaauagaagaacugaaaagcaaaaagcucgcccuugcccccugcaaccaagcaggcaugggagucgucggaaagguaggcgaaauacaaugcagcuccgaagaauccgcacgaacgaucaagaaagauggcugcaucuggaacgccgaccuuguagguauagaacuacgggucgacgacgcggugugcuacaguaaaaucaccucggucgaggcaguagcaaacuacucugcaauccccacuaccauaggaggccuacgauucgaacggagccacgacagccagggcaaaaucucgggauccccgcuggacauuacagccauacggggcucauuuuccgucaacuaccggggguuacgcuugagccucagcgaaaucaccgcaacaugcaccggcgaaguaaccaacguauccggaugcuacuccugcaugacaggcgccaaagugucaaucaaacuacacuccagcaagaacucgaccgcucacguucgauguaaaggagacgaaaccgccuucuccgucuuggaggggguccauuccuacacaguaagccuaaguuuugaccaugcaguagucgacgagcagugccagcucaacugcgguggccacgaaagccaggucacccuaaaaggaaaccuaaucuuccucgacgucccgaaauucgucgauggcuccuacaugcaaacauaccacagcacggucccaacuggagcaaacauccccagccccacagacuggcucaacgcacuuuucggcaauggacuaucacgauggauacuaggggucauaggcgugcuccugggaggccucgcccuguucuucaugaucaugucacuguucaaacuaggaacuaagcagguauucagaucccgaaccaaacuagcuuga

SEQ ID NO: 16441 - RNA, 3222 nt, Artificial Sequence
  derived and/or modified CDS sequence (opt11) from SFTSV(NB24/CHN/2013)__KR698337.1__GP
augaugaaagucauaugguucagcucucucauaugccucguaauacaaugcagcggagacaccgggccaaucauuugcgccgggcccauacacucaaacaaguccgcagacaucccucaccuacucggcuauagcgaaaagaucugccaaaucgaccggcucauacacgucuccuccuggcuccggaaccauagccaguuccaaggcuacgucgggcagcgaggaggcaggucgcaaguaagcuacuacccagcggagaacagcuacagcagauggagcggguugcucagcccaugcgaugcagacuggcuaggaauguuagucgucaaaaaggcuaaaggcuccgacaugaucguaccaggccccuccuauaaaggaaaaguauucuucgaacgcccgaccuucgacggguacguaggcugggguugcggaucaggaaagagcagaaccgaaucgggggaacucugcagcagcgacagcggcacaucgagcggacugcucccaucggaccgaguccucuggaucggcgacguagcaugccaaccgaugaccccuauaccggaggagacguuccuagaacuaaagagcuucucacaauccgaguucccagacaucugcaaaaucgacggaaucguauucaaccaaugcgaauccgaaagccuaccccagccauucgaugucgcguggauggauguaggacacagccacaaaaucauuaugcgagaacacaagacaaaauggguacaagaaagcucaucgaaagauuucgugugcuauaaggaaggcaccggcccuugcagugagucggaagaaaagacaugcaaaacguccgggagcugcagaggggacaugcaguucugcaaagucgccggaugcgaacacggagaagaggcaagcgaagcgaaguguaggugcagccucguacacaaaccgggagaggucguagucucguacggcggcaugcgcguacgaccgaaaugcuacggauuuucacgaaugauggcaacccuggaaguaaacccuccagaacaacgcauaggacaaugcacaggaugccaccuggaaugcgucaacgguggagugagacuuaucacccucacaagcgaacucaaaagcgccaccgucugcgccucucacuuuugcagcucagcaacauccgggaagaaaagcacggaaauacaguuccacagcggaucccucguagggaaaacggccauccacguaaaaggcgcccuaguagacggaacagaguucacuuucgaaggcuccugcauguucccagacggcugcgacgcaguagacuguacauucugcagagaguuccugaaaaacccacaaugcuaucccgcaaagaaauggcuauuuauaaacaucgugauccuccugggcuacgccggauugaugcuccucacaaacguguuaaaagccaucggcguguggggaucauggguaauagccccagucaaacucauguucgccaucauaaagaaacuaaugcggagcgugagcugccuaauggguaaacugauggaucgaggaagacaggucauccacgaagaaaucggcgaaaaccgagaaggaaaccaagacgacgugagaaucgaaauggcacgaccaagaagaguaaggcacuggauguacuccccggucauccuaacaauacuggccgucggccuugcagaaggaugcgacgaaaugguccaugccgacucgaaacugguuagcuguaaacaaggaucaggaaacaugaaagaaugcgugacgacaggacgggcucuccucccggccgucaacccaggacaggaagcaugcuuacacuucacugcccccggcaguccagacucaaaaugccugaaaaucaaagucaagaaaauaaaccuaaaaugcaagaaaagcucgagcuacuuugucccagaugccagaagccgaugcacaagcguacgacgaugucgaugggccggugacugccagucaggcugccccucucacuucacauccaacagcuucagcgaugacugggcaggaaaaauggaccgagcagggcucggcuucagcggauguucagacggaugcggcggagcagcaugcgggugcuucaacgcggccccaagcugcauauucuggcgcaaauggguugagaacccacauggaaucauauggaaaguaagcccaugcgcagcauggguccccucagcaguaaucgaacuaacaaugccaagcggagaaguaagaacauuccaccccaugucggguauaccgacacagguuuuuaaaggcgucucagucacguaccugggaagcgacauggaggucagcggccuaacggaccugugcgaaaucgaggaacuaaaaucgaagaaacuagcacuugcacccugcaaccaggcgggaaugggcguugugggcaaaguaggagagauccaaugcuccagcgaagaaucggcucggacaaucaagaaagacgggugcauauggaacgcagaccuaguaggaauagaacuccgaguagacgacgcaguaugcuacagcaaaaucacgaguguggaagccgucgcgaacuauuccgcaaucccaaccaccaucggcggccuaagauucgaaagaagccacgacagccaaggcaaaaucucuggcagccccuuagacaucacagccauucgaggcucauucagcguaaacuaccgcggacuacggcuuagccugagcgagaucaccgcaacaugcaccggcgaagugaccaacguaagcggauguuacucgugcaugaccggcgcaaaagucaguaucaaacuccacucaaacaaaaauagcaccgcacacgucagaugcaaaggagacgaaacagccuucagcguacuggaaggcguacacagcuacaccgugagccucagcuucgaccacgccgucguagacgaacaaugccagcuaaacugcggaggacacgagagccaaguaacacuaaaaggaaaucucaucuuccuagacguacccaaauucgucgacggcuccuacaugcaaaccuaccacucaagcguucccaccggggcaaauauucccucgccaacagacuggcuaaaugcacuguucggaaacggucuaucacgguggaucuuaggcgucaucgguguacuacuaggaggacucgcacuauucuuccuaaucaugucccucuucaaacuggggaccaaacaggucuucaggagucgcucuaagcuggcauaa

SEQ ID NO: 16442 - RNA, 3222 nt, Artificial Sequence
  derived and/or modified CDS sequence (opt11) from SFTSV(NB31/CHN/2013)__KR698338.1__GP
augaugaaggugaucugguucagcucccugauuugcuucgugauccagugcagcggggacaccgggcccaucaucugcgccgguccgauacacuccaacaagagcgccaauaucccccaccuccugggguauuccgaaaagaucugccagaucgaucgccugauccacguguccucuuggcuccggaaccacagccaguuccaggguuauguggggcaacgcggcgggcggucccaggucagcuacuacccguccgagaauagcaacucccgcuggucagggcuccuguccccaugugacgccgacuggcucggcaugcugguggugaagaaggccaaggguagcgacaugaucgucccgggccccuccuacaaggggaagguguucuucgaacggcccaccuucgacggauacgugggcugggggugcgguuccgggaagucccggacggagagcggcgaguuaugcagcucagauagcggaacaagcagcgggcuccugcccagcgacaggguccuguggaucggcgacguggccugucagccgaugacccccaucccugaggagaccuuccuugagcucaagagcuucagucagagcgaguucccagacauaugcaagaucgacgggaucguauucaaccagugcgaguccgagagccugccgcagcccuucgacgucgcguggauggacguggggcacagucacaagauaaucaugcgcgagcauaagaccaaaugggugcaggaauccuccagcaaggacuucgucugcuacaaagaaggcaccggccccugcuccgagagcgaggagaagacuugcaaaacguccggcagcugccgcggggacaugcaguucugcaagguggccggcugcgagcacggggaggaggcgucggaggccaaaugucggugcagccuuguccacaagcccggcgaggucguggugagcuacgggggcaugagggucagaccgaaaugcuacggcuucucccggaugauggccacguuagagguaaauccgcccgagcaacgcauugggcagugcaccggcugccaccuggagugcaucaacgggggcguccggcucauuacacugaccucagagcugaaauccgccacugucugcgcuagccacuucugcuccagcgccaccucggggaagaagaacaccgagauccaguuccacagcggaucacucgugggcaaaaccgucauccacgucaagggggcccugguggacggaacggaguucacuuucgaagguucuugcauguuuccggauggcugcgaagccgucgauugcaccuuuugccgcgaguuccugaaaaacccccagugcuaccccgccaagaaguggcuguucauaauaauagugauccugcugggguaugccggacucaugcugcugaccaacguccucaaggccaucggcgucuggggguccuggguaaucgcucccgugaaacugauguuugccaucaucaagaaacugaugagaagcguuuccugcuugaugggcaagcugauggaccgcgggcgccaggugauccacgaggagaucggcgagaauagggagggcaaccgagacgacgugcgaauagagauggcccggccacgccgcguccggcacuggauguacagcccggugauacugacgauccucgcgaucgggcuggcagaaggcugugacgaaauggugcacgccgacuccaagcuagucagcuguaaacagggguccggaaauaugaaggagugcgugacgaccggacgagugcucuugcccgccgucaaccccggccaggaggccugccuucacuucaccgcgccuggcagccccgacagcaagugccuaaaaauaaaagugaagcggaucaaucugaagugcaagaaguccagcucguacuucguucccgacgccagaaguaggugcacgagcgucaggcggugccggugggccggggacugccagagcggcugccccucccacuucacuagcaacuccuucagugacgacugggccggaaaaauggaucgcgcgggccugggguucucaggcugcagcgacggcugcggaggcgcugcuugcggguguuucaacgccgcccccuccugcaucuucuggcgcaaguggguggagaacccccauggcauaaucuggaaggugucucccugcgcggcaugggucccuuccgcuguaaucgaacuaaccaugccgagcggggaggugcggaccuuccaccccaugucugguauccccacgcaggucuucaaaggcguguccgugaccuaccugggguccgacauggaagucagcggccugaccgaccucugcgagaucgaggagcucaagagcaagaagcucgcccuggcccccugcaaccaggcggggaugggcguagugggcaaagucggagaaauccagugcuccagcgaggaguccgcacgaacuaucaaaaaggacggcugcaucuggaacgccgaccugguggguaucgagcuucgcguggacgacgcgguaugcuacagcaagaucacguccguggaagccguggcgaacuacagcgccaucccgaccaccaucggcgggcugcgauuugagcggucccacgacagccagggcaagauauccggcagcccccucgauaucacugccauccgcggaaguuucagcgucaauuaccggggcuuacgccugucccucagcgaaaucacggcgaccugcacaggggaagugaccaacguguccggaugcuacucuugcaugaccggggccaaggucuccaucaagcugcacagcucaaagaacucuacggcgcauguccgcugcaagggugacgagaccgccuucucgguccuggagggcguccacuccuacaccguuagccucuccuucgaccacgccgugguagacgaacagugccagcugaacuguggaggccacgaaagccaggugacacuuaaggggaaccucaucuuccuggacgugcccaaauucgucgacggcuccuacaugcagacauaccacucuagugucccaaccggggccaacaucccgagccccaccgacuggcugaacgcucucuucggcaacggccuaucgcgguggaucuuggggguugugggcgugcuccucgggggacugguccuauucuuccugaucaugagcuuguucaaacuuggcaccaagcaggucuuccgcucccgcacgaagcuggccuga

SEQ ID NO: 16443 - RNA, 3222 nt, Artificial Sequence
  derived and/or modified CDS sequence (opt11) from SFTSV(NB38/CHN/2013)__KR698341.1__GP
augaugaaagucaucugguuuucaucacuuaucugccucguaauacaaugcggcggcgacacguccccaaucaucugcgcaggaccaauacacagcaacaaaagcgcugauaucccccaccuucuaggguacagcgagaagauaugccaaauagaccgacuuauccacgugagcucguggcucagaaaccacucacaauuccaaggauacgugggacagcgaggaggcagaagccaaguaucauauuacccagcugagaacucauacagucgauggagcggccuacuaagccccugcgacgccgauuggcucggaaugcuaguagugaagaaagccaaaggaagcgacaugaucgugccaggaccaagcuacaaagguaaagucuuuuucgagcgccccaccuucgacggauacguaggcuggggcuguggcagcggaaaaagccgaaccgaguccggcgagcucugcuccagcgacuccggaacaaguuccggacuacuacccuccgacagaguccuauggaucggagacguugcaugccagcccaugaccccaauaccagaagagaccuuccuagagcuuaagagcuucucccagagugaauuuccggacauaugcaaaauugacggcaucguauucaaccaaugcgaaggagagucucuaccccaacccuucgaugucgccuggauggacgucgggcauucgcacaaaauaauaaugagagaacauaaaacuaaauggguucaggaaagcaguagcaaagacuucguaugcuauaaagaagguacgggccccugcuccgaaucggaagagaaaaccugcaagaccucagggagcugccgaggcgacaugcaauucugcaaaguggccggcugcgaacacgaagaagaggcuucggaagcaaagugccguuguagccucguccacaaacccggagaaguagucguaucguacgguggcaugagaguacggccaaaaugcuacggcuucaguagaaugauggcaacccucgaagucaaccaacccgaacaaagaaucggccaauguacagggugccaccucgaauguauaucaggcggagugcgacugauaacccuaaccagugagcuaaaaagcgccacuguaugcgccagccacuuuuguagcagcgcaaccagcgguaagaaaagcaccgagauacaauuccacuccggcagccuugucggcaaaaccgcaauacacgucaaaggcgcacucgucgacggaaccgaguucacauuugaaggcucaugcauguuucccgacggaugcgacgccguagauugcaccuucugccgcgaguuccugaaaaacccccagugcuacccagccaagaaauggcuauucaucauaaucguaauacuacuaggauacgcagggcuaaugcuacucacgaacguacucaaagcaauaggcgucuggggaagcuggguaaucgcccccguuaaacugguguucgcaaucauuaagaaacuuaugagagcgguguccuguuuaaugggaaaacugauggacaggggaagacaagugauccacgaagaaaucggagaaaaucgcgaaggcaaccaggacgacgucaggauagaaauggcacgacccagacguguccgccacuggauguacuccccggucauacuuaccauauuggcaaucggacuagcagaaggcugcgacgaaaugguccaugccgacagcaagcuaguaucaugcaggcaaggcagcggaaacaugaaagagugcgucaccacagguagagcacuacucccggccgugaaccccggccaagaagccugccuacacuucacagcgccaggcagccccgauagcaaaugccucaaaauaaaagucaaacggaucaaccugaaaugcaagaaauccucuagcuacuuugugcccgacgcacgaaguaggugcaccagcgugaggagauguaggugggcuggcgacugccaaagcggaugcccaccccacuuuacgagcaauucauucuccgacgacugggccggaaaaauggaccgcgcaggacuaggcuucagcgggugcucggacggaugcggcggggccgccugcggcugcuuuaacgcggcucccagcugcaucuuuuggcgcaaaugggucgaaaacccccauggaauuaucuggaaagucucccccugcgccgcauggguacccucagcuguaauagagcucacgaugcccuccggcgaagucagaacauuucaccccaugagcgggauuccaacacaagucuuuaaagggguauccgucacguaccuugggucggacauggaagucaguggacucacagaucuuugcgaaauggaagaacucaaauccaagaaacucgcccuggcgccaugcaaucaagcaggaaugggagucgucggcaaagugggcgaaauacaaugcagcagcgaagaaucagcgagaacaaucaagaaagacggcugcauauggaaugcagaccuggucggcauagaacucaggguagacgacgcggugugcuacagcaaaaucaccagcgucgaggcgguggcaaaccacucagcaauacccaccaccauaggcgggcuccgauucgaacgcucccacgacagccaaggcaaaauauccggcucgccacuggacauaaccgcaauaagagggucguucagcgucaacuaccgaggauugcgucucucccuauccgaaauuaccgcaacgugcacgggagaagugacgaacguuucaggcugcuacagcugcaugaccggcgcaaaaguauccaucaaacuacacucgagcaaaaacuccacagcgcacgugagauguaaaggugaugagaccgcguucucuguauuagaagguguccacuccuacagcguaucccucagcuuugaccacgcaguagucgacgagcaaugccagcuaaacugcgggggccacgaaucaaaagucacauuacggggaaaccugaucuuccucgacguaccgaaauuuguugacggaaguuacaugcaaaccuaccacagcacaguuccaacaggagccaacaucccgucacccacugacuggcugaacgcacucuucggaaacggacuaagcagaugguuccuaggcguaauagggguacugcugggcgggcucgcgcuauucuuucuaaucaugucccucuucaaacuggguaccaaacaagucuuccgaucccggucaaaacucgccuag

SEQ ID NO: 16444 - RNA, 3222 nt, Artificial Sequence
  derived and/or modified CDS sequence (opt11) from SFTSV(NB39/CHN/2014)__KR698342.1__GP
augaugaaaguuaucugguucagcagcuuaaucugccucgucauacagugcaguggggacacgggcccaauuauuugcgccgguccaauccacagcaacaaaucagccgauauuccacaccuacuaggcuacucggagaaaauuugucaaaucgacagacugauacacgugagcuccuggcugcgcaaccacucacaguuccaaggauacgugggccgacgcggcggcagaagccaaguaagcuacuacccagcagaaaacagcuacucacguuggucgggccuacucucgccaugcgacgcugacugguuagggaugcugguagucaaaaaggcaaagggcucagauaugaucguacccggaccauccuauaaaggaaaaguauucuuugaacgacccaccuuugacggcuacguaggcuggggcugcggcucaggaaaaagccgaaccgagagcggagaacuuugcucgagcgacagcggaacaagcagcggccuucugccaucggacagaguacucuggauaggcgacguagcaugccagccaaugacccccauaccagaagagacauuccuagagcuaaagagcuucagccaaagcgaguuccccgacauaugcaaaaucgacggcauaguauucaaccagugcgaaagcgaaucccuaccccaacccuucgacguagcauggauggacgucggacacucccacaaaauaauuaugcgagaacacaaaacuaaaugggugcaagaaucauccuccaaagacuucgugugcuacaaagaagggacaggcccaugcucagaauccgaggagaaaacaugcaagacuagcggaagcugccgcggagacaugcaguucugcaaggucgccgggugcgagcacggcgaggaagccagcgaggcaaaaugccgcugcagccucgugcauaagccaggcgaaguaguagucucguacggcggcaugcgugugcgcccaaagugcuacggauucucccgaaugauggccacccuagaagugaacccacccgagcaacggaucggccaaugcaccggaugccaccucgaaugcgucaacggcgguguccgcuugauaacacucacgagcgaacucaaaucggcgacuguaugcgcuagccacuucugcucaagcgccaccucaggaaagaaauccaccgaaauccaauuccacagcgguucccuugucggaaaaacugcaauacacgucaaaggggcucuaguagacggaaccgaguucacauucgaaggcucaugcauguuccccgacggcugcgacgcagucgacugcacauuuugcagggaauuucucaaaaacccccaaugcuacccagcaaagaaauggcuauuuauaaucauaguaauccuacucggauacgcuggccuaaugcugcuuacaaauguacucaaagcaauaggcguuuggggaagcugggucauagcacccgucaagcuaauguuugccaucaucaagaaacugaugcgauccguaucgugccucaugggcaaacugauggaccgaggacgccaagucauacacgaagaaaucggcgagaaccgcgagggcaaccaggacgacgucaggaucgagauggcucgaccaagacgcguaaggcacuggauguacagcccggucauacuuacaauucucgccguaggccucgcggaaggaugcgacgaaaugguacacgccgacucaaagcuagucagcuguaaacaagguagcgggaacaugaaagaaugcgugaccaccggccgagcccugcuuccagccgucaaucccggccaagaagcgugcuuacacuuuacagcuccaggauccccagaccuuaaaugccucaaaaucaaggucaagaaaauaaaccuaaaauguaagaaaagcuccuccuacuucguccccgacgcacgcuccagaugcacaagcguaaggcgcugccgaugggccggcgacugccaguccggaugcccgucccacuucaccuccaacagcuucagcgacgacugggcaggaaaaauggacagggcaggccucgguuucagcggcuguuccgacggcuguggaggcgccgccugcggaugcuuuaacgccgccccauccugcauauucuggcgcaaauggguagagaacccgcacggcaucaucuggaaaguuagccccugcgccgcguggguucccagugcaguaaucgaauuaacaaugccaagcggcgaaguacgaaccuuccaucccauguccgggauaccgacccaaguguucaaaggagucuccgucacguaucuaggguccgacauggaggugucagggcucaccgaccuaugcgaaauugaggaacuaaaauccaagaaacucgccuuagcaccauguaaccaggccggcaugggagucgugggcaaagugggggaaauucaaugcaguagcgaggagagcgcgcgaacaaucaagaaagacggcugcaucuggaaugccgaucuuguagguaucgaacucagggucgacgacgcggucugcuauuccaagaucacaagcgucgaagcaguggccaacuacucggcaaucccgacuaccauaggcgggcuaagauucgaaagaucacacgacagucagggcaagaucuccggcucaccccuugauaucaccgcaaucaggggaucauucucagucaacuacagggggcuccgccuuucccucagcgaaauaacggccacaugcacaggggaagucacaaacguaagcggcuguuacagcugcaugaccggagcaaaaguguccaucaagcuacacuccaacaaaaacuccaccgcccacguacgaugcaagggcgacgaaaccgcuuucuccguccuggaaggaguccacaguuacaccgucucacucaguuucgaccacgcaguaguugacgaacagugccagcuaaacugcgggggacacgagucacaggucacccucaaggggaaucucaucuuucucgacguaccaaaauucgucgauggaucauacaugcaaacauaccacuccagcgucccuaccggcgcaaauauuccaagccccaccgacuggcuaaacgcacucuucgguaacggccuauccagauggauacucggaguaauaggagugcuacuuggcggacucgcgcuauucuuccuuaucaugucccuguucaagcuaggaaccaaacaaguauuucgguccaggacaaaacucgcauag

SEQ ID NO: 16445 - RNA, 3222 nt, Artificial Sequence
  derived and/or modified CDS sequence (opt11) from SFTSV(QD7)__KR706566.1__GP
augaugaaagucauuugguucucaucacuaauaugcuucguaauacaaugcagcggcgacucaggcccaauaaucugcgccggaccaauccacagcaacaaaagcgcagacauaccacaccuccucggcuacucggagaaaaucugccagauagacagauuaauacacguauccucauggcuccguaaccacucccaguuccagggauacgugggccaacgugggggccggagccaaguaucauacuacccagccgaaaacucauacuccagauggagcggccuccuaucaccgugcgacgcggacugguuagggaugcuagucgucaagaaagccaaaggaucagacaugauaguacccggccccucguauaagggaaaaguauucuucgaacggccgaccuucgacggcuacgucggaugggggugcgggucaggcaagagcaggacagaaagcggcgaacuaugcuccagcgacuccggcacaucaagcgggcuccucccgucggacaggguccucuggauaggcgacguugcgugccaaccaaugacaccaauaccugaagaaacauuucuggaacucaagagcuuuagucaauccgaguucccagacauaugcaaaauagacggcaucguguucaaucagugcgaaggugaaucacuuccgcaaccauucgacguagccuggauggacgucggccacucccacaaaauaaucaugcgcgaacacaaaacaaaauggguacaggaaucaagcaguaaggacuucgucugcuauaaggaaggcacaggccccugcagcgaauccgaagagaaaacgugcaagaccuccggaucgugcaggggagacaugcaauucugcaaagucgccgggugcgaacacggagaagaagcgucagaagcgaaaugcagaugcagccucguacacaagccaggagaagucguagucagcuacggaggaaugcguauacgaccaaaguguuacggguucucccgaaugauggccacacuagaaguaaaccaaccagaacagcggauaggucaaugcacggguugccaccucgaaugcaucaacggaggcguaagguugauaacgcuuacgucagaacucaagagcgcaacaguaugcgccucacacuucugcaguucagcaacaagcgggaaaaagagcaccgaaauucaauuccacucagguucgcuagucgguaaaacagccauacacgucaaaggggcccucgucgacgguacagaguucacguucgagggguccugcauguucccggacgggugcgacgcaguagacugcaccuucugcagggaguuccuuaagaacccccaaugcuacccagccaagaaauggcucuuuaucauaaucgucauucuucuaggauaugcaggacuaaugcugcucacuaacguacuaaaagccaucggaauauggggcagcugggucauagcccccguaaaacucauguucgccaucauuaagaagcucaugcggaccaugucuugucuaauggggaaacucauggacagaggcagacaggucauccacgaagaaaucggcgaaaacagggaaggaaaccaagacgacguacgaaucgagauggcaagaccacgccgcguccgccacuggauguacucgccggucauauuaaccuuccucgcaaucggccucgccgagagcugcgacgaaaugguccacgccgacuccaaacuggcaucgugccgacaaggcuccggaaacaugaaagaaugcgugacaaccgggcgcgcacugcaccccgccguaaacccuggacaagaagcaugccugcacuucacagcacccggaagcccagacucaaaaugucuaaaaauaaaaguaaagcgaauaaaccuaaaaugcaaaaagaguucgucauacuucguucccgacgcccgcucaaggugcacaagcguacgacgcugcagaugggccggagacugccagucaggaugucccccacauuuuacgaguaauucauucuccgacgauugggcgggaaagauggacagagccggccucgguuucucaggaugcuccgacggcugcggaggagcagcaugcggcugcuucaacgcggccccgagcuguaucuuuuggcgcaaauggguagaaaacccacacggcauaauauggaaagugucaccgugcgcggcgugggucccaagcgccgucauagaacucaccaugcccagcggagagguacgcaccuuccacccaaugucuggaauaccaacacagguuuucaagggcguaucggucacauacuugggcuccgacauggaaguauccggacucaccgaccuuugcgaaaucgaggagcuaaaaagcaaaaagcuagcacuggcccccugcaaccaagcaggaaugggcguggugggaaaagucggagaaauacaaugcagcagcgaagaauccgcaagaacaaucaagaaagacggaugcaucuggaacgcagaccuugugggcaucgagcucagaguagacgacgcgguaugcuacagcaaaauaacauccguagaagcggucgcaaacuacagcgcgauaccaaccaccaucggaggccucagauucgaacgcagccacgacagccaaggcaaaaucucaggcuccccacuagacaucacggccauccgcggguccuucuccguaaauuacagaggacuacgccuaagccugagugaaaucaccgccacgugcacuggcgaaguuaccaacgucagcggcugcuauucaugcaugacgggugcaaaaguaucuaucaaauuacacucgagcaaaaacagcacugcccacguccgaugcaagggagacgagaccgccuucagugucuuagaagggguacacagcuacacagugucauugagcuucgaucacgcagucguagacgaacaaugccagcuuaacugcggcggucacgaaucacaaguaacccugaagggcaaccucauauuucuugauguaccaaaauucgucgacggcucauacaugcaaacauaccacagcaccgugcccacaggcgcaaacaucccuagccccaccgacuggcugaacgcccuauucggcaauggcuuaagccgcuggauacuaggcgucaucggcgugcuccuaggugguuuagcccucuucuucaugaucaugagucuauucaaacugggaaccaaacaagucuucagaagccggacaaagcuggcguaa

SEQ ID NO: 16446 - RNA, 3222 nt, Artificial Sequence
  derived and/or modified CDS sequence (opt11) from SFTSV(Rodent01/NB/CHN/2014)__KR698343.1__GP
augaugaaagucauaugguucuccucccuaaucugccucgucauccagugcucaggagacaccgggccaaucauaugugccggaccaauacauucaaacaaaagcgccgacaucccacaucuccucgguuacucagagaaaaucugucaaauagacagacucauacacguaucuuccuggcuccgcaaucauagucaauuucaaggcuacgucgggagacgcggcggcagaucccaggucaguuacuaccccgccgaaaacuccuauucacgcuggucaggacuucucucccccugcgaugcagacuggcuaggaaugcuggucgucaaaaaggccaaaggcuccgacaugaucguucccgggcccagcuacaaagguaaagucuuuuucgaacggcccaccuucgacggguacguaggcuggggaugcggcagcggcaaauccagaaccgaaagcggagaacucuguucuucugacagcggaaccuccagcggccuacucccaucagaccgaguccucuggaucggcgacgucgccugccaaccuaugacuccaauacccgaggagaccuucuuagaacuaaaaucguucucccaaucugaguucccagauauaugcaagauagacggaaucgucuucaaccagugcgaaagcgaaagccucccacagccauucgacgucgccuggauggacgucggccacucccauaagaucaucaugagagaacacaaaaccaaauggguccaggaaucuaguagcaaggacuucgucugcuacaaggaaggaacaggccccugcucagaaagcgaagagaaaaccugcaaaacaucagggucaugcaggggcgacaugcaauucugcaaaguagccgggugcgaacacggcgaagaggccucggaagccaaaugccgaugcagccugguccacaaaccaggcgaagucguagucagcuacggaggcaugcgcguccggcccaaauguuacggguuuucacgaaugauggccacccuggaagucaacccgcccgaacaacgcauaggacaaugcaccggaugccaccucgagugcgucaacgggggcgugcgucuuauuacacucaccuccgaacuaaaaucagccacagucugcgccucacacuuuugcucaagcgccacaagcggcaagaaaucaaccgaaauccaguuccacagcggaucuuuggucggcaagacggcaauccacguaaaaggcgcacucguugauggaacagaguucacauucgaaggauccugcauguucccagaugggugcgacgcaguggacugcacuuuuugcagagaguuccucaaaaacccucagugcuaccccgccaaaaagugguuguucauaaucaucguuauacuccuaggcuacgcagggcugauguugcucaccaacguccucaaagcaauuggaguguggggcuccugggucaucgcaccaguuaaauuaauguucgccaucauaaagaaacucaugcggucagucucgugccugaugggcaaacuaauggaccgaggccgccaggucauccacgaagaaauaggcgaaaacagggaaggaaaccaagacgauguaaggaucgaaauggcccgcccgcgcagaguccgccauuggauguacuccccaguuauacucaccauucucgcagucggccucgccgaagguugcgacgaaauggugcacgcggacaguaaacucgucuccugcaaacaaggaucaggaaauaugaaagaaugcguaacgacgggaagggcccuccucccggccgugaaccccggucaagaagcaugucuacacuucacagcaccaggcucacccgaccugaaaugccuuaaaauaaagguuaagaaaaucaacuuaaaaugcaagaaaucuuccucauacuucgucccagaugcacgcuccagaugcaccagcgucagacggugcagaugggccggcgacugucaaagcgguugcccaagccacuucacauccaauagcuucuccgacgacugggcgggcaaaauggaucgcgccgggcucggauucagcggaugcagugacggcugcggcggggcugcaugcggcugcuucaacgcugcacccagcugcauauucuggagaaaauggguagagaacccccacggcauaauauggaaaguaagucccugcgcagccugggucccaucagccgucauagaacuuacaaugccaagcggagaaguccgcacauuccacccgaugagcggaaucccgacccaggucuucaaaggcgucagcgucaccuaucuaggguccgauauggaaguuuccggccuuacagaucucugcgaaauugaggaacuuaaaagcaagaaacucgcccucgcaccuugcaaccaagcgggcaugggagucgucgggaaaguaggagaaauccaaugcagcagcgaggaaagugcgcguaccauuaagaaagacggaugcaucuggaacgcggaccucgucggaauagaacuucgaguagaugacgccgucugcuacagcaaaauuaccagcguugaagcagucgccaacuacagcgcaauaccaacaaccaucggcggccuacgauucgagcgcucccacgacagccaaggcaaaaucucagguucaccccuagacauaacugcgauccgcgggagcuucucagucaacuacagaggacugcgccuaagccucagcgaaaucaccgccacgugcacaggcgaagucaccaacgucagcggauguuacucaugcaugauaggcgccaaaguaaguaucaaacuccacucaaacaaaaacucgaccgcccacguacgcugcaaaggcgacgagaccgccuucuccguccuagaggggguccacagcuauacagucucccuauccuucgaucacgcaguaguugacgagcagugucaacuuaacugcggaggacacgagucgcaaguuacccuuaaaggcaaccucauauuccuggacguuccgaaauucgucgacggcucguauaugcaaaccuaccauuccuccgucccaacgggcgcaaacauacccagccccaccgacuggcugaacgcucucuucggcaacggccucucacgguggauccucggggucauaggcguacuccuaggagggcucgcacuauuuuuccugauaaugagccucuucaaacuggggaccaaacaaguguuccgaagcagaaccaaacuagcguag

SEQ ID NO: 16447 - RNA, 3222 nt, Artificial Sequence
  derived and/or modified CDS sequence (opt11) from SFTSV(SDLZtick12/2010)__JQ684872.1__GP
augaugaaagucauaugguucagcucccuaauaugcuucgucauacaaugcucaggagauuccggucccaucauaugcgccgggccaauacacucgaacaagagcgccgauaucccccaccuacucggauacucagaaaagaucugccaaauagaccgccucauacacguaagcucguggcuccgaaaccacagccaauuccaaggcuacguagggcaaagggguggaaggucccaggucucauacuacccagcggaaaacucauacucaagauggagcggccucuugucgcccugcgaugccgacuggcugggcaugcuaguugucaagaaagccaaagggucugacaugauaguaccagggcccagcuauaaaggcaaagucuucuucgaaagacccacauucgacggcuacgucggcuggggaugcggcagcggcaaaucacgaaccgaaagcggcgaauuaugcuccuccgacuccggaacuucaucgggacuauuaccgucggaccgaguacucuggaucggcgauguagccugccaacccaugacuccaauaccagaagagacguuccuggaacucaagagcuucagccagagcgaauuuccggacauaugcaaaauagacgggauaguguucaaccagugcgaaggcgaaucacugccacaacccuucgacguagcauggauggacguugggcacucacacaaaaucaucaugcgagagcacaaaacaaaaugggugcaagaauccagcucaaaagacuucguauguuacaaagagggcacaggaccgugcucagaaucggaagagaaaacgugcaaaaccucuggaagcugcagaggcgacaugcaguucugcaaagucgccggcugcgaacacggagaagaagccucagaagcgaaaugccgcugcucccucguccacaaaccaggagaaguaguuguaagcuacggaggcaugagaauacgacccaaaugcuacggauucucacgcaugauggcaacccuggaaguaaaccaaccggaacaacggauaggacaauguaccgggugccaccucgaauguaucaacggcggcgucaggcugaucacacucacaagugagcucaaauccgcaaccgugugcgcaagccacuuuugcaguuccgccaccagcggaaagaaaaguacagagauccaguuccacucgggcagcuuagucgguaaaaccgccauccauguaaaaggagcguuaguagacggaaccgaguucaccuucgaaggguccugcauguucccagacggaugcgacgccguggauugcacauucugcagggaguuccuuaaaaauccccaaugcuacccagccaaaaaguggcuguucauaauaauaguaauacuccucggauacgcaggccuaaugcuacucaccaacguccucaaagccaucggcauauggggaucuugggucauagcuccaguaaaacuaauguucgccaucauuaagaaacuuaugcgcacaguauccugccuaaugggcaaauuaauggaccgcggccgccaaguaauacacgaagaaaucggagaaaauagagaagggaaccaagacgacguucggaucgaaauggcccguccccgacgcguaagacacuggauguacagcccaguuauacucacauuccuagccauuggacucgccgaauccugcgacgaaauggugcacgccgacagcaagcuagucucgugcagacaaggcagcgggaacaugaaagagugugugacaacgggccgcgcgcugcuacccgcgguaaacccaggccaagaggcaugccuacacuuuacagcgccuggcuccccagacagcaaaugccucaagauaaaagucaagagaaucaaccuuaaguguaaaaagucaagcucauacuucgugccggacgcccgaucccgaugcaccagcgugcgacgaugcagaugggcaggcgacugccaauccggcugcccgccccacuucaccaguaacucguucagugacgacugggcuggaaaaauggacagagccggacuaggcuucagcggaugcagcgacggcuguggcggagcagcaugcggcugcuucaacgcagccccgucaugcaucuuuuggcgaaaauggguagagaacccacacggcauaauauggaaggucucacccugcgcagcuugggugccaucagccgucauagaacuaaccaugcccagcggcgaaguccggaccuuucaccccaugucagggaucccgacgcaggucuucaagggagucucggucaccuaccuaggaagcgacauggaaguguccgggcugacggaccuaugcgagauagaggaacugaaaucgaagaaacuggcgcuugcuccauguaaccaagccggaaugggggucguaggcaaaguaggggagauccaaugcagcucagaagagagugcaagaacaaucaagaaagacggauguauauggaaugccgaucuaguugggaucgaacugcggguggacgacgcagugugcuacucaaaaauaaccucagucgaggcagucgcgaacuacuccgcaaucccgaccacgauuggaggacuaagauuugagcgcucacacgacucccaagggaaaaucaguggcaguccccuggacauaaccgccauucggggcagcuucuccgucaacuaccggggccucagacucucacuaagcgagaucacagccacgugcacgggcgaagucacaaacguaagcggguguuacagcugcaugacaggagccaaggucucaauaaaacuucacagcagcaaaaacucaaccgcacauguacgcugcaaaggagacgaaacagcauucaguguccucgaggguguccacuccuacacugucagccugucuuuugaccacgccguaguggaugaacagugccaacucaacugcggcggccaugaaagccaagugacacuaaaaggcaaccucauauuccuugacguaccaaaauucguagacggaucauacaugcaaacauaucacagcaccgugcccaccggggccaauauccccucaccaaccgacuggcucaacgcacuauuugggaauggacucuccagguggauacugggcgucaucgguguucugcuaggcggacucgcgcuguucuucaugaucaugucacuauucaaacuuggcacuaaacaaguauuccgcucacgcacaaaacucgcauaa

SEQ ID NO: 16448 - RNA, 3222 nt, Artificial Sequence
  derived and/or modified CDS sequence (opt11) from SFTSV(Zhao)__KF374684.1__GP
augaugaagguaaucugguucagcucgcuaauaugccucguuauccagugcagcggcgacacaggacccaucauaugcgccggccccauccacagcaacaaaucggccaacaucccacaccuccuaggcuacucagaaaagauaugucaaauugaccgauuaauacacgucuccuccuggcuacgaaaccauagccaauuccaaggauacgucggacaacgcggaggaagaucccaggugucguacuacccagcagaaaacagcuacucacgauggagcgggcuacucagcccaugcgacgcggacuggcucggaaugcucgucguaaagaaagcgaaagggucagacaugaucguaccaggccccagcuacaaagggaagguauucuucgaacgcccaaccuucgacggcuaugucggauggggcuguggcagcggaaagagucggacagaaagcggagaacucugcucgagcgacuccggaacuucaucaggauuacuaccguccgauagaguacucuggauuggcgacgucgccugccagcccaugacacccauacccgaagaaaccuuccucgaacucaaaucguucagucaaucagaguucccagacaucugcaaaaucgacggaaucguauucaaccaaugcgaaagcgaaucacuaccccaacccuucgacgucgcguggauggauguaggacacucgcacaaaauaauaaugcgagaacacaaaacgaaaugggugcaagaaucaucaagcaaagauuucguaugcuauaaggaaggaacaggcccgugcagcgaaagugaagagaaaacaugcaaaacgagcgguuccugccgcggcgauaugcaguucuguaaaguagcagguugcgaacacggggaagaagcgagcgaagcaaaaugccgcugcagucugguacacaaaccaggggaagucgucguaagcuacggagggaugcgaguccgaccaaagugcuacggauucagccggaugauggccacgcucgaaguaaauccgccagaacagcggauaggacagugcacgggaugccaucucgaaugcauaaacggagggguucgccuaguaacgcuaacaucagagcugaaaagcgcuacgguaugugcaucccauuucugcagcucagcgacgagcgggaagaaaucaacagagauacaauuccacagcggcucccucgugggcaaagcagcgauacacgucaaaggugcgcuagucgacgggacggaguucaccuucgaagggucaugcauguucccggacgggugcgacgcaguagacugcacauucugcagagaguuccucaaaaacccccagugcuaccccgcaaagaaguggcuuuucauaauuaucguaauccuacuaggcuacgcgggccucaugcuccucacgaauguccucaaagccauaggaguauggggaagcugggucauagccccaguaaaacuaauguucgcgaucauaaagaaacucaugcgcagcguauccugccucauggguaaacucauggaccgcggaaggcaagucauacacgaagaaauaggagagaacagagagggaaaucaggacgacgugcgaaucgaaaugguacgaccgcgacggguccgccacuggauguacucaccagucauacugacaaucuuagcaaucgguuuaacagagggcugcgacgaaaugguccacgccgacagcaaacuggugucaugccggcaaggcucaggaaacaugaaagagugcguaaccacagggagagcccuccuaccugcugugaacccgggacaggaggcuugccuccacuucaccgcacccggcuccccggacagcaaaugccugaaaaucaaagucaagagaaucaaccucaaauguaagaaaagcuccagcuacuucguaccagacgcacgcagucgcugcacgagcguaaggcgcuguaggugggcgggcgacugccaaagcggauguccgagccacuucacaucaaacagcuuuagugacgacugggcagggaaaauggacagagcaggacucggauucuccggaugcagugacggauguggaggagcggccugcggcuguuucaacgccgcacccagcugcaucuucuggcggaaaugggucgaaaacccacacggaauuauauggaaaguaagcccaugcgcggcuuggguaccaagcgcggucauagaacuaaccaugccgagcggggaggugagaaccuuccaucccaugagcgggauaccgacccaagucuucaaaggcgucuccguaaccuaccugggcagcgacauggaggugucuggccuaaccgaccuaugcgaaauagaagaacuaaagagcaagaaacuagcgcucgcaccaugcaaccaagccggaaugggggucgucggaaaaguaggagaaauccaaugcagcucggaagaaucagcaaggacaaucaagaaagacgggugcaucuggaacgcagaccucgugggaauagaacucagggucgacgacgcagucugcuacagcaaaauaacgagcgucgaagcuguggcaaauuacucggccauccccacgacgaucggcgggcucagauucgaacgcucccacgacagccagggcaaagucucgggcagcccacucgacauuaccgccauacgcggcagcuucuccgucaacuacagggggcucagguuaagccuaagcgaaaucacggcaacuugcaccggcgaggugacaaacgugagcggaugcuauagcugcaugaccggugcaaaggucuccauuaagcuccacucaagcaaaaauagcacagcgcacguacgcugcaaaggcgacgagacugccuucagcguacuugaaggcguccacagcuauacagucucauuaucguucgaucacgccguagucgacgagcaaugucagcucaacugcggaggccacgaaucacaagugacacuaaaaggaaaccucaucuuccucgacguaccaaaguucgucgacggcagcuacaugcaaaccuaccauagcaguguaccgaccggugccaacaucccaaguccaacugacuggcucaacgcacuauucggcaacggacucucccgauggauacuuggggucauaggggugcuccuaggcggccuagcacuauucuuccuaauaaugagccucuucaaacuaggaacaaaacaaguauuccggagcagaaccaaguuagcguga

SEQ ID NO: 16449 - RNA, 3222 nt, Artificial Sequence
  derived and/or modified CDS sequence (opt11) from SFTSV(Zhejiang/01/2011)__KJ597824.1__GP
augaugaaagucauaugguucucaucgcucauaugccugguaauccaaugcaguggagauaccggacccaucauaugcgcgggcccgauccauagcaacaaaagcgcgaauaucccccacuuacugggauacucagagaaaauaugccaaauagaccgacucauucauguguccucauggcuaagaaaccacucacaauuucagggguacgugggacaacgaggcggacgcagccagguaagcuacuacccagcggaaaacagcuacucacgauggucgggccugcucagcccaugcgacgcggacuggcuaggaaugcucguugucaaaaaggccaagggcucggacaugauaguaccaggaccauccuacaaaggcaaaguauucuucgaacgcccuaccuucgacgguuacguaggcuggggaugcggcucgggaaagagcaggaccgaaagcggcgaacuaugcuccagcgacagcggaacaucgagugggcuccuccccagugacaggguacuauggauuggggacgucgcgugccaaccgaugacaccaauuccagaagaaacguuccucgagcucaagagcuucagccagagcgaguucccggacauaugcaaaaucgaugguauaguauucaaccaaugugaaagcgaaagccugccccagccauucgacgucgcuuggauggacguggggcacucacacaaaauaaucaugagggaacacaagaccaaauggguccaggagagcagcagcaaagacuucguaugcuauaaagaaggaacaggaccguguucagaauccgaagagaaaacaugcaaaacaucaggguccugccgcggcgacaugcaguucugcaaaguugcgggaugcgaacacggagaagaggccagcgaggcaaagugccgauguagccuaguccauaaaccgggcgaggucgugguaaguuaugggggcaugcgaguuagaccaaaaugcuacgguuuuucgaggaugauggcgacauuagaggugaacccgcccgaacaaagaaucggacaaugcaccggcugucaccuagagugcauaaacggagggguacgccuaguaacacugaccagugaacucaagagugcaacagugugcgcgagccauuucugcucuagugccacuagcgggaagaaguccacggagauacaauuccacucgggcagucuaguggggaaagccgcaauccacguaaaaggagcccuaguagacgguaccgaguuuacauucgaggggagcugcauguucccagacggcugcgacgccguggacuguaccuucugcagggaauuucucaagaacccgcaauguuacccagcgaagaaauggcuauuuauuauaauagugauccuccucggauacgccggacucauguuacugacgaacgugcucaaggccauaggcguauggggaaguugggucaucgccccgguaaagcuaauguuugcgaucaucaaaaagcuaaugcgcucggucucgugccugaugggaaaacugauggaucgaggcaggcaagucauacacgaagagauaggcgagaauagagaaggcaaucaggacgacguuaggauagaaaugguacgaccgagaagggugaggcacuggauguacaguccggugauacugacaauccucgcaaucgggcuaacagaaggcugcgacgaaaugguacacgcagacucgaagcuaguuucaugucgacagggauccgggaacaugaaagagugcgucaccacaggcagagcacuacucccggcggugaaccccggccaagaagcaugcuuacauuuuacggcgccaggaagcccagacagcaaaugccuaaaaaucaaagucaaaagaaucaaccugaaaugcaaaaagaguucaagcuauuuuguccccgacgcccgguccaggugcacaagcguacgaagguguaggugggcaggcgacugccaaagcggcugucccagccacuucaccaguaacagcuucagugaugacugggccggaaaaauggaucgggcaggccuaggcuucagcgggugcagcgacgggugcgguggggcagccugcggaugcuucaacgcggcgccaagcuguaucuuuuggcggaaauggguggagaacccgcacgggaucaucuggaaggucagccccugcgccgcgugggugccaucugcaguaauagagcuaacaaugcccaguggagaaguaaggacauuccacccaaugagcggaauaccgacccaagucuucaaaggggucucuguuacguaccugggcagcgauauggaagugucaggacucacggaccugugcgagauagaagaacuuaaaucaaagaaacucgcucuagcgccaugcaaccaggcggggaugggaguagucggcaaagugggggaaauccaaugcagcucagaagaauccgcgcgaacaauaaagaaagacggaugcaucuggaacgcagaccuggucggaauagaacuccgaguugacgacgcaguaugcuacucaaaaauaacaucagucgaggccguggccaacuacucggcaauacccacaaccaucggagggcucagauucgagcgcucgcacgacagccaagggaaaauaucaggcucaccacuggacaucaccgccaucaggggcucguucucgguaaacuacaggggguugagacugagccucucugagauaacggcuaccugcacgggcgaggugacaaacguguccggaugcuacagcugcaugaccggcgcgaaaguuagcauaaaacuacacagcagcaaaaacuccacggcacacguaagaugcaaaggggacgaaacggcguucagcguacuggaagggguccauagcuacacaguaagccucagcuucgaccacgcaguaguagacgaacagugccagcuaaauugcggaggacacgaaagucagguaacgcuaaaaggaaacuugaucuuucuagacgucccgaaauucguggacggaucguacaugcaaaccuaucacuccucagugccgaccggcgcaaacauccccuccccaaccgacugguugaacgcacucuucggcaacggauugagcagauggauacuaggggugaucgggguucuacucggagggcuagcucucuucuuccugauaaugagccuauucaaacuuggcacgaaacaaguauucaggaguaggacaaaacuugcguga

SEQ ID NO: 16450 - RNA, 3222 nt, Artificial Sequence
  derived and/or modified CDS sequence (opt11) from SFTSV(ZJ2013-06)__KP280204.1__GP
augaugaaggugauaugguucuccagccucauaugccucguaauucagugcagcggagauacaggaccgaucaucugcgcagggccaauucacagcaacaaaucagcagacauaccgcacuuacuuggauacagugagaaaaucugccaaauagacagacuaauacacguguccucguggcuacgcaaccauucccaauuccaaggcuacgucggucagcgcggagggcgaagccaaguaucguacuaccccgcggagaacuccuacagcagauggucagggcuacuaagcccaugugacgcggacuggcuagguaugcugguagugaaaaaggcaaaaggcagcgauaugauaguacccggaccauccuacaagggcaaggucuucuucgaacgacccaccuucgauggauacguggguuggggcugcggcuccggcaaaagccggacagagagcggagaacugugcagcagcgauaguggcacaucgucagggcugcuccccagcgaccgaguauuauggauaggcgacgucgccugccaaccaaugacccccaucccagaagaaacguuucuagaauuaaagagcuuuucgcagagcgaguuccccgacauauguaagauagacggcauagucuucaaccaaugcgagagugagagccuaccccagccauucgacguggcauggauggacgucgggcacagccacaaaauaauaaugagagaacacaaaacuaaguggguacaggaaagcucauccaaagauuucgugugcuacaaagaaggcacuggaccaugcagcgaaucugaagagaaaaccugcaagaccagcggcucgugcagaggcgauaugcaguucugcaaaguggcaggaugcgaacacggagaagaagccucagaagcgaaaugccgcuguucccugguccacaaacccggagaagucguagucucauaugggggaaugcgggugcgaccaaaaugcuacggauucucacgaaugauggcaaccuuagaaguaaacccaccagagcaaagaauuggacaaugcaccggcugccaccucgagugcguaaacggaggcgugcggcuaaucacacucacaagcgagcucaaaagcgcgacagugugcgcgagccacuucugcuccagcgccacaagcggcaagaaaagcacggaaauccaauuucauagcggcucccuuguaggcaaaaccgccauacacgugaaaggcgcgcuaguggacggcacagaguucacguucgaaggcucaugcauguucccggacgggugcgaugccgucgacugcacguucugccgcgaguuccugaaaaacccccagugcuaccccgccaagaaauggcuauucauaaacauagugauccuccucggcuacgccggccuuaugcugcucacaaacgugcucaaagcaauaggcguaugggggaguuggguuaucgcccccguaaaacucauguucgcaaucauaaagaaacucaugaggucaguaucgugccuuauggggaaauuaauggaccgcggccgacagguaauccacgaagaaauuggcgaaaacagggaaggcaaccaggacgacgugaggauagagauggcaaggccgaggcgcguaaggcacuggauguacagcccaguuauacuaacgauccucgccguuggacuggccgaggggugcgacgaaauggugcacgccgacuccaaacucguuaguugcaaacagggaucgggaaacaugaaagagugcgucaccaccggcagggcccuacucccagcagucaacccgggccaagaggcauguuugcacuucacagcgccaggcaguccggacucgaaaugccucaaaaucaaagucaagaagaucaauuuaaagugcaagaaaagcuccagcuacuucgugccagacgcaagaagcagaugcacgagcguuagaagaugccggugggcaggcgacugucaaagcggaugcccaagccacuuuacaaguaacagcuucagcgacgacugggcuggaaaaauggaccgagccggacucggauuuaguggcugcagcgauggaugcggcggggccgccugcggcugcuuuaacgcugcgccgagcuguaucuucuggaggaaauggguagagaauccgcacggaauaauauggaaagucucaccaugugccgcauggguaccgucggccgucauugagcuuacaaugccgagcggagaaguacgcaccuuccacccgaugagcggaauaccaacccagguauuuaaaggagucagcguaacguaccuaggcucggacauggaagucuccggacugacagaccuaugcgagauugaggaacuaaaaagcaagaaacucgcacucgcgccaugcaaccaagcgggaaugggagucguaggcaaagucggcgaaauucaaugcucaagcgaagaaagcgcgcguacaaucaagaaagacgggugcaucuggaacgccgaccuaguaggcauagagcucagggucgacgacgcagugugcuacuccaaaauaacaucagucgaagccguagcaaacuacuccgcgaucccaacgaccaucggcggucuacgguucgaacgaucacacgauucccagggcaaaaucagugggucaccccuggacauaaccgcgauccgaggauccuucucagucaauuacagaggacugagacucagccuaagcgagauaacagcgacguguaccggagagguuacuaacgugagcggaugcuacuccuguaugacaggggcgaaaguuucuauaaaauugcacagcaacaaaaacagcaccgcgcacgugcgguguaaaggcgacgagaccgcguuuucggucuuagaagggguccacagcuacacaguaagccucagcuucgaccacgccguaguggacgaacaaugccaacuaaauugcggaggacacgaaucacaaguaaccuuaaaaggaaaccuaaucuuccucgauguuccgaaauucguagauggcucauacaugcaaacauaccauagcucagucccaacaggggcgaacaucccaaguccaaccgacuggcugaacgcacucuucggcaacggccugaguagauggauacucggagucauaggcguacuccuagggggccuagcacucuucuuccuuaucaugagcuuguucaagcucgggaccaagcaggucuuccgguccagaacaaaacucgccuag

SEQ ID NO: 16451 - RNA, 3222 nt, Artificial Sequence
  derived and/or modified CDS sequence (opt11) from SFTSV(ZJZHSH-AM/China/05/2012)__KR017846.1__GP
augaugaagguaaucugguucagcucgcugaucugccuuguuauacaguguagcggagacacaggaccuauaauaugugccggcccgauacauagcaauaagucagcaaacauaccccaucuacucggguauuccgagaaaauaugccaaauugaccgucuaauacacguaagcagcuggcuacguaaucacucccaauuucaaggguacguagggcaacgaggaggacgaagccagguaucguacuaucccgcugaaaauagcuacucgagguggagcggucuccucucgcccugcgacgcggacugguuagguaugcugguagucaagaaggccaaaggcagcgacaugaucgucccagggccuucguacaagggaaaaguauucuucgaacgcccaaccuucgacggauacgugggauggggcugcggaagcggcaagagccgaaccgaaagcggcgaauuaugcucguccgacagcggaaccagcagcgggcuacugcccucggaccgaguccucuggaucggcgacguugcaugccagccaaugacaccgaucccggaagaaacauuucucgagcuaaagaguuucagccagagcgaguuccccgacaucugcaaaauagacgggauaguauuuaaccaaugcgagagcgagagcuuaccccagcccuucgacguggccuggauggacguaggccacucgcacaaaaucauaaugcgggagcauaagacaaaauggguacaggaaagcaguucuaaagacuucgugugcuacaaagaggggacgggcccgugcagcgaaucagaagagaagacgugcaaaaccucggguucaugcaggggcgacauccaauucuguaagguggccgggugcgaacacggggaggaagcguccgaagccaaaugucgauguagucugguccauaagccgggagaagucgucgucucguacggagguaugcgcguacgaccgaagugcuacggauucagccgaaugauggcuacacuggaaguaaacccucccgagcaaagaauaggccaauguaccggaugucacuuagaaugcauaaacgggggugugcgacuaaucacacucacguccgaacuaaagagcgcuacagucugcgcaagccacuuuuguucaucagcaacuagcgggaagaaaagcacggaaauacaauuccacucggguucacuuguagguaaggcagcaauccacgucaagggagcgcucguggacgggaccgaguucacguuugaaggaagcugcauguuccccgacgggugcgaugcggucgacugcacuuucugccgcgaguuccucaagaacccgcaauguuacccagcaaagaaauggcuauucaucauaaucguaauucuccucggauaugcgggccugaugcugcugacgaacguacugaaagccauaggagucugggggagcugggucauagccccugucaaacucauguucgcaauaauaaagaaacucaugcgcagcguaucaugccugaugggaaaacuaauggauagaggcagacagguaauccacgaagaaauaggcgaaaacagagaaggaaaccaggacgacguaagaauagagaugguccgaccgcgcagggucagacacuggauguauagcccggucauacucacgauccuggcaauaggucuaacagaaggaugcgacgagaugguccacgcggacucgaaacuggucuccugcagacaaggaaguggaaacaugaaagaaugcgugaccacgggcagagcccuacucccggccgucaaccccggccaggaagcgugccugcacuucaccgcacccggaagcccagauucgaaaugccuaaaaaucaaagucaaacggaucaaccucaaaugcaaaaagucaaguagcuacuucgugccagacgccaggagcagaugcacauccgugcggcgauguaggugggcgggagauugccagagcgggugcccaagucauuucacgagcaacuccuucagcgacgacugggcaggcaaaauggaccgggccggucuaggauucucgggcugcagcgacggcugcggaggagccgcaugcgguugcuucaaugcggcaccaucaugcauauucuggaggaaauggguagaaaacccccacggaaucauauggaaaguaucgcccugcgccgcuugggugccaucggccgucauagagcucaccaugccaagcggagaggugagaacauuccauccaaugagcgggaucccaacccagguauucaaaggggucuccguaacauaccucgggucggacauggagguuagcggacugacggaucugugcgagaucgaggaacuuaaaucaaagaagcucgcgcuagcgccaugcaaucaagccggcaugggggucguaggaaaggucggagagauccaauguagcagcgaagaaucagcgcgaaccaucaagaaagacggauguauauggaacgcggaccugguuggcauagaacuuagaguagacgacgcagucuguuacaguaaaauaacaucagucgaagccguggcaaacuacagcgcaaucccaacgaccauaggcgggcuccgauucgagcggucacacgacagccaagggaaaauaucuggcagcccccuagacaucacagcaauccgaggauccuucuccguaaacuacagaggacuaagacuaagccugagugaaauaacagccacgugcaccggagagguaacgaacguaagugguugcuacucaugcaugacaggggcgaaaguaagcauaaaauuacacucauccaaaaacucgacugcgcacguccgauguaaaggggacgaaacagcuuucucaguacuagaaggaguccacagcuacaccguaucacucagcuucgaccacgccguagucgacgagcagugccaacugaacugcgggggccacgaaucgcaagucacguugaagggaaaccuaauauuccucgacguaccuaaauucguagauggcagcuacaugcaaaccuaccacaguucggucccgaccggagcaaacaucccaagccccacggacuggcucaacgcgcuauuuggcaacggccuauccagguggauacucggggucauaggcgugcuccugggcgggcucgcucucuucuuccuaaucaugagcuuguucaaacucgggacaaagcaggucuucagaagcagaaccaaauuagcguga

SEQ ID NO: 16452 - RNA, 3222 nt, Artificial Sequence
  derived and/or modified CDS sequence (opt11) from SFTSV(ZJZHSH-CXD/China/05/2012)__KR017858.1__GP
augaugaaaguaauaugguucaguucccugauaugccuagucauccaaugcggcggagauacaggaccaauaaucugcgcaggaccgauacacagcaauaaaucggccggaaucccccaucuacucggauauucagaaaagauaugucagauugacaggcuaauccacgugagcagcuggcugcgcaaccacagccaauuccaaggauacgucggccaaagaggcggcagaagccaggugucauacuauccagcggaaaacagcuauagccgcuggaguggccuccucaguccaugcgacgcagacuggcugggcaugcugguugucaagaaagcaaaaggauccgacaugaucguacccggacccucauacaaagggaaaguauucuucgagcgccccaccuucgacggcuacguaggauggggcugcgggagcggcaaaagcagaaccgaaaguggcgaacuaugcuccagcgacagugggaccagcagcgggcuccuacccuccgaccggguccuguggauuggugauguugcaugccaaccaaugacgccgauaccagaagagaccuuccucgagcucaagagcuucucacaaagcgaguucccugacgugugcaagauagacggcaucgucuucaaccagugcgagggcgaaagucuaccccaacccuuugacguggcauggauggacguaggacacucgcacaaaauuauuaugcgggaacacaaaaccaaauggguucaagaaagcaguucaaaagacuucgugugcuacaaagaaggaacgggaccgugcagcgaaucagaagagaagacgugcaaaacguccgggucaugcagaggcgacaugcaauucugcaagguggccgggugcgagcacggcgaagaggccuccgaggcaaaaugccgcugcagccucguccauaaacccggagaagucguagucucuuacgggggcaugaggguacgccccaaaugcuacggauuuuccagaaugauggccacccuagaaguaaacccacccgaacaaagaaucggccaauguacugggugccaccuagaaugcaucaauggcggcguacgacuaaucacacugacguccgaacucaaaagcgcgaccguaugcgccagccacuucugcagcuccgcaaccucaggaaagaaaucaacggaaauccaguuccacucgggcucccuugugggaaaaacagcgauacacgucaaaggcgcgcucguggauggcaccgaguucacguucgaaggcuccugcauguucccagacggaugcgacgcaguagacugcaccuucuguagggaguuccucaaaaacccacagugcuacccagccaaaaaguggcuauuuauaaucauaguaaucuuacuaggcuacgcaggucuaaugcuccucacaaauguccucaaagcaauaggcguauggggcucauggguaauagcgcccgugaagcucguguucgcaaucauaaagaaacuaaugcgagcggucuccugccuaaugggcaaacuaauggaccguggacgccaggucauccacgaggaaaucggcgaaaaccgcgaaggaaaccaaaacgaugucagaauugaaauggcaagaccgagacgaguaagacacuggauguacucgccugucauacuaacgauauuagcaauaggcuucgccgaagggugugacgagaugguacaugcagacuccaagcuagucucgugcagacagggcagcgaaaacaugaaggagugcgucacuacgggcagagcucugcuccccgcaguaaaccccggacaagaggccugccugcacuucacagcccccggcucacccgacucgaaaugccuaaaaauaaaaguuaaacgcauaaaucuaaagugcaaaaagagcuccucauacuucgugcccgacgccaggucacgcuguacaagcgucagaagauguagaugggcgggcgauugccagucggguugcccuccacauuucacgaguaacucauucuccgacgacugggcagggaaaauggaccgggccggccucggguucuccgguugcagugacggaugcggaggagcagcauguggaugcuucaacgcagcccccagcugcauauucuggcgcaaaugggucgaaaacccacacggaaucauuuggaaagucucgccaugcgcugcauggguacccucggccgucaucgaauuaacaaugccaagcggcgaaguacgcacguuccacccgaugagcggaauccccacacaggucuucaaaggcguaucaguaaccuaccucggauccgacauggaggucaguggacucaccgaccuaugugaaauagaggaacugaaaagcaagaaacucgcgcuagcccccuguaaccaggcgggcaugggcgucgucgggaaagucggagaaauucaauguagcagcgaagaaucggcacgaacaaucaaaaaggacggaugcauauggaacgcagacuuaguagguauagaacuaagaguugaugacgccgucuguuacucaaaaauaaccucagucgaggcagucgcaaacuacagcgccaucccaacgacgauuggcgggcucagguucgaacgcagccacgacucccaaggcaaaauaucaggcucgccacucgacauaaccgccauacgcggauccuucucggucaacuaccgaggacugagauugagccugucagaaaucacagccacaugcacgggagaaguaaccaacgucagcggaugcuacagcugcaugaccggagccaaaguaagcaucaaacuacacagcuccaagaacucaaccgcacacguacgcuguaaaggagacgagacggccuucagcguacuagaggguguccacuccuacagcgugaguuuauccuucgaucacgcaguaguagacgaacagugccaacucaacugcggcggacacgaaagccaaguaacguuacgaggaaaccugauuuuccuagacgucccaaaauucguagacggaucuuacaugcaaacguaccacagcacaguaccaaccggggcaaauaucccaagccccaccgacuggcuaaacgcacucuucggcaacggacuuucccgauggauccuaggggucauaggcgugcuauuaggcgggcuugcccucuucuucuuaauuaugagccuguucaaacucggcacgaagcaagucuuccggucacgcacgaaacuagcauga

SEQ ID NO: 16453 - RNA, 3222 nt, Artificial Sequence
  derived and/or modified CDS sequence (opt11) from SFTSV(ZJZHSH-FDE/China/06/2012)__KR017859.1__GP
augaugaaagugauaugguucuccucguuaaucugcuuagugauccaaugcaguggagacaccggaccgauaaucugcgcagggcccauacacucgaacaaaucugcuaauauaccacaccuccugggguacagugagaaaauaugccaaaucgaccgucucauacacgucuccuccuggcuccgcaaccacagccaauuucaaggauacgucggccagcggggcggccgcagccaagucucauauuacccagcagaaaacagcuacucaagaugguccggacuccuuaguccaugcgacgccgacuggcucgggaugcuaguugucaagaaagcgaaagguagugacaugaucgucccgggacccagcuacaaaggcaaagucuucuucgaacgcccaacauucgauggauacgucggaugggguuguggguccggcaaaagcagaaccgaaagcggcgaacugugcaguagcgacucgggcacguccucgggccugcuaccaagcgacagaguccuauggaucggcgacgucgcgugucaaccgaugacccccauccccgaagaaacauuccuggaacucaaaucguucucacagagcgaauuuccggacauaugcaagauagacggcaucguauucaaucagugcgagagcgagagccuaccccaaccauucgauguagcauggauggacguagggcacagccacaaaaucaucaugcgagagcacaaaacaaaauggguccaagagagcagcuccaaagacuuuguaugcuacaaggaaggcaccggcccaugcagcgaauccgaagagaaaacgugcaaaacuagcggcuccugccgaggugacaugcaauucugcaaaguggcaggaugcgaacacggcgaagaggcuucagaagccaaaugcagaugcagccucguacacaaaccgggcgaaguggucgugaguuauggagggaugcgcguacgacccaaaugcuacggguucagucgaaugauggcuacccucgagguaaacccgcccgagcagcgaaucgggcaguguacaggcugccaccucgaaugcaucaacggcggaguccgccucaucacccuaacuucggaacucaaaagcgccaccgucugcgccucacacuucugcuccuccgccaccuccgguaagaaauccacagaaauccaauuccacucagggagccugguaggaaaagcagcaauccacgucaaaggugcccuaguagacggcacugaauuuaccuucgaaggauccugcauguucccagacggcugcgacgcaguggacugcacuuucugccgcgaguuccucaaaaacccacaaugcuacccggcgaagaaauggcuauucauaaucaucguaauccuccuaggguacgccggccugaugcuccucacaaacguccuaaaagccaucggugucuggggaagcuggguaaucgcacccgugaaacucauguucgccauaaucaagaaauugaugcgcagcgucagcugccucaugggaaaacugauggaucgaggacgacaagucauacaugaagaaauaggugaaaaccgcgaaggcaaccaagacgacgugcgaaucgaaaugguccgcccacgccgcguacgacacuggauguacagccccgucauccuaaccaucuuagcgaucggcuuaacagaagggugcgacgaaaugguccacgccgacucaaaacucguaucuugccggcaaggcagcggcaacaugaaagaaugcgucacgacaggcagagcacuacuccccgccguaaacccaggacaagaggcuugccugcacuucacggcaccaggcagcccagacucgaaaugcuuaaaaauuaaaguaaaacgcauaaacuuaaaaugcaagaaaagcagcucauacuucguccccgacgcccgcagucggugcacgucggugcgacgaugccgaugggccggagacugccagucgggaugccccucccacuucacaagcaacucauuuagcgacgauugggccggcaaaauggaccgagccggccucggauucuccggaugcagcgacggaugugggggugccgcaugcggguguuucaacgcagcaccaucauguaucuucuggcggaaauggguggaaaacccacacggcauuaucuggaaaguaagcccgugcgcagcauggguacccucagcagucauagaacucacaaugcccagcggagaagugcgcaccuuucacccaaugucagguauaccuacacaggucuucaaaggagucuccguaaccuaccuuggaagcgacauggaggucucuggccuaaccgaccucugcgaaaucgaagaacucaaauccaagaaacuggcccucgccccgugcaaccaagccggcaugggaguagucggcaaaguaggagaaauccagugcagcucagaagaguccgcacgaaccaucaagaaagacggaugcaucuggaacgccgaccuagucggcaucgaacuucgcguggacgacgcagucugcuacuccaaaauaaccucaguagaagcagucgcgaacuauuccgcaauccccacuaccauaggcggccuacgauucgaacguucccacgacucacagggaaaaauaagcggcucaccccucgacaucaccgccauccgaggauccuucucugucaacuaccgcggccuacgcuuaucacuaucagagaucacggcaaccugcacaggugaagugacaaacguguccggauguuacucaugcaugaccggagccaaagugucaaucaaacuacacucaagcaaaaacucaaccgcccacguccgcugcaaaggugacgagaccgccuucucagugcuagaaggcgugcacucguacaccgugucucucagcuucgaccacgccgucguugacgagcaaugucaacuaaacugcggcggacacgaaucucaagucacccuaaaaggcaaccucauauuccuggacguccccaaauucgucgacggcagcuauaugcagacauaccacucaucaguuccaaccggcgccaacauaccuucaccaaccgacuggcucaacgcccucuuugguaacggccuaucacgguggauacucggcgucauaggaguccuauuaggaggccucgcacucuucuuccuaaucaugagucuguuuaaacuuggcaccaaacaggucuuuagaagcagaacgaagcucgcauga

SEQ ID NO: 16454 - RNA, 3222 nt, Artificial Sequence
  derived and/or modified CDS sequence (opt11) from SFTSV(ZJZHSH-FZHR/China/07/2013)__KR017862.1__GP
augaugaaagucaucugguucagcucacucaucugccuugugauacaaugcgggggcgacacgggucccaucauaugcgcggguccgauccauagcaacaaaagggcaggaaucccccaccuccucggguacagcgaaaagaucugccaaauagacagauugauacauguauccagcuggcuucgaaaucacagccaauuccaaggguacguaggacaacgcggaggaaggucacaagugagcuacuaccccgcggaaaauucguacuccagguggucgggccuauuaucaccuugcgacgccgacuggcuaggcauguuaguagucaaaaaggccaagggaagcgacaugauaguaccagggcccagcuacaaaggcaaaguauucuucgaacgaccaaccuuugacggguacgucggauggggaugcggaucuggaaagucuaggacggaaucaggagaacugugcucaagcgacuccggaacaagcagcggccuccucccaagugacagaguccuauggauaggagacguggcgugccaaccaaugacacccaucccggaagagaccuuccuagaacucaaaucauuuucacagagcgaguucccggauguauguaaaauugacggcaucgucuuuaaccaaugcgaaggcgaaucuuuaccucaacccuucgauguugccuggauggacgucggccacucgcacaagauaauuaugagagagcacaaaacaaaauggguccaagaaucaagcucaaaagacuucgugugcuacaaggaaggaacaggccccugcagcgaaagcgaggagaaaaccugcaaaacguccggcucaugcaggggcgacaugcaauucuguaaggucgcgggcugcgagcacggggaagaggcauccgaggcaaagugccgcugcagccuagugcacaaacccggagaaguugucgucagcuacgggggcaugcgaguccgaccaaaaugcuacggauucucccgaaugauggccaccuuagaagugaacccgccagaacagcgaaucggccaauguacaggaugucaccuugagugcauaaacggaggagucaggcuaauaacgcuaacaagcgaacucaaaagcgccaccgugugcgccagccauuucugcagcagcgcgaccucaggaaagaaaagcacagaaauucaauuccacuccggaagccuaguaggcaaaaccgcaauucacguaaaaggugcccucguagacgggaccgaauuuacauucgaagggagcugcauguucccagacgggugcgaugccguggauugcaccuucugcagagaguuccugaaaaacccucagugcuaccccgcaaagaaauggcuauucauaaucauagucaucuugcucggauaugcaggccuaauguuguuaacaaauguguuaaaagccaucggagucuggggcagcugggucauagccccgguaaaacucguguucgcgaucauaaagaaacucaugagagcagugucaugccucaugggaaaacuaauggaccgaggccgacagguaauacacgaagaaaucggggaaaauagggaaggcaaucaggacgauguaagaaucgaaauggcacgacccaggagagugcgccacuggauguacagcccagugauauugaccauauuagccaucggauuagcagaaggcugcgacgagauggugcacgcggauucaaaacuggucagcugccgccaggggucuggaaacaugaaagaaugcgucacaaccgggagagcgcuucuccccgcaguaaacccaggacaggaggcuugccuacacuuuaccgcaccaggaagucccgacucaaaaugccucaaaauaaaaguaaaaaggaucaaccuaaaaugcaagaaaagcagcaguuacuucgugccggacgccagaucaaggugcacaagcguacgcagaugccggugggcaggagacugccaaagcggaugcccgccccacuucacgagcaacagcuucagcgacgacugggcuggcaaaauggaccgagcgggccuaggguucucaggcugcagcgacgguugcggaggagccgcuuguggaugcuuuaacgcagcaccgagcugcauauucuggcgcaaauggguagaaaacccacacgggaucaucuggaaaguaucgccaugcgcagccugggucccaucggcuguaauagaacuaacaaugccaucaggcgaagugcgaacauuccacccgaugagcgggauccccacacaagucuucaaagggguaucaguaacauaucugggcagcgacauggagguauccggacucacagaccuaugcgagaucgaggaacuaaaaagcaagaaacuagcccuagcccccugcaaccaggcaggaaugggggucguaggcaaaguaggugaaauccaaugcuccagugaagaaagcgcacgcaccaucaagaaagauggcugcauauggaacgcagaccuaguagguauugagcucaggguagacgacgccguaugcuacagcaaaauaaccucgguagaagccgucgccaacuacucagcaaucccaacaacaaucggagggcucagauucgaacgcagccacgacagccaaggaaaaaucucagggucgccgcuggacaucacggcaauccgcggauccuuuucaguaaauuacaggggccuacgccugucccucuccgagauuaccgcaacaugcacgggagaggugacuaacgucagcggcugcuacagcugcaugacgggggcaaaagugucaauaaaacuacacuccagcaaaaacaguaccgcccacguacggugcaaaggugacgaaaccgcauuuuccguccuagaaggaguacacaguuauagcguaucccucagcuucgaccacgcuguaguggacgagcaaugccagcucaauugcgggggacacgaaagccaggucacccuaagaggaaaccucauauuccuagacguccccaaauucguggacggauccuacaugcaaacauaccacagcacaguacccacaggcgcgaacauaccaucaccgaccgauuggcucaacgcccucuuugguaacggccucucuagguggauccucggcgucaucgguguacuccuagguggacuagcacuguucuuucugauaaugagccuauuuaaacuaggaaccaaacaggucuuccgcaguaggaccaagcucgcguaa

SEQ ID NO: 16455 - RNA, 3222 nt, Artificial Sequence
  derived and/or modified CDS sequence (opt11) from SFTSV(ZJZHSH-HCY/China/06/2012)__KR017855.1__GP
augaugaaagucauaugguuccccucgcuuaucugccuagugauacagugcaguggugacaccggcccaaucaucugcgcaggcccaauccacucgaacaagagcgccaacaucccacaucugcuaggauacucagagaagauaugccaaaucgaccgacucauccacguaucuagcuggcuaagaaaccacagccaguuucagggcuacgucggccagagaggcggccggagccaagucuccuacuaccccgcagagaacucauacagccgauggaguggucugcuaucacccugcgaugcagacuggcuaggaaugcuaguaguaaagaaagcgaaaggaucagacaugaucguacccgggccgagcuacaaaggaaaaguauucuucgaacgccccacguucgacggguaugucggcuggggcugcggaucgggcaaaaguaggaccgagagcggggagcuauguucuucagacuccggcaccagcagcggacugcuacccagcgacagaguccuguggauaggagacgucgcaugccagcccaugacaccgauaccagaagaaacauuccucgagcucaaaaguuucucgcaguccgaauuucccgacauaugcaaaauagauggcauaguuuucaaccagugcgagagcgaaagccuaccccaaccauucgacgucgccuggauggacguaggccacagccacaagauaauaaugagagaacacaaaacaaaaugggugcaagaaaguagcagcaaagacuucgugugcuacaaagaaggcacaggaccgugcuccgaguccgaagagaaaacgugcaagaccucaggaagcugccgcggcgacaugcaauucugcaaagucgcagggugcgaacacggcgaagaggccuccgaagcgaaaugcagaugcagccuagugcacaaaccaggcgaaguagugguaucguacggggguaugcgaguccggccgaaaugcuacggauucagccgcaugauggccacucuagaagugaacccgccagaacaacgcaucgggcagugcacuggaugccaccuugaaugcaucaacggaggaguacgccuagucacccuaaccuccgagcuaaagagcgcaaccgucugcgccucacacuucugcuccuccgccaccuccgguaagaaaagcacagagauacaauuccacagcggcagccuagucgguaaagcagccauacacguaaaaggcgcauuaguggacggaaccgaguucacguucgaaggguccugcauguucccugacggaugcgacgcaguggauugcaccuucugccgcgaguuccucaaaaacccccagugcuaccccgcaaagaaauggcuauucaucauaauugucauccuacucggauacgcaggcuuaaugcugcugaccaacguacugaaagccauaggagucuggggcuccuggguuauagcaccggucaaacuaauguucgcgaucaucaaaaagcugaugagaagcguaucaugccugaugggcaagcucauggacagaggaagacagguaauacacgaagaaauaggcgaaaacagagaaggaaaccaagaugacguacgcauagaaauggugcgaccccgacgcguacggcacuggauguacagcccaguaauccuaaccauccuggcaauaggacucacagaaggcugcgacgaaaugguccacgcagacaguaagcucguaucaugccggcaaggaaguggcaacaugaaagaguguguaaccacaggccgggcccuccucccugccgugaaccccgggcaggaagcgugccuacacuucacagcaccaggaucgcccgacuccaagugccucaagaucaaaguaaaacgcaucaaccuaaaaugcaagaaaagcagcuccuacuucgucccggacgcacgauccagaugcaccagcguccgaagaugccgaugggcaggagacugccaaagcgguuguccaucccacuucacuucuaauucauucagcgacgacugggcgggcaaaauggacagagcgggccuuggauucaguggaugcagcgacggguguggcggcgccgcguguggauguuucaacgcagcaccaagcugcaucuucuggagaaaaugggucgagaacccacacggaauaauauggaaggucucaccaugcgccgccuggguacccucagcuguaaucgaacuaaccaugccuagcggagaggugcgcacauuccacccaaugagcgggauuccgacccagguauucaaaggaguaucagucaccuaccugggaucagacauggaaguuucgggacuaacagaccuaugcgaaaucgaggaacuaaaauccaaaaagcuggcgcuagcaccgugcaaccaagcugggaugggaguaguaggaaaagucggagagauacaaugcagcagcgaagaaagcgcacgaaccaucaagaaagauggcugcaucuggaacgcggaccuaguuggaauagaacucagagucgacgacgcggucugcuauagcaaaauaaccuccgucgaggccgucgccaauuauagcgccauacccaccaccauaggcggacuucgauucgagcgcucacacgacagccaaggaaaaauaagcggcucaccccuagacauaacagcaaucagaggaucauucucagucaacuacagaggacugagacuaucucugagugagaucacagccacuugcacaggcgaagugacaaacgucucgggcugcuacuccugcaugaccggcgcgaaagucagcauaaagcuccacuccagcaagaacuccacagcacacguccggugcaagggggacgaaacggcguucaguguacuagaggggguccacucguacaccgugagccucagcuucgaccacgccguaguggacgaacaaugccaacucaacugcggcggacacgaaucgcaagugacacugaaaggcaaucugaucuuccucgacguuccgaaauucguugaugguucauacaugcaaacauaccauuccuccgucccaacaggcgccaacauccccuccccgacugauuggcucaacgcccucuucggaaacggacucagcagauggauccucggaguaaucggaguacuacuaggaggacuagcccuauucuuccuauucaugagccuauucaagcucgggacuaaacaggucuucagaaguagaacgaaacuugcguaa

SEQ ID NO: 16456 - RNA, 3222 nt, Artificial Sequence
  derived and/or modified CDS sequence (opt11) from SFTSV(ZJZHSH-HYC/China/05/2012)__KR017847.1__GP
augaugaaaguaauaugguucagcucccuaauaugcuuagugauacaaugcuccggugacacgggaccgaucauaugugcgggcccaauccacuccaauaaaucggcuaauaucccccacuuacucggguacuccgaaaagauaugccagauagacagacucauucaugucuccucauggcuucgcaaccauucgcaguuucaaggguacguaggccaacguggcggacgcagccaaguaucauacuaccccgcggaaaauagcuacagcagauggucuggccuacuuucgccaugcgacgccgacuggcuugggaugcucguagucaagaaagcuaaaggcucggacaugauaguacccggaccauccuacaaaggaaaagucuucuucgaacgcccaacguucgacggcuacguagguuggggaugcggaucggggaaaucacgaacagaaagcggggaacucugcagcagcgauagcggcaccuccagcgggcucuugcccucggacagaguccuauggauaggcgacguugcuugccaaccgaugacacccauuccggaagaaacauuccuggaacuaaaauccuucucccaaagcgaguucccggacauaugcaaaauugacggcaucgucuuuaaccagugcgagagcgaaagucuaccucagccguuugauguagccuggauggacguaggccacucccacaaaaucauaaugagagagcacaaaacaaaauggguacaggaaucaagcaguaaagacuucgugugcuacaaagaaggcaccggaccgugcuccgaaucggaagaaaagacuugcaagaccaguggaucgugccggggagauaugcaauuuuguaaaguagccggaugcgaacauggcgaagaagcaucggaggccaaaugccgcugcagccuaguccacaaaccaggcgagguaguagucaguuacggaggcaugcgaguccgacccaaauguuacggcuucucacgcaugauggccaccuuggaaguaaaucccccagagcagagaaucggacagugcacugggugccaccuggaaugcauaaacggaggcguacgacuaaucacacuaacaagcgaacuaaaaagcgcaacggucugcgcgagccacuucugcagcucugccacaucuggaaagaaaaguacggaaauccaauuucacucuggaucgcuaguaggcaaagccgcaauacacgucaaaggcgcacugguggacggaacugaguucacauucgaaggaucgugcauguucccagacggcugcgacgccguagacuguaccuucugcagggaguuccucaaaaacccacaaugcuauccagccaagaaauggcuguucauaauaauagugauacugcucggauacgcaggucucaugcugcuaacgaacguccugaaagcaauaggcgucuggggcucaugggucauagccccagugaagcugauguucgccaucauaaagaaauuaaugagaucagugucaugccuaauggggaaacugauggaccgggggcgacaagucauacacgaggaaauaggugagaacagaaaaggaaaccaagacgauguacggauagaaauggugcggccacgaagagugcgacacuggauguacagcccgguaauacucacaauacuagcgauaggguuaacagaagggugcgacgagaugguccacgcggacucgaaacucguauccugcagacaaggaagugggaacaugaaagagugcgugacuacgggacgggcccuacuuccggcggucaacccaggacaggaagcaugccugcacuucaccgcgccaggcagcccggauuccaaaugccuuaaaauaaaagucaaaagaaucaaccuaaaaugcaagaaaagcucgagcuacuuuguccccgacgccaggagcagaugcacaagugugcgaaggugccgaugggccggcgacugccaaaguggcugccccagccacuucacaagcaacucuuucagugacgacugggcaggcaaaauggacagggcuggguuaggguucuccggcugcagcgauggaugcggaggcgcugccugcgguuguuucaacgcggcaccaagcugcaucuucuggaggaaaugggucgagaacccacacgggaucaucuggaaagucucgcccugcgcagcauggguaccaucagcaguuaucgaacuaacaaugcccagcggagaaguccgcacguuucaccccaugucagggauaccaacucagguguucaaaggggugagcguaacguacuuagguuccgacauggaaguaucaggacucacggaccugugcgagaucgaggaacuaaaaucgaagaaacucgcgcuagcacccugcaaccaggccggaaugggcgucgugggcaaagucggagaaauccaaugcuccucggaagaauccgcacgcacgauaaagaaagacggaugcaucuggaacgcagaucuagucggaauagaacuccgugucgacgacgcaguaugcuacagcaaaauaacuucggucgaggccguggccaacuacucagcgauccccacgaccauaggagggcuacgauucgaacgaucucacgacagccaaggcaagaucagcggaucaccccuagacauaacagcaaucagagguucauucucagucaacuacaggggccuccgacugagccuguccgaaaucacagccaccuguacaggcgagguaacgaacgucaguggaugcuacagcugcaugacgggcgccaaagugagcauaaaacuccacucauccaaaaacucaaccgcacacguacgaugcaaaggggacgaaaccgcguucucagugcuagaaggaguacacuccuauaccgugagcuugagcuucgaccacgcaguggucgacgaacagugucagcucaacugcggcggacacgagagccaggugacccuaaaagggaacuuaaucuuccuagacgucccuaaguucgucgacgggagcuacaugcaaacuuaccacagcucaguaccgaccggggcaaacauccccagcccgacagacuggcuaaacgcacuauucggcaacgggcuaagccgcuggauacuaggagugauugggguacugcucggcggccuugcccucuucuuccucaucaugucccuguucaaacucggaacaaaacaaguauuccgaaguagaacaaagcuagccuag

SEQ ID NO: 16457 - RNA, 3222 nt, Artificial Sequence
  derived and/or modified CDS sequence (opt11) from SFTSV(ZJZHSH-HYJ/China/07/2012)__KR017852.1__GP
augaugaaagucaucugguuuuccucccugaucugccucgucauacaguguagcggagauaccggcccaaucauuugcgcaggcccaauacacuccaacaaauccgccaacaucccucaccuacuaggauacucagagaaaaucugccagauagaccggcucauacauguaaguucauggcuccgaaaccacagccaauuucaaggauacgucggacaacgcgggggcaggagccaaguaucuuacuaucccgcggaaaacagcuacucacggugguccggucugcuaucacccugcgacgcagacuggcuaggaaugcuagucgucaagaaagcgaaaggauccgacaugaucguucccggccccagcuacaaaggaaaagucuucuucgaacgccccaccuuugacggauacguaggauggggcugcggauccggcaaauccagaaccgaaucuggcgaacucugcuccuccgacaguggaaccuccagcggccuucucccaagcgacagaguccucuggaucggcgacguagcuugccaaccaaugacgccgaucccggaagaaacauuucucgaguugaaaaguuucagccaaagugaguucccggacauaugcaaaauagauggcauagucuucaaccaaugcgagagcgaaagucuaccacaacccuucgacguagccuggauggacguaggccacucacacaaaauaauuaugagagagcacaaaaccaaauggguacaagaaucgucuuccaaagacuuugucugcuacaaagagggcacaggacccugcucagaaucagaggagaaaaccugcaaaacaucaggcucaugcaggggcgacaugcaauucugcaaagucgcgggaugugaacacggagaagaagccuccgaagccaaaugcagaugcucccuggugcacaagcccggggaggucguggucucauacgguggcaugcgcguccgaccaaagugcuacgguuucucccguaugauggccacgcuggaaguaaacccgcccgaacaaaggaucggacaaugcacgggaugccaccuagaaugcauaaauggagguguacgacugauaacccucacaagcgagcuaaagagcgcaaccgucugcgcaagccacuucugcagcucugcaacgucaggcaagaaaaguaccgaaauucaguuccacucaggcucccuagucggaaaagccgcgauccacgucaaaggcgcccucguggauggaaccgaguuuaccuucgaaggcucaugcauguuccccgacggaugcgaugcuguagacugcaccuucugcagagaguuccuaaagaacccacaauguuacccagccaagaaauggcuauucauuaucauuguaauauuacuaggguacgcgggguuaaugcuacugacaaacguacuaaaagcaauaggaguauggggaucauggguaaucgcccccgucaaacucauguuugccauuauaaagaaacucaugagauccgucucaugccuuauggguaaacucauggaccgcgggcgacaagugauccacgaagaaauaggagaaaaccgcgagggaaaccaggacgacgucaggaucgaaauggugcgacccagacgagucagacacuggauguacagcccugucauacuaaccauccuggcuaucggacugacugaagggugcgaugagaugguccacgcagacaguaaacuggucuccuguaggcaaggaagugggaacaugaaagaaugcgucaccacaggcagggcguugcucccagcggugaacccuggccaggaagcgugccuucacuucacagcccccggaagccccgacuccaaaugccucaaaguaaaaguaaaacgaaucaaccugaaaugcaagaaaagcaguucauacuucgucccagacgcccgcucaagaugcaccagcguacgccggugcagaugggcaggagacugccagagcggcugcccaucccacuuuacguccaauucauucucagacgacugggcggggaaaauggaccgagccggccucggguucucaggcugcagcgacggcuguggaggggccgccugcggcuguuuuaacgcugcacccagcugcauuuucuggagaaaauggguagagaacccgcacggcauuauauggaaagucucuccaugcgccgccugggugcccucggccguaauugaacucacaaugccaagcggcgagguacgcacguuccaccccaugucaggcaucccgacccaaguuuuuaaaggagucuccguaaccuaccucgguuccgacauggaaguauccggccucacagaucucugugaaaucgaagaacuaaaaagcaaaaagcuagcccucgcgcccugcaaccaggcaggcauggggguaguaggcaaagucggggaaauacagugcaguuccgaagaauccgcaagaacuauuaagaaagacggcuguaucuggaacgccgacuuagucgggauugaacuccgcguagaugacgccgucuguuauucuaaaaucacauccguugaggcaguggcaaacuacucagcaauaccuaccaccaucggcggacuccgauucgaacgcucacacgacagccaggggaaaauaucgggcucgcccuuagacauaaccgccauccgggguagcuucagcgugaauuaucgaggacugagacuuagccugagcgagaucacggcgacgugcacaggagaggucacaaacgucuccggaugcuacuccugcaugaccggcgcaaaagucaguaucaaacugcacucaagcaaaaacagcacagcacacguacgcugcaaaggugacgaaacagccuucagcguuuuggaaggaguccacucauacaccgucucacucaguuucgaccacgcaguaguagacgagcaaugccagcuaaacugcggcggacacgaaucgcaagugacccucaaaggaaaucucaucuuccucgacguuccaaaauucguagacggaucguacaugcaaacguaccacagcucaguaccaaccggagccaacauccccagcccaaccgauugguuaaacgcacucuucggcaauggucuaucacgauggauccucggcgucaucggaguacugcugggcggacucgcccucuucuuucucaucaugucccuguucaaacucgggaccaaacaaguauuuaggucgagaacaaaacuagccuag

SEQ ID NO: 16458 - RNA, 3222 nt, Artificial Sequence
  derived and/or modified CDS sequence (opt11) from SFTSV(ZJZHSH-LU/China/10/2011)__KR017850.1__GP
augaugaaagugauaugguucagcagccuaaucugcuuagugauccaaugcagcggagacacgggacccauaaucugcgccggaccaauccacuccaacaaaucagcuaacaucccgcaucuccucggcuacucagaaaagauaugccaaauagaccgccucauacacguaagcucguggcuaagaaaccacagccaauuccaaggauacguuggccaacgcggcggccgcucccaaguaucauacuacccagcggaaaacucuuacagucgaugguccgggcugcuuucacccugcgaugcagacugguuagggaugcuagucgugaagaaagccaaagggagcgacaugauaguacccgggcccucguacaaaggaaaaguauucuucgaacgaccaacauucgacggguaugucggcuggggcugcggcuccggcaaaaguagaaccgagagcggggaacucugcagcagcgacuccggcaccucaagcggccuccuaccaagcgaccgcguucuauggauaggagacguagccugccaacccaugacaccaaucccagaagaaaccuuccuugaacucaagagcuucucacaaagcgaauuucccgacaugugcaaaauagacggaauagucuucaaccaaugcgagagcgagagcuuaccacagcccuucgacguagccuggauggacgucggccacagccauaaaauaaucaugagggaacacaaaacaaaauggguacaagaaucguccagcaaagacuucguaugcuacaaagaagguacaggaccuugcagcgaaagcgaagagaaaacaugcaaaaccuccggcuccugccgaggcgauaugcaguucuguaaagucgccggaugcgaacacggggaagaggcuucggaagcgaaaugcagaugcucgcuagugcacaaacccggggaagucgucgucucauacggcggaaugcgcguucgacccaagugcuacggauucaguagaaugauggccacacucgaaguaaacccaccggaacaaagaauaggacaaugcaccgggugccaccuagaauguauaaacggaggcguacgacucguaacgcucacaagcgaacuaaaaucggcaacagucugcgcuagccacuucugcagcuccgccacaucgggaaagaaaagcacagaaauacaauuucauagcggaucgcucgucggcaaagccgcaauacacgucaaaggcgcuuugguagacggcacagaguucacauuugaaggaagcugcauguucccagacggcugcgacgccgucgauugcaccuucugccgggaguuccucaaaaacccccaguguuacccagccaagaaauggcuguucaucauuaucguaauacuccucggauacgccggccuaaugcuucucaccaaugugcuuaaagcaaucggcgucuggggcagcugggucaucgccccagucaaacugauguucgcaaucauuaagaaacugaugcgauccgucucgugccucauggguaaacugauggaccgaggccgccaaguaauacacgaagagaucggagaaaaccgagaaggaaaucaggacgauguccgaauagagauggugcguccccgccgaguacgacauuggauguauucacccgugauacuuaccauacuggcgauaggacucaccgagggcugcgaugaaaugguacacgcagacagcaaacuggucuccugcaggcaaggcagcgggaacaugaaagaaugcgucacaaccggcagagcccuacuaccagcagugaacccgggacaagaagcaugccugcacuucacggcacccggaucacccgauagcaaaugccucaaaauaaaagugaaaaggauaaaccucaaaugcaagaaauccaguuccuacuucguaccggacgcacgaucccggugcacgaguguaagacgcugucgaugggccggcgacugccaaucugguugcccgucacacuucacaagcaacagcuucucagacgacugggccgggaaaauggaccgcgcagggcuaggauucagcggcugcagcgacggauguggaggggccgccugcggcugcuucaaugcagcaccaagcugcauauucuggcgaaaauggguagaaaacccacacggcauuaucuggaaagucucgccaugugcagccuggguacccagugccguaauagaacuaacgaugccgagcggcgagguccgcacuuuccaccccaugagcgggauaccgacacaaguauucaaagggguauccgucacauaccuaggaucggacauggaaguaagcggccuaacugaccucugcgagaucgaagaacugaaaucaaagaaacucgcccucgcccccugcaaccaagcaggaauggggguggucggcaaagucggcgaaauccaaugcagcagcgaggaauccgcccguacgaucaagaaagacggaugcaucuggaaugcggaccuugucgggaucgagcuacgagucgaugaugcggucugcuacucaaaaaucacguccguagaggccguagcaaacuacucagcaauucccacaacaauaggcggacuccgauucgagcgcucgcacgacagccaagggaaaaucucgggauccccacuagacauaaccgcgauacgaggauccuucucggucaacuaccgcgggcuaagacugucauugagugaaaucaccgcuacaugcacuggagaaguaaccaacgugagugguugcuacagcugcaugacgggcgcgaaaguaaguauaaagcuccacucauccaagaacuccaccgcacacguaagaugcaaaggcgacgaaacagcguuuuccguacuagaggggguccacuccuacacgguauccuuauccuucgaccacgcagucguagacgagcaaugucagcucaacugcgggggccacgaaagccagguaacucugaagggcaaccucauuuucuuagacguuccaaaauucguagacggaucauacaugcaaacauaccacagcucaguccccacgggagcgaacauaccgagcccgacggacuggcugaacgcacuauucggaaacgggcugagccgauggauacuaggagucaucggcgugcuccucgggggacuagcauuauucuuccuaauaaugagccuauucaaacucggaaccaaacaagucuucagaagccgcaccaaacucgcauaa

SEQ ID NO: 16459 - RNA, 3222 nt, Artificial Sequence
  derived and/or modified CDS sequence (opt11) from SFTSV(ZJZHSH-SHZ/China/05/2012)__KR017848.1__GP
augaugaaagucauaugguucuccagucuaaucugccuaguaauacaaugcagcggggacacaggccccauaauaugugcaggaccuauacacagcaacaagagcgccaacaucccgcaccuacucggauacagcgaaaagauaugucagauagaccggcuaauccacguguccagcuggcuacgcaaccacucccaauuccaaggauauguagggcagcgcgggggcaggucacagguaucauacuacccggcagaaaacucauacucaagauggucgggucuacuaucaccaugcgacgccgacuggcuggggaugcuggucguaaagaaggcaaaaggcucagacaugaucguaccgggcccauccuacaaggggaaaguauuuuucgaaaggcccacguucgacggcuacgucggcugggggugcggcuccggcaaaaguagaacagaauccggagaacuaugcuccagcgauucgggaacgucguccgggcuacuccccuccgaccgaguacucuggauaggcgaugucgccugucagcccaugacaccgauacccgaggaaacguuccuagaacucaagagcuucucccaaagcgaguucccggacauaugcaagauagacggcaucgucuucaaccaaugcgaaagcgaaucacucccgcaaccauucgacguagcauggauggacgucggacacucccacaaaaucauaaugagggaacacaaaacaaaauggguccaagaaagcagcuccaaagacuucguaugcuauaaagagggcacaggaccuugcucagagagcgaagaaaagacaugcaaaacaucaggcagcuguaggggcgacaugcaauucugcaaaguagcuggcugugaacacggcgaagaggcaagcgaagcaaaaugccgcuguagccucguacacaaacccggggaggucgugguauccuaugggggcaugcggguuagaccgaaaugcuacggauuuucaagaaugauggcaacgcucgaagucaauccgccagaacagcgaauagggcaguguaccggcugucaucuagagugcaucaacggaggcgugcgccuggucacacucaccagcgaacucaaaagcgcaacaguaugcgcgucacacuuuugcaguagcgccaccagcggcaagaaauccacagaaauacaguuccacagcggcucgcucguaggcaaagccgcgauccacgucaaaggcgcacuugucgacggaacagaguucaccuucgaaggcagcugcauguucccagacggaugcgacgccgucgauugcacuuuuugccgagaguuccucaaaaacccccaauguuacccugcaaagaaauggcuguucauaauaaucguuauucuccucggauacgcaggccuaaugcuacucacgaacguacuaaaagccauaggcguaugggguaguugggucauagcacccguuaaacucauguucgcgaucauaaagaaacucaugagaucagucuccugcuuaaugggaaagcuaauggaccgaggccgccaaguaauacacgaagaaaucggagaaaauagggaagguaaccaagacgauguacggaucgagaugguccgcccaagaagagucagacacuggauguacagccccguaauccuaaccauacuugcaaucggacucacagagggcugugacgagaugguacaugcagacucgaaacugguaagcugcagacaaggcagcggcaauaugaaagaaugcguaacaaccggcagagcccugcuaccggcagucaauccaggacaggaagcaugccuacacuucacagcacccggaagcccugacaguaaaugccucaaaaucaaaguaaaacgcauaaaccugaagugcaaaaagucaucgucguacuuuguacccgacgcccggagccgauguaccuccgugcgucgcuguaggugggccggcgacugccaaaguggaugccccucacacuucacuagcaacagcuucagcgacgacugggcagggaagauggaccgcgccgggcuaggguucucgggaugcuccgacggaugcggaggagccgcaugcggaugcuucaacgcagcgccuucaugcaucuucuggagaaaguggguggaaaacccccacgggaucauauggaaagucucacccugcgccgccugggucccguccgcaguaauagagcucacaaugccauccggagaaguccgcacguuccaucccaugagcggaauccccacacaagucuucaaagggguaucagucaccuaccugggcagugacauggaagucucgggucucacagaccucugcgaaauagaagaacuaaaaagcaagaaacucgcacuggcaccauguaaccaagccgguauggguguagugggaaaaguaggcgaaauacaaugcagcucagaggaaucggcaagaacaaucaaaaaggacggcuguaucuggaacgcggaccuagucggcaucgaacuaagggucgacgacgccgucuguuacagcaagauuaccagcguagaagcuguagccaacuacucagcaauaccgaccaccaucggaggccuucgcuucgaacgaucccacgacucccagggaaaaauaagcggcucaccucucgacaucaccgcuauaaggggcucauucagcgucaacuaccgcggacuccgacucucacuaagcgagaucacagcaaccugcacaggcgaagucacaaacgugaguggaugcuacuccugcaugaccggagccaaagucaguauaaaacuccacagcagcaaaaacucaacagcccacgucagaugcaaaggcgacgaaacagccuucucaguacuggagggaguccacgguuacaccguaucacucaguuucgaccacgcaguuguggacgagcaaugccaacucaacugcggcggccacgaaucucaagugacccuaaaagguaaucucaucuuccuugacguaccaaaauuuguugacggcucuuacaugcaaaccuaccacagcucgguacccacaggagcaaauauacccucaccgacagauuggcuaaacgcacuauucggaaacggacucagccgcuggauauuaggcgugaucggcgucuuacucgggggacuagcauuauucuuucugaucaugucacuauucaaacugggaaccaaacaagucuucaggucgagaacaaaacuagcauaa

SEQ ID NO: 16460 - RNA, 3222 nt, Artificial Sequence
  derived and/or modified CDS sequence (opt11) from SFTSV(ZJZHSH-WSH/China/08/2012)__KR017854.1__GP
augaugaaggucauuugguucagcucccuaauaugccucgucauacaaugcgguggcgauacagggcccauaaucugcgcaggccccauacacagcaacaaaagcgccggcauaccccaccuacucggcuacagcgagaaaauaugucaaauagacaggcuaauacacguauccuccuggcuccgcaaccacucgcaguuccagggauacguagggcagcgaggaggucgcagccaggugagcuacuacccagcagaaaacagcuauucuagguggagcggcuuacucucgccaugcgacgcggacuggcugggaaugcuagucgucaagaaagcaaaggggucagacaugaucgugccagggccaagcuacaaaggaaaggucuucuucgaacgaccaacauuugacggguacguaggcugggggugcggcucagguaaaagcagaaccgaauccggugaacuaugcucaagcgacagcgggaccuccagcggccuccugccaucagacaggguauuauggauuggagacguagcaugccaaccaaugacaccgauaccggaagaaacauuccucgaacucaaaucauucucccaaagcgaguucccggacgucugcaaaaucgacggaauaguguucaaucaaugcgaaggagaauccuuaccccaacccuuugacguagccuggauggacgucggccacucacacaagauaauaaugcgggaacacaaaaccaaauggguccaagaauccuccucuaaagacuucgugugcuacaaagagggaacuggcccaugcucggaaagugaagagaaaacaugcaagacuuccggaucauguaggggcgacaugcaauuuugcaaaguggcagggugcgaacacggagaagaggcaucagaagcgaaaugcagaugcucccuaguccagaaacccggcgaaguaguggucucguacggaggcaugcgcguccgcccaaaaugcuacggauucucgagaaugauggcgacccuggaagugaacccacccgaacaacgcauaggccaauguacaggcugccaccuugaaugcaucaacgggggaguccgccuaauaacacugacaagcgagcucaagagcgcaaccguaugcgcaagccacuucugcagcagcgcaaccucagggaagaagaguacggaaauacaauuccacucaggcagccuagugggaaagacagccauccacgucaagggagcccuaguggauggcacagaguucacauucgaaggaucaugcauguuccccgacggaugcgacgcaguagauugcacauuuugcagagaguuccugaaaaacccgcaaugcuacccggcaaagaaauggcuauucauaauuaucguaauacuacuaggcuacgcaggacugaugcuacuaaccaacguccucaaagccauaggugugugggggucauggguaaucgccccaguaaaacuaauguucgcgauuaugaagaaacucaugaggucaguaagcugccuaaugggcaagcuaauggaccgcggccggcagguaauacacgaagaaauaggcgaaaaucgagaggggaaccaagacgacguacgaaucgaaaugguucgaccaagacgagugcggcacuggauguacagcccagucauacucacgauacuagcgaucggccuaacagaaggaugcgaugaaaugguacacgcggacagcaagcuagugucgugccggcaaggcagcggaaacaugaaggaauguguaacuaccgggcgugcccuacuccccgcuguaaacccaggacaagaagcgugccugcacuucacagcgcccggaucaccagacagcaaaugccugaaaaucaaagucaagcgcaucaaccucaaaugcaagaaaagcagcagcuauuucguaccugacgcaaggucaagaugcacaagcguuaggcgcugccgaugggcgggcgacugccaaagcggcuguccgccacacuucacaucgaacagcuuuucagaugacugggcaggaaaaauggaccgagccggacugggauucucagggugcucugacgggugcggaggggccgcgugcggaugcuucaacgcagcgccgagcuguaucuucuggagaaaauggguugagaacccgcacggaauaauauggaaagucuccccaugcgccgccugggugcccucggccguaauagagcucaccaugcccucuggcgaaguacggacguuccaucccaugagcggcauaccaacacagguauucaaaggagucucagugacauaccuaggcagugauauggaagucagcggccucacggaccucugcgagauugaggaacugaaaucgaagaaacucgcacuagcaccguguaaccaagcuggaaugggcgucgucggaaaagucggcgagauacaaugcuccagugaagaaucggccagaacgaucaagaaagacgggugcauauggaacgcggaccuggucggcauugaauuaagaguagaugacgcggucugcuacucaaaaauaacaucagucgaagcagucgccaacuacucggcaauucccacgacaauaggcgggcucagguucgagcgcagccacgacagccagggaaaaaucuccggaucgccccuugacaucacagcaaucagaggaucguuuagcgucaauuaccggggacuacgucugagccuauccgaaaucacagccacaugcaccggcgagguaaccaacgucagcggcugcuauagcugcaugacaggagccaaaguaagcauaaaacuccacucuagcaaaaacaguaccgcgcacgugcggugcaaaggggacgaaacagcguucucaguauuggagggcguacacucguacagcguaagccugagcuuugaucacgcgguaguagacgaacaaugccagcuaaacugcggcggacacgaaucucaagugacccuaagaggcaaccuaaucuuccuagacguccccaaauuuguggacgguagcuacaugcaaaccuaccacucaacaguccccaccggcgccaacauaccauccccaacagauuggcuaaacgcguuauuugggaacggccuaagccgguggauccuaggggucauaggcguacugcuaggcgggcuagcgcuguucuuccugaucaugagucuguucaaacuaggcacaaagcaagucuuccggucacguacuaaacuagcauaa

SEQ ID NO: 16461 - RNA, 3222 nt, Artificial Sequence
  derived and/or modified CDS sequence (opt11) from SFTSV(ZJZHSH-XAM/China/06/2012)__KR017853.1__GP
augaugaagguaauaugguucucaucacucauaugucuugucauucaaugcagcggagacacgggcccgauaaucugcgccgguccgauacacagcaacaagagcgcaaacaucccgcaccuccuaggauauuccgagaaaaucugccagaucgaccgccucauacacguauccagcugguuacgcaaccacucacaauuccaaggcuacgucgggcaacguggcggccgaagccaagucuccuacuacccagcagaaaauagcuacucacgcuggucuggucuccugagcccuugcgacgccgauuggcucggcauguugguugugaagaaagcaaaaggaucggacaugauaguaccagggcccagcuacaaggguaaagucuucuucgaacgcccgaccuucgacggcuacgugggcuggggcugcggcuccggcaagucccgaaccgaaucgggggaacugugcucauccgacuccggaacauccagcggacugcuacccucagacaggguucuguggauuggcgacgucgccugccaacccaugaccccgauaccagaagagaccuuucuugaacuaaaauccuuuucccaaagcgaauuucccgacauaugcaaaaucgacgggauagucuucaaccagugcgaaagcgaaagccuaccccaaccguucgacguagccuggauggacguuggccacagccacaaaauuauaaugcgcgaacacaaaaccaaauggguacaagaaucaucauccaaagacuucgucugcuacaaggaagguacaggccccugcucggaguccgaagagaaaacgugcaagacgucagguucaugcagaggcgacaugcaguucugcaaaguagcaggaugcgaacacggagaagaagccucagaagcgaaaugccgcugcuccuugguucauaaacccggagaagugguaguauccuacggggguaugagagugcgaccaaaauguuacggguucucccgcaugauggccacccuagaaguaaaucccccagaacaacgcaucggacaguguacaggaugccaccucgaaugcaucaauggcggaguacgacucguaacgcucacaucugaacuaaaaucggccacaguaugcgcgagccacuucugcagcucggcaacauccggaaagaaauccacagaaauccaguuucacagcggcucauuagucggcaaagccgcaauccacguaaaaggggcacucguagacggaacugaguucacguucgaaggauccuguauguucccugacggaugcgacgcaguggacugcaccuuuugccgggaguuccucaaaaacccccaguguuauccggccaaaaaguggcuauucaucaucauugugauccuccucggauacgcgggacuaaugcuacuaacaaacguacucaaagccauaggaguaugggguagcuggguaauagcacccgucaagcucguguucgccauaaucaaaaagcucaugcgcgcagucucuugccugaugggaaaacuaauggacagagggcgccaagucauacacgaggagauaggcgaaaacagggaaggcaaccaagacgacguccggaucgagauggcaagaccacgacguguaagacacuggauguacagcccagugauccuaaccauauuggccaucggacucgcagaggguugcgacgaaaugguccacgcggacucaaaacucguuucgugcagacaaggcagcggcaacaugaaagaaugugucaccacaggccgcgcacuacucccggcuguaaaucccggccaagaggccugccuacacuucacggcaccaggaucgcccgacucaaaaugccucaagaucaaggucaagcgaaucaaccuaaaauguaagaaaagcucgaguuacuuugucccagacgcacggucacgauguacauccgugcgacggugcagaugggcaggcgauugccaauccggaugccccagccacuucacaucuaacagcuucagcgacgacugggcagggaaaauggaccgcgccggacuaggguucagcggcugcagcgacggcugcggcggagcagccugcggaugcuucaaugcagccccaagcugcaucuucuggagaaaaugggucgaaaacccgcacgguaucauauggaaagucucacccugcgccgcaugggugcccucagccgucaucgagcucaccaugcccagcggcgaaguacgcacauuccacccaauguccggcauaccaacccaagucuucaagggggugagcgucacguaccugggcuccgacauggaagugagcggacucacagaucugugcgaaaucgaagaacuaaaauccaagaaacucgcgcucgccccgugcaaucaagcaggaaugggcgucguuggaaaaguuggagaaauccaaugcagcagcgaggaaagcgcaagaacgaucaaaaaggacggcugcaucuggaacgcggaccucgucgggaucgagcucaggguagacgacgcgguauguuacucaaagaucacauccguagaggcuguagccaauuacagugcaauccccacgacaaucggcggccuaagauucgaacgcucgcacgacagccaaggcaaaauuucgggaucaccccucgacauaacagcgaucagagguuccuuuucagucaacuacagaggccuacgucugagccugagcgaaauaaccgcgaccugcaccggcgaaguaacaaacgucucuggcuguuacuccugcaugaccggggccaaaguauccaucaaacuccauucaagcaaaaacucaaccgcccauguacgaugcaagggagacgaaaccgcauucucgguucuugagggagugcauagcuacaccgucagccugagcuucgaccacgcagugguagacgaacaaugccaacuaaauugcgggggccacgaaucacaaguuacacucaaaggaaaccugaucuuccucgacgucccgaaauucguggacggaucauacaugcaaacauaucacagcagcgucccgaccggcgccaacauuccgagccccaccgacuggcucaacgcacuauucggcaacggacuuucgagauggauacuuggaguaauagggguacucuugggcgggcucgcacucuucuuucucauaaugagucucuucaagcucggaaccaaacaaguauuucggagccguacgaagcucgcuuaa

SEQ ID NO: 16462 - RNA, 3222 nt, Artificial Sequence
  derived and/or modified CDS sequence (opt11) from SFTSV(ZJZHSH-YJX/China/06/2012)__KR017860.1__GP
augaugaaggucauuugguucagcagccuaauaugccucgucauacagugcaguggagacacgggaccaaucaucugcgcaggaccaauccacuccaacaaaucagcaaacaucccgcaccuauuaggguauuccgaaaagaucugccagauagacagacuaauacauguguccagcuggcugcgcaaccacucacaguuccaaggcuacguaggccaacgcggcggacggagccaagucucauacuaccccgcggaaaacagcuacagcagaugguccggacuccucucaccaugcgacgcagacuggcuagguaugcugguagugaaaaaggccaaaggcucagacaugaucguaccagggccgucauacaagggaaaaguguucuuugaacguccaacauucgacggguacgucggauggggcugugguucuggaaaaucacggacagagucaggugaacuaugcucaucagacagcggaacaucaagcggacuccuucccucagaucgaguacuauggauuggggacguagcuugccaaccaaugacgccaauccccgaagaaaccuuccuugaacuaaagagcuucagccagagcgaauuuccggacauauguaaaauugacggcaucgucuucaaccaaugcgaaagcgagagcuugccgcaacccuucgacgucgccuggauggacgucgggcacucgcacaagaucauaaugcgcgaacacaagacaaaauggguccaggaaucauccucaaaagacuuugucugcuacaaagaaggaacaggcccuugcuccgaauccgaggagaaaacguguaaaaccucgggaagcugucgaggggacaugcaauucugcaaaguagcggggugcgaacacggagaagaagccucagacgccaagugccgcugcuccuuaguacacaaaccgggugagguuguggucucauaugggggcaugcgaguccgccccaaaugcuacggauucucacguaugauggccacccucgaagucaacccgccugagcagaggaucggccagugcacaggaugccaccucgaaugcaucaacgggggcgugagacucaucacccucacgagugaauuaaggucagccacaguaugugcaagccacuucugcuccucagccacaagcgggaagaaaaguacggaaauacaauuccacucaggcucacucguuggcaagaccacaauacacgugaagggcgcgcuggucgacggcaccgaguucacguuugaaggauccugcauguucccagacgguugcgaugccguagacugcacuuuuugccgagaauuucuuaagaacccgcagugcuacccugcgaagaaauggcucuuuauaauaaucguaauccuacucggauacgcaggccugaugcuacucaccaacguacuuaaggcuaucggaguauggggcagcugggucauagcacccgucaagcucauguucgcgaucauaaagaaacucaugcgaucgguaucuugccuaaugggaaaacucauggacagaggccgacaaguaauacacgaggagaucggggaaaaccgagaaggaaaccaggacgaugucaggaucgaaauggcacgcccccgcagaguacgccacuggauguacuccccggucauccucaccauacuagcaauaggccuagcagaaggcugcgacgagaugguacacgcagacucgaagcuaguaucaugcaaacaagccagcgggaacaugaaagaaugcgugaccacaggacgagcacugcuaccagccguaaacccggggcaagaagcaugccugcacuuuaccgcgcccggauccccggacuccaaaugucucaagauuaaagucaagcgcauaaaucugaaaugcaagaaaagcaguagcuacuucguccucgacgcaaggagccgguguacgucggugagacgaugccgaugggcgggugacugccagagcggcugcccaagccacuuuacaucuaacucguucagcgacgacugggccggaaagauggacagagccggccucggauucuccggaugcagcgauggcugcggcggcgccgccugcggaugcuucaacgcggccccgagcugcaucuucuggcgcaaaugggucgagaacccgcacggcaucaucuggaaaguaucacccugcgccgcguggguacccuccgccguaauagagcuaacgaugcccucuggagagguacggaccuuccaccccaugaguggaauacccacccagguauucaaaggggucucggucacguaccucggaucagacauggagguaagcggccuaaccgaccugugugagaucgaagaauugaagucaaagaaacuagcccuagcgcccugcaaccaagccggaaugggggucguagguaaagucggggaaauccaauguagcagcgaggaaagcgcgcguacaauaaagaaagauggcugcauauggaacgccgaccuaguaggcauugaacuuagaguagacgacgcaguuugcuauuccaaaauaaccuccgucgaagcagucgccaacuacagcgccauaccaacgacaauaggcgggcuaagguucgaaagaagucacgacagccagggcaagauaagcggcagcccacucgacaucacagccaucagaggcucauucaguguaaauuaccgaggcuuacgcuuaagccugagcgaagucacggcaacaugcaccggcgaagucacaaacguaucagggugcuauucaugcaugacgggagcaaaagucagcaucaaacugcacucgagcaaaaauuccacagcacacguaagaugcaaaggggaugaaaccgccuucagcguucuagaagggguccacaguuacaccgugagccugucauucgaccaugcggucgucgacgaacagugccaacucaacugcgggggucaugagucccaagucacccuaaagggaaaccucauauuccucgacguaccaaaguucguugacggaucguacaugcaaaccuaccacucaucagucuuaaccggggcaaacauacccagcccuacggauuggcucaacgcacuguucggcaacggcuuaagcaaauggauccuaggcgucauuggaguccuccucggagggcucgcgcuuuucuucuuaaucaugagccuguucaaauuaggcacaaaacagauauuccgaucgagaacuaagcuagcauag

SEQ ID NO: 16463 - RNA, 3222 nt, Artificial Sequence
  derived and/or modified CDS sequence (opt11) from SFTSV(SPL003A)__AB817988.1__GP
augaugaaggugaucugguucuccucccucauauguuuagucauacaaugcagcggcgacacuggacccauaauaugugccggaccaauccacaguaacaaauccgcaaacauaccccaccuccucggguauagugagaaaaucugccaaauagaucgacuaauccacguauccucguggcuacgaaaccacucgcaauuccagggauacgugggucaacgaggcggccgaagccaaguaucguacuuccccgcagaaaacagcuacagcagauggucgggccuacuaagcccaugcgacgccgacuggcuaggcaugcugguggucaagaaagccaaagguucggacaugaucguacccggccccagcuacaaaggaaaagucuucuucgaaaggccaacguucgacggauacgugggauggggcugcggcagcgggaaaucccgcaccgaauccggugaacucugcagcagcgacaguggcaccaguaguggacuauuaccuucagacagaguacuguggaucggcgacgucgcgugccaacccaugacccccauccccgaagaaaccuuccucgaacuaaagagcuucagccagucagaguucccagacaucugcaaaauagacggaaucguauucaaccaaugcgaauccgaaucacuaccccaacccuucgacguggcauggauggacgugggacacagccauaaaaucaucaugagggaacauaaaacgaaauggguccaagaaagcaguucaaaggacuucguaugcuacaaagaaggaaccggccccuguuccgaaagcgaagagaaaacgugcaaaacauccggaagcugcagaggggacaugcaauucugcaagguggcaggaugcgaacacggagaggaagccucagaagcgaaauguaggugcucauuaguacauaaaccgggagaagucgucguaagcuacggcggaaugagggugcggcccaaaugcuacggcuucucgagaaugauggcaacucucgaagucaacucucccgagcaaaggaucggccaaugcaccgguugccaccuagaaugcauaaauggaggggugcgacugauaacguuaaccucagaacucaaaagcgcgaccgucugcgccagccacuucuguucaagugccacaagcggaaagaaaucaacagaaauacaauuucacuccggaucccucguaggaaaaacagcgauccaugucaaaggcgcacucgucgacgguaccgaguucaccuucgaaggcagcuguauguucccagacggcugcgacgcaguggacugcacauucugucgcgaguuccucaaaaacccgcaaugcuacccugccaagaaauggcuuuucauaaucauagucauccuccucggauacgccggacucauguuacucacaaacguacuaaaagcaauagggguauggggaagcugggucaucgcgccggucaaacuaauguucgcaaucaucaagaaacucaugagauccgucucgugccuaauggggaaacuaauggaucgggggcggcagguuauccaugaagaaauaggcgagaaccgcgaagggaaccaagacgacguaagaauagaaauggcacggccacgacgagucaggcacuggauguacuccccagugauucuaacgauccucgccauaggacuagccgaaggaugcgacgagaugguccacgcggacagcaaacugguuucaugcaaacagggaagcggcaauaugaaggaaugcguaacaacgggccgggcccugcuacccgcggucaacccaggacaagaagcaugccugcacuuuacagcaccaggaucccccgacagcaaaugccuaaaaaucaaagugaagcgaaucaaccuaaaaugcaaaaagagcagcuccuacuucguaccagacgcccguagccgaugcacgucagugagaagaugucgcugggcaggagacugccaauccgguugcccaagccauuuuacgagcaacucauucagcgacgacugggcugggaaaauggaccgcgcaggacuaggcuucagcggcugcagcgacggcugcggaggagcagccugcggcugcuucaacgcagccccaucuugcaucuucuggcgaaaauggguagaaaacccacacggaaucauuuggaaaguuucccccugcgccgccuggguccccucagccgucauugaacucaccaugccguccggagaagugcgcacguuccacccgaugagcggaaucccaacgcaagucuucaagggagucagcguaaccuaccuaggaagcgacauggaagugagcggacuaacggaccuaugcgagaucgaagaacugaaaucaaagaaacuagcgcuggcuccaugcaaucaagcgggaaugggcgucgucggcaaagucggcgagauacaaugcuccucagaagaaucagcacgaacaaucaagaaagauggcugcauauggaacgccgaccuagucggaaucgaauuaagggucgacgacgcggucugcuacagcaaaaucaccuccguagaggcagucgcgaacuacucagcaaucccgacuaccaucggaggacuaagguucgaaagaucgcacgacucacaaggcaaaauuucgggauccccgcuagacaucacagccauaagaggcagcuucucggugaacuaccgcggauuaagacucagccuuagcgaaaucacagcaaccugcaccggcgaaguuaccaacgucagcggaugcuacuccugcaugacaggagcacggguaagcauaaaacuacacucgagcaagaacucgacugcacacguaagaugcaagggggacgaaaccgcauucagcguuuuagaaggaguacacuccuacacaguuagucucuccuucgaccacgcagucguagacgagcagugccaacuuaauugcggaggccaugaaucacaagugacucuaaaaggaaaccuaauuuuccuagauguaccaaaguuuguagacggcucauacaugcaaacauaccacagcagcgucccaacuggcgcgaacauccccagcccgacagacuggcuaaacgcccucuucggaaacggccugucacgcuggauacugggcguaaucggaguucuccucggagggcuagcgcuuuucuucuugaucaugucccuuuuuaaacuuggcaccaagcaaguauuucgaucaaggacaaaguuagccuaa

SEQ ID NO: 16464 - RNA, 3222 nt, Artificial Sequence
  derived and/or modified CDS sequence (opt11) from SFTSV(SPL004A)__AB817989.1__GP
augaugaaagugaucugguucuccuccuuaauauguuuggucauacaaugcagcggcgacaccggcccgaucaucugcgcagguccgauccacagcaacaaaagcgcaaauauaccacaccuccuaggcuacagcgagaaaaucugccaaauagaccgacugauccacguauccucauggcuccgaaaucacagccaauuucaaggguacgugggacaacgaggcggaaggucgcaaguaaguuacuauccagcagagaacaguuacagccgcuggucuggguuacucagcccgugcgacgcggacuggcuagggaugcuaguugugaagaaagcgaaaggaucggacaugauaguucccggcccaucauacaaagggaaggucuucuucgagcgucccaccuuugacggauacgucggcuggggaugcggcucaggcaaauccaggacggaaagcggcgaacuauguagcuccgauagcggcaccaguucggggcuccuaccgagcgaccgcguacucuggauaggggacgucgcaugccaacccaugacaccaaucccggaagaaaccuuccucgaacuaaagagcuucagccagagcgaguucccggacauaugcaaaaucgacgggauagucuucaaucagugcgaaagcgaaagccugccacaaccauucgauguggccuggauggacgucggacacucccauaaaaucaucaugagggaacacaaaaccaaguggguccaagagagcagcagcaaagacuucguaugcuacaaagaaggaacagguccaugcagugaguccgaagagaaaacaugcaaaacaucaggauccugcaggggugacaugcaguucugcaaagucgcagggugugaacacggagaggaagccuccgaggcgaaaugucgcuguagccuaguacacaaacccggagagguaguaguaucauacggaggaaugagggugcgccccaaaugcuauggcuucagcagaaugauggcgacccucgaaguaaacccgccagagcaaaggauaggccaaugcacaggaugccaccucgagugcaucucaggggguguacgcuuaauaacuuuaacgucagaacuaaaaagcgccaccguaugcgcaucccauuucugcagcucagcgacaagugggaagaaaagcacagaaauccaauuccacaguggcagccuagugggcaaagcugccauccacgucaaaggcgcccucguggacggcaccgaguucacguucgaaggauccugcauguucccagacgggugugacgccguagauugcaccuucugccgggaauuucucaaaaacccacaaugcuacccugccaaaaaguggcuauucaucaucaucgucauccugcuaggcuaugcuggucucaugcuacucacaaacguccucaaagccauaggcguaugggggagcugggucauugccccagugaaacugauguuugcaaucaugaagaaacucaugcgaagcguaagcugccugauggggaaacuaauggacagaggacgccaggugauacacgaggaaauaggcgaaaaccgggaaggcaaccaagacgacguccggaucgaaauggcccgaccacggcgagugcggcacuggauguacagcccagucauccucaccauccucgcaauaggacuagcggaaggaugcgacgagauggugcacgccgacucgaagcucguaucaugcagacagggaagcggaaauaugaaagaaugcgucacaacuggcagggcucugcucccggcaguaaacccgggccaagaagccugccuccacuucacggcgcccgggagcccagacucgaaaugccucaagauaaaggucaaacgcaucaacuuaaaaugcaaaaagagcucgagcuacuucguaccagaugcaaggagcagauguacaagcgugcgccgaugccgaugggcaggggacugccaaagcgggugccccagccacuucaccucuaacaguuuuagcgaugacugggcaggaaaaauggaccgggcaggacugggguucagcggaugcuccgacggcuguggcggagcagcauguggauguuucaacgccgccccgagcugcaucuucuggcggaagugggucgaaaacccgcacggcauaauauggaaagugagccccugcgccgcguggguccccucggcgguuauagagcuaacaaugcccucgggagaaguacgcacauuccacccaauguccgguauacccacccaggucuucaaaggcgucucggugaccuaccuuggcagugacauggaggugagcggccucaccgaucuaugcgaaaucgaggaacucaaaagcaagaaacuagcucuagccccauguaaccaggcgggaaugggggucguaggaaaaguaggggaaauucaaugcucauccgaagagucugcacggaccauaaagaaagacgguugcauauggaacgcagaccuaguuggaauagaacucagagucgacgacgccgucuguuauagcaaaaucacaucgguagaagcugucgccaacuacucagccauacccacaaccauaggcgggcuaagauucgaacggucgcacgauucacaaggcaaaauuagcggcucucccuuggacauaacagccaucagaggcucauucuccgucaauuacagaggccuccgccugagccucuccgaaaucacagcaaccugcacgggggaagucaccaacguaagcggcugcuacagcugcaugacgggagccaaagucaguaucaaacuccacucaaguaaaaacuccacagcacacgugcgaugcaaagaagacgaaacggcauuuucaguccucgaaggcguccacagcuacacgguaagccucagcuucgaccacgcagucgucgacgaacaaugccagcuaaacugcggaggccacgaaagccacgugacacuaaaaggaaaccucaucuuuuuagauguccccaaauucguagacggguccuauaugcaaaccuaccacuccucaguaccgacaggagccaacauaccgagcccaacagacugguuaaacgcccuguucggaaacggacuaagccgauggauccucggagucaugggagugcuacuaggagggcuagcguuauuuuuccuuaucaugucccuauucaaacuagggacuaaacaaguguuuaggucucggaccaaacucgccuaa

SEQ ID NO: 16465 - RNA, 3222 nt, Artificial Sequence
  derived and/or modified CDS sequence (opt11) from SFTSV(SPL005A)__AB817990.1__GP
augaugaaagugaucugguuuaguagucuaauaugcuuaguaauacaaugcagcggagacgcaagcccaauaaucugcgcggguccgauucacagcaacaaauccgcaaacauuccacaccuacucggauacagcgagaaaauaugucaaaucgacaggcuaauacacguaagcucauggcugcgcaaccacucucaauuucaaggcuacguggggcagcgcggcggcagaagccagguuucguacuuccccgcagaaaacagcuacucaagguggagcggucuacugucacccugcgacgcagacuggcuagggaugcugguaguuaaaaaggcuaagggcagugacaugaucguccccggacccagcuacaaaggaaaaguauucuucgaacgccccacauucgacggguacgugggcuggggaugcggcuccggaaaaagccgaacagaaucuggggaacuaugcucgagcgacagcggaacaucaagcggacuccucccaucugaucgaguccuauggaucggagacgucgcaugccaaccgaugacaccaaucccagaggagaccuucuuagaauuaaagagcuuuagccagucagaguuccccgacaucuguaaaaucgacggaauaguuuucaaccagugcgaaagcgaaagccucccacagcccuuggacguggcauggauggaugucggccacucgcacaagaucauaaugagagaacacaaaacaaaauggguacaagaauccagcuccaaagauuucguaugcuacaaagaggguacgggcccaugcagugaauccgaagagaaaacaugcaagacuagcgggaguugcagaggagacaugcaguucuguaaaguagcgggcugcgagcacggagaagaggccucagaagcuaaaugccgcugcuccuugguccacaaaccaggagaggucgucgucucauacgggggaaugcgcguacgaccaaagugcuacggcuuuucccgcaugauggcgacccuggaaguaaacccauuggaacaaagaaucgggcaaugcacaggaugucaccucgaguguauaaacggagguguccgcuuaaucacacucaccagugaacugaaaucagcgaccgucugcgcgucccacuucuguucgucggcaacgagcggcaagaaaagcacagaaauucaauuucacuccggcucacuuguaggaaaaacagccauccauguuaaaggagcgcucgucgacgggaccgaauuuacauucgaaggcucaugcauguucccagacgggugcgacgccguggacugcaccuucugccgggaguuccucaaaaacccacaauguuacccagcaaagaaauggcuauucauaauaaucgucauccuacuaggauacgccggcuugaugcuacuaaccaauguccucaaagccauaggagucuggggaagcuggguaauagcccccgucaaacucauguucgccauaauaaagaaacucaugcgaagcgucucaugccuaaugggaaaauuaauggaccgcggcagacaaguaauacacgaagaaauaggggaaaacagggaagggaaccaagaugacgugaggaucgaaauggcgcgcccgcgcaggguucgacacuggauguacagcccggucauucucacgauccuggcaaucggacuugcagaggggugcgacgaaaugguacacgcagacagcaaauuggucagcugcaaacaagggggaggcaacaugaaagagugcgucacgacaggcagggcccuacucccggccgugaacccaggccaagaagcgugucugcacuucaccgcacccggauccccagauucgaaaugccucaaaauaaaaguuaaacguaucaaccucaaaugcaagaaaagcucaagcuacuuugucccggacgcacguagccgaugcacaagcgucagaaggugccgaugggccggcgacugccaauccgggugcccgucccacuucacaagcaacucauuuagcgacgacugggcagggaaaauggaccgagccggucucggauucucuggaugcucagauggaugcggcggcgccgcaugcggcugcuucaacgcggccccgaguuguauauucuggagaaaguggguagaaaacccacacggaaucaucuggaaggucucccccugcgcagcauggguaccaagcgccgugauagaacuaacaaugcccucaggagaaguuaggaccuuccacccaaugagcggaauacccacacaggucuucaagggcguauccguaacguacuuaggcucggacauggaagucagcgggcucacagaccugugcgaaaucgaggaacucaaaucuaagaaacucgcccuagcccccugcaaccaggcaggcaugggaguggugggaaaagugggggagauccaaugcuccuccgaagaaagcgcaaggacaaucaagaaagacggcugcauauggaacgcugaccucgucgguauagaacugagaguggacgacgcagucugcuacucgaaaauaaccuccguagaagccguggcaaacuacucagccauacccacgacaauaggcgggcuucgcuucgaacgaucccacgacagccaaggcaaaaucucaggcaguccccuagacaucaccgcaauaagaggcuccuucucagucaacuacaggggcuuacgccuuucauugagcgaaauaacggcuaccugcacgggcgaggucacaaacguaagcggcugcuacucaugcaugacaggagcaaaaguaucgaucaaacuacacucauccaaaaacuccaccgcacacgugcgcuguaagggggacgagaccgcguucucgguccuagaaggaguccauagcuacaccguaagccucagcuuugaccacgccgugguagacgagcaaugccagcuaaacugcgggggccacgaaucacaaguuacccucaagggaaaccucauauuuuuagauguccccaaauucgucgacggaaguuacaugcaaacguaccacagcucuguaccaaccggggccaacaucccaagcccgaccgacuggcucaaugcgcuguucgguaacggacuaagccgauggauccucggaguaaucggaguucucuugggcggacucgcacucuuuuuccucauaaugucccucuucaaacucggaacuaaacaagucuuuaggagcaggacgaaacuugccuga

SEQ ID NO: 16466 - RNA, 3222 nt, Artificial Sequence
  derived and/or modified CDS sequence (opt11) from SFTSV(SPL010A)__AB817991.1__GP
augaugaaagucaucugguucagcagccucaucugcuuaguaauacagugcucgggagacacuggacccaucauaugcgcagguccaauccauucaaacaaaagcgccaacauuccccacuuacucggguacucagagaaaauuugccagaucgaccggcucauacacguauccagcuggcuacgaaaccacagucaauuccaaggcuacgucggacagcgaggaggccgaagccaaguaaguuacuucccagcagaaaacagcuacagcagauggucaggacuccugagccccugcgaugcagacuggcucggaaugcuaguaguaaagaaagccaaagggucagacaugauaguacccgggccaagcuacaagggcaagguauucuucgaacgacccaccuucgacggauacgucggcuggggaugcgggagcggcaaaagcaggacugagagcggagagcuaugcuccagcgacagcgggaccagcagcggccuccuaccgucggacaggguccuauggaucggcgacgucgcaugucaaccuaugaccccaauacccgaagaaacuuuccuggagcucaagaguuuuucacaguccgaguucccagauaucuguaaaaucgacggcaucguguucaaccaaugcgaauccgaaucacuaccacagcccuucgacguggcauggauggacgucggacacagccacaaaaucauaaugagggaacacaaaaccaaaugggugcaagaaucaagcuccaaagacuucgucugcuacaaagagggcacagguccgugcagcgagagugaagagaaaacgugcaagaccucagguaguugccgcggggauaugcaguucugcaaaguggcaggaugcgaacacggugaagaggccucagaagcaaaaugccgcugcucccuuguacacaaaccgggcgaaguaguggucuccuacggcggcaugcgcguacgccccaaaugcuacggauucuccaggaugauggcaacccuggaagugaacagcccagaacagcgaaucgggcaaugcacgggcugccaucucgaaugcaucaacggagguguccgccucaucacgcucacgagcgaacuaaagagugcaacagucugcgccucacauuucugcagcagcgccaccagcggaaagaaauccacagaaauccaguuccacucgggcagccuagugggaaaaacggcgauccacguaaaaggagcguuaguagacgggaccgaguucacuuucgagggcucaugcauguucccagacggcugcgacgccguagacuguacuuucugccgcgaguuccucaaaaauccgcaauguuacccggcuaagaaguggcuauucaucauaauaguaauccuacuaggcuacgcgggacuaaugcuacucacaaacguccuaaaagccaucggcguauggggaagcuggguaauagcgccgguaaaacuaauguucgccauaauuaagaaacuaaugcgcucggucucaugcuugauggggaaacugauggacaggggccgccaagucauacacgaggaaaucggugagaaccgcgaaggcaaccaagacgacgucaggaucgagauggcacgaccccgaagggucagacacuggauguacagccccgucauccucacaauccuagcuauuggacuggcagaagguugugacgaaaugguacacgcggauucuaagcugguaagcugcaaacaagggagugggaacaugaaagaaugcguuaccacaggccgagcgcuacuacccgcaguaaacccuggccaggaagcaugccuccacuucacugcgcccggaucaccggacaguaaaugcuugaaaaucaaagucaaacgcauaaaucuaaaaugcaaaaagaguuccagcuauuucgugccagaugcccgaagccggugcaccuccguccgaagauguaggugggcgggagacugccaaagcgguugcccaagccacuucaccagcaacagcuucuccgacgacugggcgggaaaaauggacagagcggggcuaggguucuccggcugcuccgaugguugcggcggagccgcaugcggaugcuucaacgcagcgccaagcugcaucuucuggagaaagugggucgagaacccgcacggaaucaucuggaaagucucaccaugcgccgcauggguaccaucugccgucauugaacucacgaugccuaguggagagguacgcaccuuccauccaaugagcgguaucccuacccaagucuucaaaggcguauccgugacguaccugggcagcgacauggaaguaucgggucuaacugaccugugcgaaauagaagaacugaaaagcaagaaacuagcccuggcaccgugcaaccaagccggaaugggggucguaggcaaaguaggcgaaauacaaugcuccagcgaagagagcgcucgaaccaucaagaaagacggcugcauauggaacgcggaccucgucggcauugagcuaaggguagacgacgcagucugcuacuccaaaauaacuucagucgaagcaguggcgaauuacagcgcaauacccacaacaauaggagggcugagauucgagcgcucacacgacagccaagggaaaauaucgggaucgccacuagacaucaccaccauucgaggauccuucucuguuaacuauagaggguugcgcuugagccucagcgaaauaacagcaaccugcacgggcgaaguaacaaacgugagcggaugcuacucuugcaugacgggcgccagaguuagcauaaaacuacacucaaguaaaaacagcaccgcccacguacgaugcaaaggcgacgagacagccuucagcguccucgaaggaguccacucauacaccgucucauuaucauucgaccaugccguaguagacgagcagugccaacucaacugcgggggccacgaaucacaaguaacccucaagggcaacuugauauuccucgacguuccaaaguucguagacgguagcuacaugcaaacauaccauagcagcgugccaaccggggccaacaucccaucacccaccgacugguuaaacgcccucuucgggaacggccucaguagauggauacucggcgucauaggaguccuacucggagggcucgcguuauucuuccuaaucaugucccuguucaagcuaggaacgaagcaaguauuccgaagcaggaccaaacucgccuga

SEQ ID NO: 16467 - RNA, 3222 nt, Artificial Sequence
  derived and/or modified CDS sequence (opt11) from SFTSV(SPL030A)__AB817992.1__GP
augaugaagguaauaugguucagcucccucaucugccuaguaauccaaugcagcggggauacgagccccaucauaugcgcaggacccauacacagcaauaagagcgcaagcauuccacaucugcucggguacuccgagaaaaucugccaaaucgacaggcucauacacgucagcagcuggcuacggaaccauucacaguuccaaggauacguaggccaacgcggagggaggagccaggucuccuacuucccagccgaaaacagcuacagcagauggucgggacuacucucaccgugcgacgccgacuggcuaggaauguuaguagucaagaaagccaaaggcagcgacaugauaguucccggccccuccuacaaaggcaaagucuucuucgaacgcccgaccuucgacggauacguuggauggggcugcggaagcggaaaguccagaacggagucaggggaacucugcagcucagauaguggcaccagcagcgggcuacuacccagcgaccgcguccucuggauaggagacguagcgugccaacccaugacuccaauccccgaagagacguuucucgagcugaaaucauuuagccagucagaguuccccgacauaugcaaaauugacggcaucguguuuaaccaaugcgaaagcgaaucccuaccucaaccauuggacguagcauggauggacguaggacacucacacaaaauaauuaugcgagaacacaagaccaaguggguccaggaaagcucaucaaaagacuucguaugcuacaaggagggaaccggcccguguucggagagcgaagagaaaacgugcaaaacuucaggcucgugccgcggcgacaugcaguucugcaaaguggcaggcugcgaacacggggaagaggccucagaagcaaaaugccgaugcucccugguccacaaacccggcgaaguaguaguaagcuacggaggcaugagaguccgcccaaaaugcuacggauucucgagaaugauggcaacacuagagguaaaucccccggaacuaagaaucggacaaugcacaggcugucaccuagaaugcaucaacgguggaguacgacucaucacacucacauccgaacuuaaaagcgcgacagugugcgcgucacacuucuguagcuccgcaaccagcgggaaaaagaguaccgaaauccaauuccacagcgggucacucgucgggaagacagcaauacaugugaaaggcgcucuaguugacggaaccgaguuuacguucgaaggaaguugcauguuccccgauggaugcgacgcgguggacugcacuuucugcagggaguuccuuaaaaacccgcagugcuauccggccaagaaauggcuguucauuauaaucgugauauuacuaggauacgcaggccugaugcuccucacaaacguacucaaagcaauagggguauggggaagcugggucauagcgccagugaaacuaauguucgcgaucaucaaaaagcuaaugagaagcgucuccugcuugaugggaaaacugauggaccgagggagacaaguaauccacgaagaaauaggugaaaaccgcgaaggcaaccaagacgauguccgcauagaaauggcacgcccaaggagaguccgccacuggauguacagcccggucauccuaaccauacuagccaucgggcucgccgaaggcugugaugaaaugguccacgcagacuccaaacucguaagcugcaagcaaggaggaggaaacaugaaagaaugcgucaccacaggacgggcccuauuaccggccgucaacccaggucaggaagccugccuacauuucacugcaccagggagcccagacucaaaaugccuaaaaauacgcgucaaacgaauaaaucuaaaaugcaagaaaucuagcagcuauuucguacccgacgcgcgcagccgaugcacgagcgucagaaggugcagaugggcgggcgacugccaaucaggcugccccagccacuucacaagcaacagcuucucagacgacugggcugggaaaauggacagagcagggcuaggguucagcgggugcagcgauggaugcggaggagccgccugcgguugcuucaacgccgcacccagcugcaucuuuuggcgaaaauggguagaaaacccacacggaaucaucuggaaaguaucgccaugcgcagcaugggugcccagcgcagugaucgaacuaacaaugccguccggagaggugagaacauuccaccccaugagcggaauaccaacccagguauucaagggcgucuccgugaccuaccucggauccgacauggagguaucggggcuaacggaccucugcgagauagaagaacuaaagaguaaaaaguuagcgcuugcuccgugcaaccaagcgggcauggguguagugggcaaagucggagagauacaaugcaacagugaagaguccgcccgaacgaucaagaaagacggcugcaucuggaacgcggaccuugucgggauagaacucagaguggaugacgcggugugcuacagcaaaaucaccucggucgaagcagucgccaacuacagcgcaaucccaacaacaauaggcggccuucgguuugaacggucccaugacucccaggggaaaaucaguggaucaccccuggacauaacagccaucaggggcucauucucggucaacuacagaggccuucgucugucccuaagugaaaucacagcgaccugcaccggcgaaguaacgaacguaagcgggugcuacagcugcaugaccggagcaaaagucagcauaaaacuccacucaagcaaaaacagcacagcccacgucagaugcaaaggagacgaaaccgccuucucgguacuggaaggcguccacagcuacaccguaucccucuccuucgaccacgcaguaguagaugaacagugccaacugaacugcggcggccacgagucccaaguaacucucaaaggcaaccugaucuuccucgacguaccaaaauucguagacggcucguauaugcaaacauaccacagcagcguaccgacuggagcaaacauccccagccccaccgacuggcucaacgcgcucuuuggcaacggacugagucgauggauacucggcguaauuggaguacuccuaggaggacucgcacuauucuuccuaaucaugucccuauuuaaauuaggcacgaagcaaguguuccgcucgcgcaccaaguuagcguga

SEQ ID NO: 16468 - RNA, 3222 nt, Artificial Sequence
  derived and/or modified CDS sequence (opt11) from SFTSV(SPL053A)__AB985292.1__GP
augaugaagguuauaugguucagcucacuaauaugccugguaauccaaugcagcggagauacagggccgaucauaugcgcaggaccgauccacuccaacaaaggggcuaacauaccacaucugcuaggauacuccgaaaagaucugccaaauagacagacuuauccacgucucgucguggcuaagaaaccacagucaauuccagggauacgugggccaacgcggcggccgaagucaagucagcuacuuccccgcggagaauaguuacucaagauggagcggacuacuaucaccaugcgacgcugacuggcugggaaugcuagucgucaaaaaggccaaaggcucagacaugaucguuccaggccccucuuacaaagggaaagucuucuucgagcgcccaacauucgacggcuacgucgguuggggauguggcucaggcaagagccgcacugagagcggggaacuaugcaucagcgacuccgggaccuccagcggccuacuccccuccgacagaguccucuggauaggggacgucgccugccaacccaugacaccaauacccgaggaaacguuccuagagcuaaagagcuuuagccaaagcgaguucccagacauaugcaaaauagacgggaucguauucaaccagugcgaaagcgagagcuugccccagccauuugauguagcauggauggacgucgggcacagccacaaaauaaucaugcgagaacacaaaaccaaauggguacaggaaagcucaucgaaagacuucguaugcuauaaagagggaacaggaccgugcuccgaaucagaagagaaaaccugcaaaacgagcggcagcugccgcggggacaugcaauucugcaagguagcaggcugcgaacacggggaagaagcgagcgaagccaagugccgguguagucucguucacaaaccuggggaagucguggucagcuacggagguaugagaguucgcccaaaaugcuaugguuucucgcgaaugauggcaacccucgaagucaacucgccagaacaaagaauaggacaaugcaccgggugccaccucgagugcauaaacgggggagugcgccucaucacgcucacauccgagcucaagucagcaaccgugugcgcaagccacuuuugcuccagugcaacaagcggaaagaaaagcacugagauacaauuccacucaggaagccuagucggaaaaacggccauccacgucaagggcgcgcuugucgacggaacugaguucacguuugaaggcucgugcauguucccggauggaugugacgccguggacugcacauucugccgagaguuccucaagaacccccaaugcuaccccgccaagaaauggcuguucauaauaauagucauacuccuaggguacgcgggacucauguuguuaacaaacguucucaaggcuaucggcgucuggggcagcuggguuaucgccccggugaagcucauguucgcgauaauaaagaaacucaugcgcucagucucgugccuuaugggaaaauugauggaccguggacgccaagucauacacgaagaaauaggcgaaaaccgcgaaggcaaccaagacgacguacggauagaaauggccagaccccgacgggugcgccacuggauguacagcccggucauacucacaauccuagcaauaggccucgccgaagguugcgaugagauggugcacgcagacagcaaacugguaagcugcaaacaaggguccgggaacaugaaagaaugcgugacaacaggcagagcucuacugccggccgugaacccaggucaggaagcaugccuacacuucaccgcccccggcucacccgacuccaaaugccuaaaaaucaaaguuaagcgaaucaaccugaaaugcaagaaaucgucaagcuacuuuguacccgacgcaagauccaggugcacaucagugcgccggugccggugggccggcgauugccaaucagguugccccagccacuucaccuccaacagcuucuccgaugacugggccggaaaaauggaccgggccggacuaggauucucgggaugcucggacgguugcggaggggcagcaugcggaugcuuuaacgcggccccgaguugcaucuucuggaggaaauggguagaaaacccgcacggaaucauauggaaaguauccccaugugccgcauggguaccaucugccgugaucgagcuaaccaugcccuccggagaaguacgaacauuccacccgauguccggcaucccgacccaggucuuuaaaggggucucagucaccuaccuaggaucggacauggaagugaguggccucacagaccuaugcgaaaucgaggaacuaaaaucaaagaaacucgcucuagcgccaugcaaccaggcuggcaugggaguagucgggaaaguaggagagauccaaugcagcagcgaggagagcgcgcgcacuauaaagaaagacggaugcaucuggaacgcagaccuggucggaaucgagcuacgagucgacgacgcggucugcuacucgaaaauaaccucuguagaagccgucgcaaacuacucggcaauaccgaccacaaucggcggccugcgauucgaacgaucgcaugacucccaaggaaaaaucucuggaucgcccuuagauaucacagcgaucagaggaucauucagcgucaacuacagaggccuacgccucagccugucagagauuacggcaacuugcacgggagaaguaacuaacguaagcggaugcuacagcugcaugacaggcgcacgcguguccaucaaacugcacucguccaaaaacuccacagcacacguucgcugcaaaggggaugagaccgcguucucaguacuggaagggguccacuccuacaccgugaguuuguccuucgaccacgcagugguagacgaacagugucaacuaaacugcggaggccacgaaucacaaguuacccuaaagggaaaccugaucuuccuugauguacccaaauucguagacggcuccuacaugcaaacguaccauagcuccguaccgacaggggccaacauaccaagcccgaccgacuggcuaaacgcgcuauucgguaacgguuugaguagguggauacucggagucauaggaguacuacucggaggccuggcccucuucuuccuaauaaugagccuauucaaguuaggcacaaagcaagucuuccgaagcagaacaaagcuagcauaa

SEQ ID NO: 16469 - RNA, 3222 nt, Artificial Sequence
  derived and/or modified CDS sequence (opt11) from SFTSV(SPL054A)__AB985293.1__GP
augaugaaagucaucugguucagcucccuaaucugccuaguaauacagugcagcggugacacaggccccaucaucugcgcaggcccuauacacuccaacaaaagugcaaacauaccucaccuacucggauacuccgaaaagaucugccaaauagauagacucauccauguguccagcugguugaggaaccauagccaauuccagggauaugucggucaacgcgguggaagaagccaaguguccuacuucccggcugaaaacagcuauuccagaugguccgggcugcuguccccaugcgacgcagacuggcucggaaugcucguugucaaaaaggcaaagggcagugacaugauaguacccggaccaucauacaaaggaaaagucuucuucgaacgacccacauucgacggauacguaggcugggggugcggcucaggcaaaagcagaaccgagaguggagaacuaugcucguccgacagcgggaccagcuccggauuauuaccaucagacagaguccuauggauaggagacgucgccugccaaccaaugacaccuauaccggaagagacauucauggaacuaaaaucauucagccaauccgaguucccagacauauguaaaaucgacggcaucguauucaaccaaugcgaauccgaaucauuaccacaaccauucgacgucgcauggauggacgucggccacucacacaaaaucauaaugcgggaacacaaaacuaaauggguccaagaaucaucauccaaagacuucguaugcuacaaagaaggaacgggccccugcagcgaaagcgaagaaaagaccugcaaaaccucgggcagcugcagaggcgacaugcaauuuugcaaagucgcggggugugagcacggagaagaagccuccgaagcgaaaugcagauguucacucguacacaagcccggcgaaguaguaguaucguacggcggaaugcggguccgcccgaaaugcuacggcuucucccgcaugauggccacccucgaagugaacccacccgaacaacgaaucggacaaugcaccggaugccaccuagaaugcauaaacggcggcguacgccuaauaacucucacaagugaacuuaaguccgccacggugugcgccagccacuucugcuccagcgcuacaagcggaaagaaaagcaccgaaauccaauuccacucgggcagccuggucggaaaaaccgcaauccacguaaaaggagcccucguggaugggaccgaguucacauucgaaggguccugcauguucccggacgggugcgacgccgucgauugcaccuuuuguagagaauuucucaaaaacccacagugcuaccccgcaaagaaauggcuauucaucauaauagugauacuccuaggguacgcuggccuaaugcuauuaacaaauguccucaaagccaucggcguauggggaagcuggguaauugcgccaguaaaacuaauguucgccaucaucaagaaacucaugcgguccguguccugccuaaugggaaaacucauggaccgugggcgacaagucauccacgaagaaauaggcgaaaacggagaaggcaaccaagacgacguccguaucgaaauagcccgaccacgccgggugcgccauuggauguacuccccagugauccuaacgauacuggcaaucggccuagcugagggcugcgacgaaaugguccaugcagacagcaaacuugucaguugcaaacaggguucagggaacaugaaagagugcguaaccacagggagagcucuacuaccagccguuaacccaggacaagaagcaugccuacacuucacugcgcccggauccccagauucaaaaugccucaaaaucaaagucaaacggaucaaccucaaaugcaaaaagagcucgucauauuucguaccggacgcaaggagcagaugcacguccguaaggcgaugccggugggccggagacugccaaagcggaugccccagccacuucaccuccaacucauucucagacgacugggcgggcaagauggaucgcgcaggacucggguuuuccgggugcagcgacggcugcggaggcgcagcaugcggcugcuucaacgcagcccccagcugcaucuucuggagaaaauggguagaaaacccccacggcauaaucuggaaggucucccccugcgccgcguggguuccuagcgccgugauagagcucaccaugccauccggcgaggugcgcacguuccaccccauguccgggauccccacccaaguauuuaaaggaguaagugucacauaccuaggcucagacauggaggucucuggucuaacagaccucugcgagauagaggaacuaaaaucgaagaaacucgcacucgcgcccugcaaccaggccgggaugggcguagucggcaaagucggagagauccaaugcaguucagaagaaagcgcgcgcaccaucaagaaagacggaugcauuuggaacgcggaccuagugggcaucgaacucagaguggacgacgccgugugcuacagcaaaaucacaucuguagaagccgucgcaaauuacuccgcaauccccaccaccaucggagggcuccgauucgagcgaucacaugacucacaaggcaagauaucaggcuccccacuagacaucacagcaaucagaggauccuucuccgugaacuacagaggacuacgccuaagccucucagaaaucacagcgacgugcacaggcgaaguaaccaaugucagcggcugcuacagcugcaugaccggagcgaaaguauccaucaaauuacacucaucaaagaacuccacagcacacguacggugcaaaggagacgaaacggccuucagcgugcuagaagggguucacuccuacaccgucagccucagcuucgaccacgcagugguagacgaacaaugccaacuaaacugcggcgggcacgagucccaaguaacccuaaagggaaaccuuaucuuccuagacguaccacgcuucguagauggcucauacaugcaaaccuaccacucguccgugccgaccggagccaacauaccuucaccgacagauuggcucaacgcguuauuuggaaacgggcugucccgcuggauacucggcguaauaggagugcuacugggcggacucgcacucuucuucuuaauaaugagccucuucaaacucggcacaaaacaaguauucagaagcagaaccaaacuggcauaa

SEQ ID NO: 16470 - RNA, 3222 nt, Artificial Sequence
  derived and/or modified CDS sequence (opt11) from SFTSV(SPL055A)__AB985294.1__GP
augaugaaggucaucugguucuccagccuaaucugccucgugauacaaugcaguggcgacaccggaccaauaauuugcgcaggaccgauccacagcaacaaauccgccaacauaccucaucugcuuggauacucggagaaaauuugccaaaucgacagacuaauccaugugagcuccuggcuccggaaccacagccaauuccaaggguacgucggccaacgaggcggccgcucccaagucagcuacuuucccgcagaaaacagcuacucaagguggucaggucuacucucuccgugcgacgccgacuggcuuggaauguuaguaguaaagaaagcaaaaggcucagacaugaucgugccaggcccgucauacaaaggaaaaguguucuucgaaagacccacauucgauggcuacgugggguggggaugcggcucaggcaagucuagaacagaaagcggagaacucugcucauccgauuccgggaccucgagcggacuccuacccuccgaccgaguccuauggauaggcgacgucgcgugccagccaaugacaccgauaccagaagaaacauuccuagaacucaagagcuucucucaaagcgaguucccagacauuugcaaaaucgacggaauaguguuuaaccaaugcgaaagcgaaagccugccacaaccuuucgacgucgccuggauggauguuggacacucccauaaaaucauaaugagagaacacaaaacaaaauggguacaagaaucaucgagcaaagacuucgucugcuacaaagaaggaacaggcccauguucagaaagcgaagagaaaaccugcaagacgagcggauccugccgcggcgacaugcaguuuuguaaagucgcagguugcgaacacggcgaagaagcguccgaagcaaagugucgcugcucccugguacacaaacccggcgaagucguggucucguacggcggaaugagaguuagacccaaaugcuacggcuucagccgcaugauggccacccuggaaguuaacagcccagaacaaagaauaggacaaugcaccggcugccaccuagaaugcauaaacgguggcgucagguuaaucacccuuacaucagagcucaagagcgcgaccguaugcgccucccauuucugcagcagcgccacauccgggaagaaauccaccgaaauucaauuccacucagggagucuugugggcaaaacggcaauacacguaaaaggggcccuaguagacgguacagaauuuaccuucgaaggcucgugcauguucccggacggcugcgacgcaguggacugcacauucugccgcgaguuccucaaaaauccgcaaugcuaccccgcaaagaaguggcuauucaucaucaucguaauccuccucggauacgcuggacucaugcuacucacaaacguacuaaaggcaauaggagucuggggcagcugggucauagcaccagucaagcucauguucgcaauaaucaagaaacuaaugcgauccguaaguugccugaugggaaaacucauggaccgcggccgccaagucauacacgaagaaaucggcgaaaacagagaagggaaccaggacgacguacgcaucgaagucgcccgaccaagaagagucaggcauuggauguauucgccggucauccuaacaauauuagcaaucggacuagccgaagguugcgacgagaugguacacgcagacucaaagcuaguaagcugcaaacaaggauccggaaauaugaaagaaugcgucacaaccggccgagcauuacucccagcagugaacccaggacaggaggcgugccuucacuucaccgcccccggaucacccgacagcaagugccucaaaauaaaaguaaagcguaucaaccuaaagugcaagaaaucaucaaguuacuucgugccagacgcaagaucccgcuguacgucggugagacgcugcagaugggccggggacugucaaucaggaugcccaagccacuuuacaagcaacagcuucucugacgacugggccggcaaaauggacagagcaggauuaggauucucgggaugcucagacggcuguggcggcgccgccugcggaugcuucaacgcagccccaucguguauauucuggcgaaagugggucgaaaacccacacggcaucauauggaaaguuagcccaugcgcugcauggguaccaucagccguaaucgagcuaacaaugcccagcggggaaguacgaaccuuccacccgaugucaggaauccccacacaaguuuucaaaggagucucagucacguaucuaggcucagacauggaggucucaggccuaacagaccucugcgaaaucgaggaacugaaaucaaagaaacuagcacuugcacccugcaaucaagcaggaaugggcgucgucggcaaagucggagagauccaaugcuccagugaagaauccgcucgcacgaucaaaaaggacggaugcauauggaacgccgaccuggucggcaucgaacugagaguagaugacgccgucuguuauucaaagaucacaagcguagaggcaguagccaacuacagcgccauuccaacgaccauaggagggcuccgauucgagcgaucacacgacagccaagguaaaauauccggcucuccccuggacaucacagcgauccgggguuccuucagcguaaacuaccgaggacugcgacucagcuuaucagagauaacagccacaugcacgggagaggucacgaacgugucgggguguuacagcugcaugacaggagcccgcgucucaaucaagcuacacaguuccaaaaacucgaccgcccacguaagaugcaagggagacgaaacggccuucagcguucucgaaggcguccacucauacaccgugucacuaucuuuugaccaugcaguggucgaugaacaaugucagcuuaacugcggcggccacgagagccagguaacgcuaaaagggaaccucauauuuuuagacguuccaaaguucguagacggcucauacaugcaaaccuaccacucgucgguaccaacaggcgccaacauccccagcccaacagacuggcucaacgcccuauucggaaacggacucagccgauggauccucggcguuauaggaguacuccucggcgggcucgcccuauucuuccuaaucaugagccuauucaaacuagguaccaaacaaguauuccgcucccgcacaaaacuggccuaa

SEQ ID NO: 16471 - RNA, 3222 nt, Artificial Sequence
  derived and/or modified CDS sequence (opt11) from SFTSV(SPL057A)__AB985295.1__GP
augaugaaagucauuugguucagcucacugauaugcuuaguuauacaauguuccggagacacgggaccgaucauaugcgcaggcccaauacacagcaacaaaagcgccgacauaccacaucuacucggguacagcgagaaaaucugccaaauagacaggcucauccacgugagcagcuggcuccgcaaucacagccaauuccaaggcuacguaggucaaaggggaggcagaagccaggugucuuacuaccccgcagaaaacuccuauagcagauggagcggccuccuaucacccugcgacgcggacuggcugggaaugcuugucgugaagaaagccaaagggucagacaugaucguaccagggccuuccuacaaaggaaaaguauucuucgaacgaccgacauucgacggcuacgucggauggggcugcggaagcggcaagagccggacagaaagcggcgaacuaugcucaagcgacagcggaaccucaaguggccuccucccauccgauagggucuuauggauaggagacguagcgugccagccuaugaccccuaucccugaagaaacauuccucgaguuaaagagcuuuagccaguccgaguucccagacauaugccgaauagacggcauaguguuuaaccaaugcgaaagugaaagccuaccacagccauucgacgucgccuggauggacgucggccacagccauaaaauaauaaugagggaacacaaaacaaaauggguccaagaauccagcucgaaagacuucgucugcuacaaagagggcaccgggccgugcucagaaucugaagaaaagacaugcaagaccagcgguagcugcaggggagacaugcaguucugcaaagucgccgggugcgaacacggggaagaggccagugaagcaaaaugcagaugcucgcugguccauaaaccaggagaggucguagucucguauggcggcaugaggguccgaccaaaaugcuacggauucuccagaaugauggcgacccuagaagucaacccacccgagcaaaggauuggccaaugcaccgguugccaccuggaaugcgucaacggaggcgugcgcuuaauaacacugacgagcgagcucaaaucggcuacaguaugcgcuucccacuucugcagcuccgcaauaucagggaagaaaucaaccgaaauacaauuccacuccggaagccucguaggcaaaaccgccauccacgucaagggagccuuaguagacgggaccgaauuuacauuugaaggaucaugcauguucccagacgggugcgacgcagucgauugcacauucugucgcgaguuccugaaaaauccacaaugcuacccagccaagaaauggcuauuuaucaucaucgugauccuccuuggauacgcggggcuuaugcuccucacgaacgugcucaaggccauuggcgucuggggaucaugggucauagcaccgguaaagcuaauguucgccaucaugaagaaacuuaugagaagcgucagcugccuaauggggaagcugauggaccggggcagacaagugauacaugaggagaucggcgagaacagagaaggaaaccaagacgauguucggaucgagauggcacgaccgcggcgcgucagacacuggauguacagcccggucauacuaaccauccuagcagugggccuggccgagggaugcgacgaaaugguacacgcagacucaaaacuggucuccugcaaacaaggaucaggaaacaugaaagagugcgucacaacgggccgagcccugcugccggcaguaaacccaggacaggaggcuugccuucacuuuaccgcacccggaucaccagacuccaaaugccuuaaaaucaaagucaagaagauaaacuugaaaugcaagaaguccucaagcuacuucguaccagacgcaagaagccgauguacaagcguacgaaggugcagaugggccggcgacugccaaagcgggugccccagccauuucacaaguaacagcuuuucagacgacugggccggaaaaauggacagagccggccucggguucucgggaugcagcgacgggugcggcggagcugcgugcgggugcuucaaugcugccccaaguugcauuuucuggcguaaauggguagaaaacccgcacgggauaauauggaagguuaguccuugugccgcauggguacccucggcagugauagagcuaacgaugccaagcggggagguucgcacauuccacccaaugucagguauaccaacgcaaguauucaagggagucuccguaacauaccuaggcuccgacauggaagucagcggacuuacggacuuaugcgagauugaagaacuaaaaucaaagaaacucgcgcuagcacccugcaaccaggccggaaugggcgucgugggcaaaguuggagaaauucaaugcuccagcgaagaaagcgcccgaacgauuaaaaaggacgggugcaucuggaacgcggacuuagugggcaucgaacucagaguggacgacgccgucugcuacucaaaaaucacgagcguggaagcaguagccaacuauucagcaauacccacaaccauaggaggcuuacgauuugaacgaucacaugacagccagggcaagauaucaggcucaccgcuagacaucaccgcgauaagagggagcuucucggucaauuacagaggauuacgccuaagccuaagcgagaucacagcgacaugcacaggagaagucacgaacguuucgggaugcuauuccugcaugacaggcgcuaaaguaaguauaaagcuccacucgaacaagaacaguaccgcgcacguccgcugcaaaggcgacgagaccgcguucucaguacuggagggcgugcacaguuacaccguuagccucaguuucgaccaugcagugguagacgaacaaugccagcugaacuguggaggccacgaaucacaagugacccugaaggggaacuuaauauuccuagacguaccaaaauucguagacggcuccuacaugcaaacguaccacagcucgguacccaccggagccaacauaccaagcccaaccgauuggcuuaacgcucucuuuggcaacggucuaucgcgguggauccuaggcguuauaggcguauuauuaggaggacuagcacuauucuuccuaauaaugucacuauucaaacuagggaccaaacaaguguucagaagcagaacaaagcuggcauga

SEQ ID NO: 16472 - RNA, 3222 nt, Artificial Sequence
  derived and/or modified CDS sequence (opt11) from SFTSV(SPL062A)__AB985297.1__GP
augaugaaagugauaugguucagcucacuaauaugcuuaguuauacgaugcagcggcggaaccggacccaucauaugcgccggcccgauacacucgaacaagucagcaaacaucccccaccuucucggcuacagcgaaaagaucugccaaauugaccgacucauacacguaagcucauggcuacgcaaucacucgcaguuccaaggauacgugggccaaaggggaggaaggagccaagucagcuacuuccccgccgaaaacucuuauaguagaugguccgggcuacuaucucccugugacgccgacuggcucgguauguuaguagucaaaaaggccagaggaucagacaugauaguacccggccccuccuacaaaggaaaaguauuuuucgagagaccaacauucgacggcuacguaggcuggggaugcggauccggaaagucucgaaccgaaagcggagaacuaugcucuagugacagcggaaccuccagcgggcuacuccccuccgacagaguacuauggaucggcgacguagcgugccaaccgaugacgccgaucccggaagaaaccuuccuagagcuaaaauccuuuucacaaagcgaguuccccgacauuugcaagauagacggcauagucuucaaccaaugcgaaagcgaaucacuaccccaaccauuugacgucgccuggauggaugucggacacucacacaaaaucauaaugagagaacauaagacaaaauggguccaggaaucaagcuccaaagacuuuguuugcuacaaagaaggaaccggcccgugcagcgaauccgaagagaaaacaugcaagacgucaggcucaugcagaggagacaugcaauucugcaaaguggcaggaugcgaacacggagaagaggcuucggaagcgaaaugccgauguagccugguacacaagccgggagaagucgucgucaguuacggcggaaugaggguacgcccaaagugcuacggauucagccgcaugauggcaacgcuggaaguaaacccucccgaacaacgcauagggcaaugcaccggaugccaucuggaaugcauaaacggaggcguacgacuaauaacccuaacgagcgagcuuaagagcgcaaccguaugcgcgucacauuucuguucaucagccaccucaggcaagaaaagcacggaaauccaauuccacucagguucccuaguagguaaaaccgccauacauguaaaaggagcgcuagucgacggaacagaguucacauucgaaggcucaugcauguucccagacggaugcgacgcaguagacugcacuuucugccgagaguuccucaagaacccccaauguuacccagcaaagaaguggcuguucaucauaaucgcaaucuugcucggguacgcaggucuaaugcugcugacgaacgugcuaaaggccauaggcguaugggggagcuggguaaucgcccccguaaaacuuauguucgcaaucaucaaaaagcucaugcgcagcguaagcugccugauggguaaauuaauggacagaggcagacaagucauacaugaagaaauaggcgaaaacagggaaggaaaccaggacgacguuagaauagaaauggcccgcccacgccgcguacgacacuggauguauuccccaguuauccucacgauacucgcaaucggccucgcagagggaugcgacgagauggugcacgcagacuccaagcuagucucaugcaaacaagggagcggaaacaugaaagagugcgugacaacaggcagggcucuacuccccgcagugaaccccggacaagaagcaugccugcacuucaccgcuccaggaaguccagacucuaaaugccuaaaaauuaaaguaaagagaaucaaccuuaaauguaaaaagagcucaagcuacuucguacccgacgcccguagccgaugcacguccguacgucggugccgaugggccggcgacugccaauccggaugcccgagccacuucaccagcaauuccuucagcgacgauugggcgggaaaaauggaucgggccggacuaggauucuccggcuguucagacggcugcggaggggcagccugcggcugcuucaacgcggccccgucaugcauauucuggaggaagugggucgaaaacccgcacggaaucaucuggaaggucaguccaugugcggcaugggucccaucagcagugaucgagcuaacaaugccaagcggggaagugcgaaccuuccacccaauguccggcauaccaacacagguauuuaaaggcgucagcgucacauaccucgguagcgacauggaagugucaggccuuaccgaccugugcgagaucgaggaacucaaaucuaagaaauuagcacuugccccaugcaaccaggccgggaugggagucguaggcaaagucggcgaaauacaaugcuccucggaggaaagcgcacgcacgaucaagaaagacggcugcauauggaacgccgaccuggucgggauugagcuaaggguagacgacgcagucuguuacuccaaaauuaccucaguagaagcgguagcaaacuacuccgcaauaccuaccacgaucggcggucucagguucgagcgaucccacgacagccagggcaaaauaagcggcucgccucucgacauaacagcgauccgcgguuccuucuccgucaacuacaggggccuuagguugagccucuccgaaaucacggccacgugcacgggcgaagucacgaacgucuccggaugcuacaguugcaugaccggagcaaaagucuccauaaaacuccacucauccaaaaauucgaccgcucacguaaggugcaaaggagacgagacagccuucucagugcucgaaggaguccacagcuacaccguaucccucuccuucgaccacgcaguggucgacgaacagugccagcucaacugcggaggacacgaaagccaggucaccuugaaagguaaucugauuuuucuggacgugcccaaauuugucgacggcucauacaugcagacguaccacuccucagugccuacaggagccaauaucccuagcccaacagauuggcucaacgcccucuucggaaacggccucagcagauggauacucggggucauaggcguucuauuaggaggacuagcccucuucuuccugauaaugagccuauucaagcucggcaccaaacaagucuucagaagcaggacgaagcucgccuaa

SEQ ID NO: 16473 - RNA, 3222 nt, Artificial Sequence
  derived and/or modified CDS sequence (opt11) from SFTSV(SPL066A)__AB985298.1__GP
augaugaaagucaucugguucuccagccuaauuugucucguaauccaaugcagcggggacgcguccccuaucauaugcgcaggaccgauccacagcaauaagucagccaacaucccucaucugcugggcuacagcgaaaagaucugccaaauagacagacugauccacgucagcucguggcugaggaaccacagccaguuccaaggcuacgugggacaacggggaggcaggagccaagucucuuacuuccccgcagagaacuccuacagccgcugguccggccuccuaucacccugcgacgccgacuggcucgggaugcuagucgucaagaaagccaaaggcagcgacaugauaguccccggaccaucguacaaaggaaaaguauucuucgaaaggccgacauucgauggcuacgucggauggggcugcggcaguggaaaaucacgaaccgaaucaggagaacugugcucaagcgacagcggcacaucguccggacuauugccaucagaucgaguacuauggauaggcgacguagcuugccagcccaugacuccaauccccgaggagacauucuuagaacuaaagagcuucagccagucagaauuucccgacaucugcaaaauugacgggaucguauucaaccaaugugaauccgaaucacugccccaacccuucgacgucgccuggauggacgucggccacagucacaaaauaauaaugcgagaacacaaaacaaaauggguacaagaauccucgagcaaggacuucguauguuacaaagagggaacaggcccaugcucagaaagcgaagagaaaacuuguaaaaccagcgggagcugcagaggagacaugcaauucugcaaaguagcuggaugcgaacauggggaagaggcaagcgaagccaagugccgaugcucccuaguacacaaaccaggugagguagucguauccuacggaggcaugcgcguacgcccgaaaugcuacggcuucucacgcaugauggcaacccuggaggugaacccacccgaacagcgaauugggcagugcacagggugccaccucgaaugcaucaacggcgggguacggcuaauaacacuaacaucagaauuaaaaagcgcaacagucugcgcuagccacuucugcucaagugccacaagcgggaagaaaucaacagaaauccaauuccacuccggcagccucguaggaaaagccgcgauccacgucaaaggagcauuagucgacggcaccgaauuuaccuucgaagguuccugcauguuccccgauggcugugacgccguggacugcacauucugccgcgaguuccucaaaaauccccaguguuauccggcaaagaaaugguuauucaucauuaucgucauacuccuaggcuacgcaggucucaugcucuuaacaaacguucuaaaagccaucgguguauggggaaguugggucauagcuccggucaaacuuauguucgcgauaauaaagaaacuaauccgcuccguaucaugccugauggguaaacuuauggaccgcggucgacaaguaauacacgaagaaauaggcgaaaacggcgaaggaaaccaggacgacguacggauagagauggcaagacccagacggguccgacacuggauguacucgccagugauacucacgauccucgccaucgggcuagcagaaggcugcgacgaaauggugcacgccgacucaaaacucguaaguuguaaacaaggaucagguaacaugaaagagugcgucaccacaggacgcgcccuacuaccugccgucaacccgggacaagaggcaugucuacacuucacagcgccagguucacccgacagcaaaugccugaaaaucaaaguaaaaagaaucaaccuaaaaugcaagaaauccagcaguuacuuugucccggacgcccgaagccguugcacgucaguacgaaggugccgcugggcaggagacugucagagcgguugccccucccacuucaccagcaauucauucucagacgacugggcaggcaaaauggacagggccggccuaggcuucucaggcugcagugauggcugcggaggggcggccugcgggugcuucaacgccgcuccauccugcaucuucuggcgcaaaugggucgaaaacccacacgggauaauauggaaaguauccccuugcgcagcauggguacccucagcagucaucgagcucacaaugccuagcggcgaaguccgaacauuccacccgaugagcgggauaccuacccaaauauuuaagggggucuccgucacauaccuaggcagcgacauggaaguaagcggacugacagaccugugcgaaauagaagaacuccgaagcaagaaacuugcccuagccccaugcaaccaagcuggcaugggaguaguaggaaaagucggggaaauacaaugcagcucagaagagucggcacgcacaauaaagaaagacggcugcaucuggaaugcagaccuaguaggaaucgaacuacgcgucgacgacgccguaugcuacagcaaaauaacaagcguagaagcaguggcaaacuacucugcgaucccaacuaccauaggcggccuacgguuugaacgcucccacgacagccagggaaaaaucuccggaagcccccucgacaucaccgccauacgagguagcuuuagcgugaacuacagagggcuaagacugagccucagcgaaaucaccgccacaugcacaggagaagucaccaacgucagcgguugcuacuccuguaugacgggcgcgaaagucagcaucaagcugcacagcucgaaaaauucaaccgcacacguccggugcaagggcgacgaaacagcauuuucaguccucgagggaguccacagcuacacgguaucacuauccuucgaccacgcgguagucgacgaacaaugccaauugaacugcggcggacacgaaagccaagugacgcuaaaaggaaaccuaauuuuccuagacguaccaaaguucguggacggcagcuacaugcagacguaccacagcucggucccgacaggcgcaaacaucccuuccccaacagacuggcugaacgcccucuucggcaacggacucucaagauggauccucggggucaucgggguacuccucggaggacucgcgcucuuuuuccugaucaugucccuauuuaaacuaggaacaaagcaagucuuccggagccgcaccaagcucgccuaa

SEQ ID NO: 16474 - RNA, 3222 nt, Artificial Sequence
  derived and/or modified CDS sequence (opt11) from SFTSV(SPL070A)__AB985301.1__GP
augaugaaagucaucugguucaguucacucauuugcuuagucauacaaugcagcggcgacaccgggcccauaauaugcgcaggaccgauccacucaaacaaaucagccaacauuccgcacuugcucggcuacucggagaaaaucugccaaaucgaccgacucauacacguaucaaguuggcuccgcaaccacagucaauuccaaggcuacgucggccagcgaggcggccgaucccaagugaguuauuuccccgcagaaaacagcuacagucgauggucgggccuccuaucgccaugcgacgcggacuggcuagggaugcucgucgucaaaaaggcgaaaggcagcgacaugaucguaccaggaccaagcuacaaaggcaaggucuucuuugaacgccccaccuucgacggauacguaggcuggggaugcggcucaggcaaaagcagaacggaaaguggggaacucugcucaagcgauucaggcacaagcagcggacuacugcccagcgaccgcguacuguggauaggagauguagccugccaacccaugaccccaaucccagaagaaaccuuuauggaacugaaaucauucagccaguccgaguucccggauauaugcaaaaucgacgggauaguauucaaccagugcgagucagagagcuuaccccagcccuuugacguggccuggauggaugucgggcacagccacaagauaauaaugagagaacacaaaacgaaauggguacaggaaucaaguucaaaagacuucgugugcuacaaggaaggcacagggccaugcagcgaaucagaagagaaaacguguaagacaucaggcagcuguagaggagacaugcaauucugcaaagucgccgggugcgaacacggggaagaagcaagcgaagcaaaguguaggugcagccugguacacaaaccgggcgaaguaguugugucguacggcggcaugcgaguccgaccgaaaugcuacggguucucccggaugauggccacauuggaaguaagcccacccgaacaaagaauuggccagugcaccggaugccaucuugaaugcaucaacggcggcguucgacuaaucacacucaccagugagcugaaaagcgcaacagugugcgcaagccauuucugcagcucggcaaccaguggaaagaaaagcacugaaauacaauuccacagcggcagccuuguuggaaagaccgccauccacguaaaaggcgcacucauggaugggaccgaauuuaccuucgaaggcagcugcauguucccggacggaugcgacgcaguggacugcaccuucugccgagaguuccuaaagaauccacaaugcuaccccgcaaagaaaugguuauucauuauuaucguaauacuccucggcuacgcaggacucaugcuccuaacaaacguacucaaagcaauaggcguaugggguagcugggugauagcacccguaaaacuuauguucgcaauaaucaagaaacucaugcguucgguaucaugccuaaugggaaaacucauggacagagggcgccaggucauccacgaagaaauaggagaaaacggcgagggaaaccaggaugacgucagaauagagauggcgaggccccgacgaguccggcacuggauguauagcccggucauacuaacaauccuggcaauaggacuagccgaggggugcgacgagaugguacacgccgacucaaaauuagucucaugcaaacaaggcagcggaaacaugaaagaguguguaacgacuggcagagcgcuccuaccggccguaaacccgggacaagaagcaugucuccauuuuaccgcucccgggaguccggacaguaagugccucaagaucaaagucaaacgaauaaaccucaaaugcaagaaaagcagcaguuacuuuguccccgaugcacguagcagaugcacauccguccggagaugccgcugggccggagauugccagucgggaugccccagucacuucacaagcaacagcuucucagacgacugggccgguaaaauggaccgugccgggcuaggguucagcgggugcucagacggcuguggcggcgccgcaugcgggugcuucaacgcagcgcccagcugcaucuucuggagaaaaugggucgagaacccccacggaauaaucuggaaagucucacccugugccgcauggguccccucugccgugauagaauuaaccaugccaagcggggaaguacggacguuccaccccaugagcggaauacccacgcaggucuuuaaagguguaucggucacauaccuaggaagcgacauggaaguaaccgggcucacagaccuaugcgaaauagaagaauuaaaguccaaaaagcuagcacuagcucccugcaaccaagccggcaugggagucgugggcaaggucggggagauucagugcagcuccgaagaaucagcacgcacgaucaaaaaggacgggugcauauggaacgcggaucuaguaggcauagaacucagagucgacgacgcgguaugcuacaguaagaucacgagcguagaagcuguagccaacuacucggcaauacccaccacgauaggcggccuacgguucgagcgcagccaugauagccagggcaaaaucagcggcagcccccuagacauaacagcaauccgcggcucauucuccgucaacuacagaggccugagacuuucacuaagcgagaucacggccacaugcacaggcgaaguaacgaacgucucaggcugcuacagcuguaugacgggggccaaagugagcauaaaauuacacagcaguaaaaacucuaccgcucacguccgcugcaaaggagacgagaccgcauucucgguccucgaagggguacacucguacaccgugucacucuccuuugaucacgccgucguagacgaacaaugccaacucaauugcggcgggcacgaaucucaggucacgcugaaagggaaccuaauuuuucuugauguacccaaauucguagacggguccuacaugcagaccuaccauuccucaguacccaccggcgcgaacaucccaagcccaacagauuggcuaaaugcacucuucggcaacggcuuguccagauggauacucggcgucauaggcgugcuacugggcggcuuagcccuauucuuccuaaucaugagccuguucaaacucggaaccaaacaaguauucagaccuagaacaaaacuagcguaa

SEQ ID NO: 16475 - RNA, 3222 nt, Artificial Sequence
  derived and/or modified CDS sequence (opt11) from SFTSV(SPL071A)__AB985302.1__GP
augaugaaaguuaucugguucagcucccucaucugccuaauaauacaaugcagcggggacacaggaccgaucauaugcgcugguccaauccacucaaacaaauccgccaacaucccccaucuacuaggcuacucagagaaaaucugccaaaucgacagacuuauccacgugagcucuuggcugagaaaccacucccaauuccaaggauacguaggacaacgaggaggaagaagccagguaagcuacuuccccgcggaaaacagcuacuccagaugguccggccuacugucaccgugcgacgcggacuggcuagggaugcucgucguaaagaaagcaaaagguagcgacaugaucguacccggacccucauacaaaggcaaagucuucuucgaacgcccaaccuucgauggauacgucggguggggaugcgggucgggaaaaagccgcacggaaagcggcgaacuauguucuucagacucaggcacaucgagcggccuauuaccaucagaccgcguccucuggauuggagacgucgccugccaaccuaugacccccauaccggaggaaacauuucucgaauuaaagagcuuuagccaaagcgaguucccagacauaugcaaaaucgacgggaucguguucaaccaaugugaaagcgaaucacuuccccagcccuucgacguagcauggauggacguagggcacucacacaaaaucauaaugagggagcacaaaacuaaauggguacaagagucaucaucgaaagauuucguauguuacaaagagggcacaggacccugcucagaaagcgaagagaaaacauguaaaaccucaggcuccugucgcggcgacaugcaguucugcaaaguagcuggaugcgaacacggagaagaaacaucggaggcuaaaugccgcuguagccugguccacaaaccaggagaaguaguagucuccuacggaggcaugcgcguaaggccgaaaugcuacggcuucagcagaaugauggcaacacuggaagucaacccacccgaacaacggauaggacaaugcaccggcugccaccuagaaugcaucaacgggggagugcgcuuaauaacacucacauccgaacuaaaaagcgcaacagugugcgccagucauuucugcagcagcgcaacgaguggaaagaaaagcaccgaaauacaguuccacucagggucgcuagucggaaaaaccgcgauccacguaaaaggugcgcucguugacgggaccgaguucacauucgaagguucaugcauguucccggacgggugcgacgccguagacugcaccuucugccgagaguucuugaaaaacccgcaguguuacccagcuaagaaauggcuauucaucaucaucgucauccuccucggauacgcgggccucaugcugcuaacuaacguccuaaaagcaaucggcguuugggggagcuggguaauagcccccgucaagcucauguucgccauaauaaagaaacuaaugcggucagucucaugccuaauggggaaacugauggaccggggucgacaggucauacacgaggaaauaggcgaaaacagggaagggaaccaagacgacguucggaucgaaauggcgcgaccccgccgcgugcgacacuggauguauagccccgugauucuggcaauccuugcgaucggacuagcagaaggaugcgacgaaaugguacaugcggacagcaaacucgucagcugcaaacaagggagugguaacaugaaagagugcguaacaacaggccgggcacuacuacccgcagucaaccccggacaggaggccugccuccacuucaccgcacccgguucaccagacagcaaaugccugaaaaucaaagugaaacgcauaaacuuaaaaugcaagaaaagcucgagcuacuucgucccugacgccagaaguagauguacgaguguaagacgaugccgcugggcgggagacugccaaagcgggugcccaagccacuucacuagcaacucauucagcgaugacugggcaggcaaaauggacagagcaggacuaggguucucaggaugcucggacggcugcggcggggccgccugcggcuguuucaacgccgcaccgagcuguaucuucuggagaaaauggguagaaaacccccacgggauaaucuggaaaguaucgccaugugcagccuggguacccucagccgucauagagcuuacaaugccaagcggggaggugcgcaccuuccacccaauguccggaaucccgacacaaguuuucaaaggcgucucaguaacguaccugggcuccgacauggaaguuuccgggcucaccgaccucugcgaaaucgaggaacuaaaaucgaagaaauuagcccuagcaccaugcaaccaagccgggauggggguagugggaaaagucggggaaauccaaugcucaucagaagaaucugcccggacgaucaagaaagauggcuguaucuggaacgcggacuuggucggcauagaacuaagaguggacgacgcaguaugcuacuccaaaauaaccucaguagaagccguagccaacuacucagcuauaccaaccacuauaggcgggcuaagauucgagcgcucgcacgacucacagggaaaaaucucaggcucgcccuuagacauaacggcaauaaggggcucguucucggucaacuaccggggucugaggcuaagccuguccgaaauaaccgccacuugcacgggcgaagucacuaacguaagcggcugcuacagcugcaugacuggggcaaaagucagcauaaaacuacacucgagcaagaacucuaccgcgcacguccgcugcaaaggagacgagaccgcauucuccguacuggaaggaguacauucauacaccguaucccugagcuuugaccaugcaguagucgacgaacaaugccaauuaaauugcggaggccacgagagccaggugacccucaaagguaaccuaaucuuucuugacguaccuaaauucguugacgguucguauaugcagaccuaccacagcucaguaccaacaggcgccaacaucccaagccccacugacuggcucaacgcccuauucggaaacggcuugagccgcuggauauugggagucauaggcguacuacuagggggacucgcccucuucuuccugauaaugucacuauucaaacuaggaaccaaacaaguguucaggucccggacgaaacuagcguaa

SEQ ID NO: 16476 - RNA, 3222 nt, Artificial Sequence
  derived and/or modified CDS sequence (opt11) from SFTSV(SPL077A)__AB985304.1__GP
augaugaagguaauaugguucagcucgcucaucugcuugguaacgcagugcagcggcgacacgggacccauaauaugcgcaggcccuauacacaguaacaaauccgccaacaucccgcaucugcuuggcuacucggaaaagauaugccaaauagacagacugauccacgugagcucauggcuacgaaaccacagucaguuccaaggguacguuggccaacgagggggccgaagccaaguaucuuacuuuccagcagaaaacagcuauucacgcuggucgggucugcuaagccccugugacgcagauuggcucggaaugcuaguaguaaagaaggcaaaggguucagacaugaucgugccaggucccucguacaaaggcaaaguauuuuucgaacggccaacguucgacggcuacgucggaugggggugcggaucaggaaagagcagaaccgaaagcggggaauuaugcucaagugacagcgguaccagcagcggccuccuaccgucggaccggguacuauggaucggagacguugcaugccaacccaugacuccaauaccugaggagaccuuccucgaacucaaaucauucagccaaagugaguucccagacauaugcaaaaucgacggcauaguauucaaccaaugugagagcgagagccugccacagccuuucgacgucgcauggauggacgucggacacagccacaaaauaauuaugagagaacacaaaaccaaauggguccaagaaucaagcucgaaagauuucguaugcuacaaagagggcaccggcccaugcucagaaucagaggaaaagaccugcaagaccucaggaagcugccggggcgacaugcaguuuuguaaagucgcuggaugcgaacacggagaagaagccagcgaagcaaaaugccgcugcagccucguccacaaacccggcgaaguaguggucucauacgguggcaugcgaguacgaccuaaaugcuacggcuuuucaagaaugauggcuacacuggaagucaacccucccgaacaaaggaucgggcaaugcaccggcugucaccuggaaugcauaaauggcggcguccgacugaucacgcucacaagcgaacuuaagagcgcgacggugugcgccucccacuucugcagcucggcuacaucaggcaaaaagagcacggaaauacaauuccacucaggaagccuaguuggaaaaaccgcaauccaugucaagggagcccucguggacggcacggaguucacauucgaagguucgugcauguuccccgacggaugcgaugccguagauugcaccuuuugcagagaguuccugaaaaacccacaaugcuaccccgccaagaaauggcuauucauaauaaucgucauccuccucggcuacgcaggccugaugcugcugacaaaugugcuuaaagcgauaggaguauggggaagcugggucaucgcaccggucaaacuaauguucgcaauccuaaagaaacugaugcgcagcgucagcugccugaugggaaaacugauggaucgcggccgccaagucauacacgaagaaauaggagaaaacagagaagggaaccaagacgacguacggaucgagauggcucgcccaagacgcgugaggcauuggauguacagcccggucauacucacuauacuagccauaggccuagcugagggcugcgacgagaugguacacgccgacuccaaacuggucagcugcaagcaaggaucagguaacaugaaagaaugcguaacaacaggcagagcccuacugcccgcugucaacccaggccaggaagccugccugcacuucacggccccaggcucaccagacucgaaaugucucaaaaucaagguaaagcggaucaaccuaaaaugcaaaaagagcagcagcuauuucgucccagaugcccgaagccgaugcacgagcguaagacgauguaggugggcaggagacugccagucagggugccccucccacuucaccagcaacagcuuuuccgaugacugggcaggcaagauggaccgcgccgggcucggauucucaggcugcagcgacggaugcgguggcgcggccugcggcugcuucaacgcugcacccucaugcauuuucuggcgaaaaugggucgagaacccccacggcaucauauggaaagucucaccaugcgccgcaugggucccaagcgcaguaaucgagcucaccaugcccagcggagagguccgcacauuccacccaaugaguagcauccccacgcaaguauuuaaaggcguauccguaacauaccucggcagcgacauggaaguauccggauuaacugauuuaugcgaaaucgaggaacucaaguccaagaagcuagccuuagcgcccugcaaccaagcaggcaugggcgucgucgguaaaguaggggaaauacaauguagcucagaggagagcgcgcgcacaaucaagaaagacggauguaucuggaacgccgaccuagugggcauagaacuaaggguagacgacgcggucugcuacucaaaaaucaccucgguagaggccgucgccaacuacagugccauacccaccaccauagggggccugagguuugaacgaucccacgacucacaaggaaaaauaucgggcucaccacuagacauaacagcgaucagaggcucauucucagucaauuaccgagggcugcgucuuagccucagugagaucacagcaacgugcaccggagaagucacaaacguguccggcugcuacagcugcaugacaggcgcaaagguaucuaucaagcuccacaguaguaaaaacucaacagcucacgugcgaugcaaaggggacgagacugccuucucaguccucgagggaguccacuccuacacggugagucucagcuuugaccacgcaguaguagacgaacaaugccaauuaaacugcgggggacacgaaucacaagucacccucaaagggaaccugauauuccucgacguaccaaaauucgucgacggaucauauaugcagaccuaccacagcucaguaccgaccggagccaacauacccagcccaacugacuggcugaacgcacuauucggcaacggccuauccagguggauacucggcgucauaggcgugcugcugggaggacuagcccucuucuuccugaucaugagccuuuucaaacagggcaccaagcaagucuuccgaagccgaaccaaacucgccuaa

SEQ ID NO: 16477 - RNA, 3222 nt, Artificial Sequence
  derived and/or modified CDS sequence (opt11) from SFTSV(SPL084A)__AB985307.1__GP
augaugaaagucauaugguucagcucccuaaucugccuagucauccaaugcaguggggacaccggcccgauaauaugcgcggguccaauccacucgaauaaaucagcuaauauaccccaucugcuuggauauucagagaagaucugccaaauagaccgacuaauacacguaagcagcuggcuccgaaaccacucgcaguuccagggauacgugggucaacgcgggggacggucccaaguauccuacuucccagccgaaaacucauauucacgaugguccggacuacucucccccugcgaugccgacuggcuaggaauguuggucgucaagaaagccaaagggagcgacaugauagucccaggccccucguacaaagguaaaguauucuucgaacgaccuaccuuugacggcuacguaggcuggggcugcggcuccggcaagagcagaaccgaaagcggagaacuaugcucgagugacuccgggaccucgaguggacuacugccuucagacaggguacuauggauaggcgacgucgccugccaacccaugacaccgauccccgaagaaacauuccucgagcuaaagagcuucagccaguccgaguucccagacauaugcaaaaucgacggcauuguauucaaccagugcgaaagugagucacugccccaaccauucgacgucgccuggauggacgucgggcacucacacaaaaucauaaugagggaacacaaaacaaaauggguacaggagucaucaucuaaagacuucguuugcuacaaagaggggacgggcccaugcucagaaagcgaagagaagacguguaagacaucaggaaguugcaggggcgacaugcaauucugcaaaguggccgguugugaacacggggaagaggccuccgaagcaaaaugccgaugcagccuaguacacaaacccggagaagugguagucuccuacggcggaaugcgcguccgcccaaagugcuacggguucuccagaaugauggccacccuggaaguaaaucccccagaacaacgaauagggcaauguacagggugccaccuugaguguauaaacggcggcguacgccucauuacucugacgucagaacuuaagagcgcaaccgugugcgcuagccacuucugcagcagcgcaaccucagguaagaaauccacagaaauacaguuucacaguggcucccuaguuggcaaaaccgcgauacacguaaaaggcgcccuaguagacggaaccgaguucacauucgaagguagcugcauguuccccgacggaugugacgcaguugacugcaccuucugcagagaguuccuaaagaacccacaaugcuacccagcaaagaaauggcuauucaucaucaucguaauacuacucgguuacaccggacuaaugcuacuaacaaacgugcucaaagcaauaggagucugggggaguuggguaaucgcaccgguaaagcuaauguucgcaauccuaaagaagcuaaugcgcucggucucaugccucaugggaaaacuaauggaccgcggacgccaagugauccacgaagaaaucggcgaaaaccgagaaggaaaccaagacgacgugcgaaucgaaauggcacgacccagacgaguccggcacuggauguauagcccggucauccucaccauccuagcaaucggccucgccgaagguugugacgagaugguucacgccgacuccaaguuagucaguugcaagcaaggcagcggaaacaugaaggaaugcguaacaacgggcagagccuugcuacccgcagucaaccccggccaagaagcaugccugcacuucacagccccaggaagcccugauucaaagugccuaaaaauaaaagugaagcguauaaacuuaaaaugcaaaaagucaucgagcuacuucgugccggacgcccgguccaggugcacgagcgugaggcgcugccgaugggccggugacugucaguccggcugcccgagccauuucacgaguaacaguuucagcgacgacugggcagggaaaauggaccgggccggucucggcuucagcggauguagcgacggcugcggaggggccgcaugcggcugcuucaacgccgcucccuccugcaucuuuuggagaaaauggguggagaauccacacggaaucauauggaaaguaagcccaugcgccgcauggguaccaagcgcagucauagagcuaacaaugccaagcggagaaguucguacguuccacccaaugucggguauaccaacgcaagucuucaaaggagucucggucacguaccucggguccgauauggaaguauccggacuaacagaccuaugcgaaauagaagaacuaaaaagcaagaaacucgcacuagcgcccugcaaccaagcagguaugggcguaguggguaaagucggagaaauccaauguagcagcgaagaaagcgcgcgcaccaucaagaaagacgggugcaucuggaacgccgaccuagucgguauagagcuaagaguagacgaugcaguaugcuacucaaaaauuacauccgucgaggccguagccaauuauucagccaucccaacgaccaucggcggacuccgcuuugagcgcagccacgacucccaaggcaaaaucucgggcagcccccuggacauaacagcaauacgcggauccuucagcguaaauuacagaggacuaagacuaagccugagcgaaaucacggcaaccugcaccggcgaagucacaaacgucagcggcuguuacagcugcaugacaggcgccaaggugagcaucaaacuacacuccagcaagaacucaaccgcccacguacgaugcaagggggacgaaaccgcguucucaguccaggaaggcguccauucauacaccguaagucuauccuucgaccacgccgucgucgacgagcagugccagcuuaacugcggaggccacgaaucucaagucacguuaaaaggaaaucucauauuccucgaugugccaaaauucguagacggcaguuacaugcaaacguaccacagcucggucccaaccggagccaacaucccaagcccaaccgacuggcucaacgcucuauuuggcaacggccuuuccagguggaucuuaggcgucauaggcguccuccugggcgggcuagcacuauucuuucuaauaaugaguuuauucaaacuggggaccaaacaagucuuccgauccaggaccaaauuggcauag

SEQ ID NO: 16478 - RNA, 3222 nt, Artificial Sequence
  derived and/or modified CDS sequence (opt11) from SFTSV(SPL086A)__AB985308.1__GP
augaugaaagucauuugguucagcucgcuuauaugccuugucauacaaugcucaggcgacacaggcccgaucauaugcgccggacccauccacagcaacaagagcgccaacaucccacaucugcuaggcuacagcgagaaaauaugccaaauagacagacucauacacguaaguucauggcuccgaaaccacagccaauuccagggguacgugggccaacgcgggggacguagccaggucucauacuucccagccgaaaacagcuacuccagguggucaggauuacuuucaccgugugacgccgacuggcuaggaauguuaguagugaagaaagcaaaagggagugacaugaucguccccggccccuccuacaaaggaaaagucuucuucgaacgcccgaccuuugacggauacgucggauggggcugcggcagcggaaaaucccgcaccgaaagcggcgaacuauguuccucagacuccggaacuagcagcggccuacuccccuccgacaggguccuauggauaggugacguagcuugucagccuaugacacccauuccagaggaaaccuuccucgaacuaaagagcuucagccaaagcgaguuccccgacauaugcaaaaucgacggcauaguguucaaccaaugcgaaucagaaucccuaccccaacccuucgacgucgccuggauggacgucggacacagccacaaaaucaucaugcgcgagcacaagacgaaauggguucaggaaagcagcuccaaagauuuuguaugcuacaaagaaggcacaggcccaugcuccgagagcgaggagaagaccugcaaaacaucaggcucaugccggggcgauaugcaauucugcaaaguugcgggcugcgaacacggagaagaagcaagcgaagcaaaaugccgaugcagucucgugcacaaaccaggcgagguagucguaucauacggaggcaugcgagugcgcccaaaaugcuacggauucucgcgcaugauggccacccuagaagucaacccaccagaacagcgaauaggacaaugcaccgggugccaccucgagugcaucaacggaggagugaggcucauaacgcucacauccgagcuaaaaagcgcaacaguaugcgccagccacuucugcucaucggccaccagcggcaagaaaagcacagaaauucaauuccacagcggaucccuagugggcaaaaccgcgauacaugucaaaggagcauuagucgacggcacagaauuuacguucgaaggaucaugcauguucccagacggaugcgacgcaguagacugcaccuucugccgugaguuccucaagaauccacaaugcuacccggccaagaaaugguuauucaucaucauagugauacuccugggauacgcaggccuaaugcuacucacgaacguauuaaaagcaaucggaguauggggcucgugggucauagccccaguaaaauuaauguucgccauaaucaaaaagcucaugcggagcgucucgugccucaugggcaaacucauggaccgcggacgccaagucauacacgaggaaaucggugaaaaccgcgaaggaaaccaggaugauguacgcaucgaaauggcacgucccagaagaguccgacacuggauguauagcccaguuauauuaacaauacuggcuaucggccucgccgaaggcugcgacgaaauggugcacgcagacuccaaauuaguauccuguaagcaaggcagcggcaacaugaaagaaugcgucaccacaggccgcgcccugcuccccgcggucaacccaggccaagaggcuugucugcauuucaccgcccccggaagcccggacagcaaaugccucaaaaucaaaguaaaaagaaucaaccugaagugcaagaaaagcucgagcuacuucguacccgacgcucgaagccguugcacaucaguacgaagaugccgcugggcgggagacugccaaagcgggugcccgagccacuucaccuccaacucguucuccgaugacugggccggaaaaauggaccgcgcagggcucggcuucuccggcugcagcgacggaugcggcggcgcagccugcgggugcuucaacgcugcccccagcugcauauucuggcggaaauggguggagaacccccacggaaucaucuggaaaguuucacccugcgccgcaugggugccuucagccguaauagagcucacgaugccauccggcgaaguccguacguuccacccaaugaguggaauccccacccaaguauucaaaggagugagcgugacauaucuuggcucggacauggaaguuagcggacucacggaucuaugcgaaaucgaagaacugaaaucuaagaaacuagcccuagcacccugcaaucaagcgggcaugggcgucguagguaaaguaggcgagauacaaugcucgagcgaagaaagcgcccgaacgaucaagaaagacggcugcaucuggaacgcagaccuaguaggaauagagcuccgagucgacgacgccgucugcuacucaaaaauaaccuccguagaagccguagcgaauuauucugccauccccaccacaaucggaggccuccgcuucgaacgcucccacgacucccaaggcaaaaucucggguagcccccuggacaucacagccauacgaggaucguucagcgucaacuacagaggacuacgucuuagucugucagagauuacagccacaugcaccggcgaagucacaaauguaucagggugcuauuccugcaugacgggcgcucgagucuccaucaaauuacacagcuccaaaaacucaaccgcgcacguccgcugcaaaggagacgaaaccgcauucucgguacuugagggcguccacucauacacagucucucuuagcuucgaccacgccgucgucgacgaacaaugccaacuaaacugcggaggccacgaaucacaaguaacccugaaaggcaaccuaaucuucuuagacguucccaaauucguagacggaagcuacaugcaaacauaccacaguagcgucccaacaggagccaauaucccgucccccaccgacuggcucaacgcacuauucggcaauggacuauccagguggauccucgggguaaucggaguacugcuaggugggcuagcgcuauucuuccuaaucaugucucuauucaaacucggaacaaaacaggucuuccgcagccgaacaaaacuagccuga

SEQ ID NO: 16479 - RNA, 3222 nt, Artificial Sequence
  derived and/or modified CDS sequence (opt11) from SFTSV(SPL087A)__AB985309.1__GP
augaugaagguaauaugguucagcagucucauaugccuaguaauccaauguaguggcgacaguggaccaaucauaugcgcagggccaauacacucaaacaaaagcgcugacauaccacaccuacucggguacucagagaaaaucugccaaauagacagacucauccacguuucaaguuggcuacgaaaucacagccaauuucaaggauacgucggucagcgcggaggacgcagccaggucaguuacuacccagccgaaaacuccuacagccgauggagcggauuacugucacccugcgacgcggacuggcuaggaaugcuagucguaaagaaggcuaaagguuccgacaugaucgucccaggcccaagcuacaaaggcaaggucuucuucgaaagaccaacauucgacggauacgugggguggggaugugguagcggaaaaagccgauccgaaucaggagagcugugcucgucagacagcggaaccucgucagggcugcuaccgagugaccgaguacucuggaucggggacgucgccugccagcccaugacccccauaccagaagaaaccuuccuagaacuaaagagcuucucacagucagaguuccccgacaucugcaaaaucgacggcauugucuucaaucagugcgaaggagaaagccugccgcagccauucgacgucgccuggauggacguaggccacucacacaaaauaauaaugcgugaacacaaaacuaaauggguccaagaaucgagcagcaaagacuuuguaugcuacaaagaaggaaccggcccuuguuccgaaucggaagagaaaacaugcaagaccucaggcucgugcagaggugauacccaauucugcaaaguagcggggugcgaacacggagaagaagccucagaagcgaagugcagaugcagccucguccauaaacccggcgaagucgucgucagcuacggcggaaugcgcguccgacccaagugcuacggauucucccgcaugauggcaacccucgaagucagcccacccgaacaacgaauaggacaauguacuggcugccaccuagaaugcauuaacggaggaguacgcuugaucacauuaaccagcgaacuaaagucagcgacaguaugcgccagucauuucugcucauccgccaccuccggaaagaaauccaccgaaauccaauuccacucaggcucccucgucgggaaaaccgccauccacguaaaaggagcgcucguagacggcaccgaauuuacguucgaaggauccugcauguucccagaugggugugacgcaguagacugcaccuucugccgcgaguuccuuaaaaacccccagugcuacccagcaaagaaaugguuauucaucauaaucgugauacugcuaggcuacgcggggcuaaugcugcucacgaacgugcugaaagccauagggguguggggcagcugggugauagccccgguaaaacucauguucgccaucaucaagaaacucaugcgaacaguauccugcuugaugggaaaacugauggaccgcggacgacagguaauacacgaagaaauaggagaaaaucgggaaggaaacagggacgacauccgaaucgagauggcacgaccacgcagaguccggcacuggauguacucucccgugauucugaccauacuagccaucgggcuagccgaaggcugugacgaaaugguccacgccgacaguaaauuagucucguguagacaggggagcggaaauaugaaagagugcgugacaacaggccgggcccugcucccagccguaaacccaggccaagaggcaugccuccacuucacagccccaggcagccccgacuccaaaugccucaaaaucaaagugaaaaggauaaaccuaaaaugcaagaaauccuccuccuacuucgugcccgacgccagaucgagaugcaccagcguaagacgaugccgaugggcaggagacugccaauccggcugcccaccccacuucacgagcaacagcuuuagcgacgacugggcuggaaaaauggacagggcuggacucggcuuuagcggcugcagcgacggcugcggcggagcagcaugcggaugcuucaacgcagcacccucaugcaucuucuggcgaaaaugggucgagaacccccacggaaucauauggaaagucucgcccugcgcagccuggguacccucggccguaaucgaacugacaaugccauccggugaaguacgaaccuuccaccccaugagcgggauuccaacacaggucuucaaaggagucuccguaacauaccuuggauccgacauggaagucaguggacucacagaccucugcgagauagaggaacugaaaagcaagaaacuagcccuugcaccuugcaaccaggccggaaugggagucgugggaaaaguaggugaaauucagugcagcagugaagaauccgcacgaacgaucaagaaagacggaugcaucuggaaugcggaccucgucggaaucgagcugcgagucgacgacgcugugugcuacagcaaaaucacauccgucgaggccguagccaauuacuccgccauuccuaccaccauaggcggauugagauucgaacgcucgcaugacucgcaagggaaaauaucagguucgccccucgauauuacugccauaagaggcagcuucucaguaaacuacaggggacuccgccuaagccugagcgaaaucacagccacaugcaccggagagguaacgaacgucagcggaugcuacagcugcaugacaggagcgaaaguaucaaucaaacuacauucaagcaaaaacucaacagcacacguaagaugcaaaggagacgaaacagccuucuccguacucgagggaguccacuccuacacagugucacuguccuucgaccacgcaguaguagacgaacggugccaacugaacugcggcggccacgaaucgcaaguaacccuaaaaggcaaccuaauauuccuggacgucccaaaauucgucgacgguuccuacaugcagaccuaucacagcacaguacccaccggagccaacauaccaagcccaacagacuggcucaacgcacucuuugggaacggccucaguagauggauccuaggaguaauaggcguacuccuaggcggccuggcccucuucuuccugaucaugagccuauucaaacucgguacaaagcaggucuucagaagccguacgaaacuagccuaa

SEQ ID NO: 16480 - RNA, 3222 nt, Artificial Sequence
  derived and/or modified CDS sequence (opt11) from SFTSV(SPL090A)__AB985311.1__GP
augaugaaggucauaugguucccaucucugauauguuuaguaauacguugcagcggcggcacaggcccaauaauaugcgcgggcccaauccacagcaacaaaagugccaacaucccacaucugcuagguuauuccgaaaagaucugccaaaucgaccgucuuauccacgucagcucauggcuacguaaccacucacaauuccaaggauacgucggccagcgcggagggaggucacaaguuucauacuucccagcagaaaacagcuacagccgauggucaggcuugcuuucaccaugugacgcagacuggcugggaaugcuaguaguuaagaaagcccggggauccgauaugauaguccccggcccaucauacaaagguaaaguauucuucgaacgccccacuuucgacggguacguaggauggggauguggaaguggaaaaagccgaaccgagucaggggaacucugcuccagcgacuccgggacaucaagcgggcuacugcccuccgaccggguacuguggaucggcgacguagccugccaacccaugacccccaucccagaagagaccuuucuagaacucaagaguuucagccaaucagaguuccccgacauauguaagaucgacggcauaguauucaaccaaugcgaaagcgaaagccuaccccaaccguucgacguagccuggauggaugucggacacucucacaagaucauaaugagagaacacaaaaccaaauggguccaggaaucaagcuccaaagacuucguaugcuacaaagagggcacaggccccugcucagaaagugaagagaaaacaugcaaaacaucaggaagcugccgcggcgacaugcaauucugcaaagucgccggaugcgagcacggggaagaggccucggaagcaaagugucgguguagccucguucacaagccaggcgagguaguaguaucguacggagguaugagagugcgcccgaagugcuacggauucucccgcaugauggccaccuuagaagugaacccaccagagcaaagaauaggacagugcacgggaugucaccuggagugcauaaacggaggaguaaggcugauaacacuuaccagugagcucaaaagcgcaacagucugcgcgagccacuucugcuccucggcaaccaguggcaaaaagagcaccgaaauccaauuccacucaggaucgcuaguaggaaagacagcaauccacgucaagggcgcccuaguagacgggacggaguucaccuucgaagguucaugcauguuccccgacggcugcgacgcaguagacugcaccuucugccgagaguuccucaaaaacccacaaugcuacccagcaaagaaaugguuauucaucaucaucgcaauccuucucggauacgcgggacuaaugcugcuaaccaacguacucaaagccauuggcguauggggcuccugggugauagcgccaguaaagcuaauguuugcaaucauaaagaaacucaugagaucggucucaugccucaugggaaaacuaauggacagggggaggcaagugauacaugaagagaucggugaaaaccgagaaggcaaucaagacgacguccgcauagagauggcccgcccuagaagaguccgccacuggauguacuccccagucauccuaaccauccuggccauaggccucgcagagggcugcgacgaaaugguacacgcagacagcaagcuaguguccuguaaacaagggagcggcaacaugaaagaaugcgugaccacaggccgcgccuugcuaccggcaguaaaccccggacaagaggcgugcuugcacuucaccgcuccaggaagcccagacagcaaaugccucaaaauaaagguaaaacgcaucaaccucaaaugcaagaaaagcagcucauacuucguaccagaugcgcggagcagauguaccuccguaagacgaugcagaugggccggagacugccaguccgggugcccgagccacuucacaucaaacuccuucagcgacgacugggcaggaaaaauggaccgcgcuggacuggguuucagcggaugcagugacggcugcggcggugcggccugcgggugcuucaacgcagcccccucaugcauauucuggagaaaaugggucgagaacccccacggaauaauauggaaaguaucgcccugcgccgcauggguacccucagcaguuauagagcuaaccaugccguccggagaaguacgcacguuccacccaauguccggaauaccaacccaaguauucaaagggguuuccguaacauaccuagggucagauauggaagucuccggacucaccgaccucugugaaaucgaggaacuaaaaucaaagaagcucgcccuagcgccaugcaaccaagcgggaaugggaguggugggaaaagucggugaaauacaaugcagcucagaggaaagcgcacgcacaaucaagaaagacggaugcauauggaacgccgaccucgucgggaucgagcuccggguagacgaugcagucuguuacucaaaaaucaccagcgucgaagccguagccaacuacuccgccauaccuacaacaaucggcggacuacgauucgagcguagucacgacucccaaggcaaaaucucuggcucgccgcuagacauaaccgcgauacgggguucauucucggucaacuaucgugggcuacggcuaagucucagcgagauaacagccaccuguaccggcgaaguaacgaacguauccggaugcuauagcugcaugaccggggccaaaguauccauuaaacuccacuccagcaaaaacagcacagcacauguccgaugcaaaggggacgagacagcuuucagcguacuagaaggaguccacucuuacaccguaucauugucauuugaccacgccguugucgaugaacaaugccaacucaacugcggcggacacgaaucacaaguaacccugaaaggcaaccucaucuuccucgacguaccuaaauucgucgacggguccuacaugcagaccuaccacagcuccgucccgacgggagcaaauauacccagcccaacggacuggcugaacgcccucuucggaaacggacuauccagauggauccuaggaguuauaggagugcuccuaggcggccucgcacucuucuuccugaucaugucccuauucaaacuugguaccaaacaaguauuccgaagccgcaccaaacucgcauaa

SEQ ID NO: 16481 - RNA, 3222 nt, Artificial Sequence
  derived and/or modified CDS sequence (opt11) from SFTSV(SPL097A)__AB985312.1__GP
augaugaaagugauaugguucagcucgcucauaugccucgucauccaaugcuccggagacaccggcccgaucauaugcgccggaccaauccacucaaacaaaucagccgacauaccccaccucuuaggauacucagagaaaauaugccagauagacaggcucauacaugucagcagcuggcuacgcaaccacagucaauuccaaggauauguagggcagcgaggcggccggucccaagucucauacuacccagcagaaaacuccuacagccgguggucaggccuccuaucaccgugcgacgcagacuggcucgguaugcuggucgugaagaaagcaaagggcagcgacaugauaguacccggucccaguuacaaaggcaaaguauucuucgaacgacccaccuucgacggguacgucgguugggguugcggcucggguaaaucgcgaaccgaaagcggagaacuauguaguagcgacucgggcacaucgucuggacuccuacccucagacagaguccuauggaucggcgacgucgccugccaaccaaugacacccauaccggaagaaacauuucuggagcucaagagcuucagccaaucugaguucccagacauaugcaaaauagacggaaucguauucaaccaaugcgagagcgaaucacugccccaacccuucgacguagccuggauggacgucgggcacagccacaaaauaauuaugcgugagcacaagacaaaaugggugcaagaaucaucuagcaaagacuuuguaugcuacaaacaaggaacaggccccugcccggaaucggaagagaaaaccugcaagacaagcggaucauguaggggcgauaugcaauuuugcaaagucgcuggaugugaacacggagaagaagcauccgaagcuaagugccgaugcagccucguccauaaacccggcgaaguaguaguaaguuauggaggaaugcgcguacgaccaaagugcuacggcuucucccggaugauggcgacgcuggaagugaaucccccagaacagcgcauaggacaaugcacaggcugccaucucgagugcguaaacggaggcgucagacuaauaacucuaacaucagagcuaaaaagcgccaccguaugcgcaucccacuuuugcagcucagcaaccucaggcaagaaaaacaccgaaauccaguuccacagcggaucauuagucggaaaaacggcuauccacguaaaaggagcccuauuagacggcaccgaguucacauucgaaggcuccuguauguucccggacggcugcgacgcagucgacuguacauucugccgagaguuccugaaaaacccccagugcuaccccgcgaaaaagugguuauucaucauaaucguaauucuucucggauacgcgggccucaugcuccucacaaacguccucaaagccaucggcgucuggggaucgugggucauagcaccagugaaacugauguucgccauaaucaaaaagcuaaugcgcagcguguccugccucaugggaaaauugauggacagaggccgacaaguaauccacgaagaaaucggagaaaacagagaaggaaaccaggacgacguacgcaucgaaauggcccgaccccgccgggugcgacacuggauguauagcccgguaauccugacaauauuggcaguaggccucgccgaaggaugugaugagaugguacacgcggacucaaaguuagugagcugcaagcaaggcucaggcaacaugaaggaaugcguaacgacaggccgcgcacugcuuccggccguuaacccagggcaggaagcaugccuccacuucacagcaccggggucgcccgauagcaaaugccucaaaauaaaagucaaaaagaucaaucugaaauguaaaaagagcucgagcuacuucguaccggacgcacgcucacgaugcaccucaguuaggagguguagaugggccggagacugccaaaguggaugcccaagucacuucaccuccaacucauucagugaugacugggccggaaaaauggacagagcaggccucggcuucuccggcuguucagacggcugcgggggagcugcgugcggaugcuucaacgccgccccaucauguauauucuggagaaaauggguagagaacccccacgggaucauauggaaagucucccccugugcugccugggugccaagugcaguuauagaauugacgaugccgaguggcgaaguccgaaccuuucaccccaugagcggcauaccgacccagguguucaagggagucagcgucacguaccuaggcucggacauggaggugagcggccuaaccgaucugugcgaaaucgaggagcucaagagcaagaaacuggcacuggcccccugcaaccaagccggcaugggaguaguaggaaaagucggcgaaauccaaugcagcagcgaagagagcgcgcgaacaauaaagaaagacgggugcaucuggaacgccgaccucguaggaaucgaacugagaguagacgacgcagugugcuacuccaaaaucacaagcguggaggccguggcgaacuacagcgcaauccccacaacgaucggcggccuaagguucgaacgaagccaugacucccagggaaaaaucuccgggagcccacuagacaucaccgcaauaagaggaucuuucagcgucaacuaucgaggccuccggcuaagccugagcgaaaucaccgcaacaugcacaggagagguaacuaacgucuccggauguuacagcugcaugaccggcgccaaaguaagcauaaaacugcacagcaacaaaaacagcacagcacacgugcgcugcaaaggcgacgaaacagcauucagugugcuagagggaguccacagcuacaccgucagccucucauucgaccaugcugucgucgacgaacagugccagcucaacugcggaggacacgaaagccaggucacucuaaaaggcaaccuaaucuuccucgacgucccaaaauucgucgacgguucuuacaugcaaacguaccacagcucaguaccgaccggcgcuaacauaccgagucccaccgacuggcuaaacgcccuguucggcaacggacuguccagguggauacuaggcgucauaggaguucuucucggcggacucgcacucuucuuucuaaucaugucccuguuuaaacucggcacaaaacaagucuucagauccagaaccaaacuagccuga

SEQ ID NO: 16482 - RNA, 3222 nt, Artificial Sequence
  derived and/or modified CDS sequence (opt11) from SFTSV(SPL100A)__AB985313.1__GP
augaugaaagucaucugguucucaagccuaauaugccuggucauccaaugcagcggcgacacaggaccaaucaucugugcaggcccaauccauucaaacaaauccgccgacaucccccaccuacucggauacuccgagaaaauaugccaaauagacagauuaauccacguauccuccuggcuacgaaaccacagccaguuccaaggauacgucggacagcgcggcggcaggucacaaguauccuacuacccggcagaaaacagcuauagccgcuggagcggucuacuaagcccuugugacgccgacuggcuaggcaugcucgucgugaagaaagcuaaaggaucagacaugaucguaccgggaccaagcuauaaaggcaaaguauucuucgaacgaccuaccuucgacggcuauguaggauggggaugcgggucgggaaagagcagaacagaaucgggagagcucugcuccucagacucaggcacaucauccggucuacuccccagcgaccgaguacuauggauaggcgacguggcuugccagcccaugaccccgauacccgaggaaaccuuccuagaauuaaaguccuucucccaaucagaauuucccgacaucugcaaaauagacggaaucguauucaaccaaugugaaagcgaaucacucccucagcccuucgacgucgccuggauggacguuggccacagccacaaaauaaucaugcgagaacacaaaacuaaauggguacaggaauccucgagcaaagacuuuguaugcuacaagcaaggaacagggccuugcagcgaaagcgaagagaaaacaugcaaaacauccgggucgugccgaggagacaugcaauucugcaaaguagcaggcugugaacacggagaggaggcaucagaggcgaaaugccgaugcagccucguacacaagcccggcgaaguggucguaagcuacggaggcaugcgcgucagaccaaagugcuacggguucagccgcaugauggcuacacuagaggucaaucccccagaacaacgcauagggcaaugcacgggcugccaccucgaaugcguaaacggcggagucaggcucaucacccucaccucagaacuaaaaucggccacaguaugcgcuucacacuucugcagcuccgccaccuccggcaagaaaagcacagaaauacaauuccacucaggcagccuggugggaaaaaccgccauccacgugaaaggcgcacuccucgacgggacagaguucaccuuugaaggaucguguauguucccagacgguugcgacgcugucgacuguacauucugccgggaguuccucaaaaacccacaaugcuacccagcaaagaaauggcuauucaucauaauagucauccuccucggauacgcagggcucaugcucuugaccaacgugcucaaagcaauagccgucuggggguccuggguaaucgcccccgucaaacuaauguucgcaauaauuaagaaacucaugcgcucaguuuccugccuuaugggcaaacuaauggacaggggccggcaaguaauacacgaggaaauaggggaaaacagagagggaaaccaggacgacguccgaaucgaaauggcgcgaccucgccgaguaagacacuggauguacagcccaguuauacuuacaguucucgcggucggcuuagcagaagggugcgacgaaaugguucacgcagacuccaaacuugugagcugcaagcagggcagcggcaacaugaaagagugcgucaccacggggcgcgcccuguuacccgcagugaaucccggccaagaggcgugccuccacuucacagcgcccggaagcccagacuccaaaugucuaaaaauaaaaguuaagaaaaucaaccuuaaaugcaagaaaucgucuuccuacuucguccccgacgccagaucccgcugcaccucagucagaagaugucgaugggccggggacugccagagcggaugccccagccacuucaccagcaacagcuucucggacgacugggccggaaaaauggacagagcgggccucggauucagugggugcuccgacgggugcggcggagccgcaugcggaugcuucaacgcagcaccaagcugcaucuucuggaggaagugggucgagaauccccacggcaucauauggaaagucaguccaugcgcggcauggguaccgucagcagucaucgaacucacaaugccaagcggugaaguaagaacauuccaccccaugagcggaauacccacacaaguuuucaaaggggucuccgugacguaucucggcagcgacauggaagucuccggacugaccgaccuuugcgagaucgaggaacuaaagucaaagaaacuggcccuggccccauguaaccaggcaggaaugggggucguaggcaaagucggagagauccaauguucguccgaggagagcgcacgcaccaucaagaaagacggauguauauggaaugccgaccucgucggaauagaacuccguguagacgacgcagucuguuacucaaaaauuaccuccguagaagcaguggcaaacuacagcgcaauaccaaccaccauaggaggccucagauucgaaagaagccaugacucacaaggcaaaaucagcggaucgccacuagacaucaccgcaauaagagggagcuucucagucaacuacaggggccucaggcuaagccuauccgaaauaaccgcgacaugcaccggcgaagucacaaacguaaguggcugcuacucgugcaugacuggcgccaaaguaucaauuaaacuccacucaaauaaaaacagcaccgcccacguacgaugcaaaggagacgaaacugcauuuagcgugcuagaaggcguacacagcuacacugucucacucagcuucgaucacgcaguagucgacgagcagugccaacucaauuguggcggacaugaaucucaagugacccuaaaaggaaaccucauauuuuuggacguacccaaauucguggacggauccuacaugcaaacauaccacucuuccguuccuaccggcgcuaacauccccuccccaacggacuggcucaacgcacucuucggcaauggccuaucgcgauggauccugggcgucauaggaguauuauugggaggccucgcacuauucuuccuaaucaugucccucuuuaagcuagguacgaaacaagucuuccgcucacgaacaaagcucgcguaa

SEQ ID NO: 16483 - RNA, 3222 nt, Artificial Sequence
  derived and/or modified CDS sequence (opt11) from SFTSV(SPL106A)__AB985316.1__GP
augaugaagguaauaugguucagcucacuaauuugucuggugauccaaugcucaggagacacaggcccgaucaucugcgcgggacccauccacagcaacaaauccgccaacauaccacaccuacuaggcuauagcgagaaaauaugccaaauugaucgacuaauccacguaaguaguuggcugagaaaccacucucaauuucaaggauauguaggccaaagaggaggcagaucgcaagucuccuacuucccagccgaaaacuccuacucacgauggagcggccuacucagcccaugugaugcagacuggcuuggaaugcucguggucaaaaaggccaaaggcucggacaugaucguccccggcccuuccuacaaaggaaaggucuucuucgaacgccccaccuucgacggcuacgucggcuggggcugcggcagcggcaaaagccgaaccgaaagcggcgaacuuugcuccucggacagcgggaccucgagcgggcuacugccaagcgaucgcguccuauggauaggagaugucgcaugccaaccgaugacccccaucccagaagaaaccuuccuggaacucaaaucauucagccaaagcgaguucccagacauuugcaagauagacggcaucguauucaaccagugcgaaagcgaaucccuaccccaaccuuucgacguagccuggauggacguagggcacagccacaaaaucaucaugcgcgaacacaagaccaagugggugcaggaaagcagcuccaaagacuucgucugcuacaaagaaggcacaggcccaugcucugaauccgaggaaaagacaugcaaaaccuccggaucgugucgcggagauaugcaguucugcaaagucgcggggugugaacacggagaagaagccagugaggccaaauguaggugcucccuggugcacaaacccggcgaagucguaguaucauacggcggaaugcgaguccgcccaaagugcuacggauucagccgcaugauggcgacgcuagaaguaaacccacccgaacaacggaucggccagugcaccggcugccacuuagaaugcaucaacggcggcguacgacugaucacacuuacaucagaacuaaaguccgccaccgugugcgccagccacuucugcuccucagccacaucaggcaaaaagagcaccgaaauacaauuccacucgggcucccucgucggaaaaacagcgauccacguaaaaggcgcccuuguagacggaacagaguucacauucgagggaagcugcauguucccggacggcugcgaugcagucgacugcaccuucugcagagaguuccucaaaaacccacaaugcuaccccgcaaagaaauggcuguucauaauaaucgucauacuccucggauacgcaggacuaaugcuacugaccaacguacuaaaagccaucggcgugugggggagcuggguaaucgccccagucaaacuuauguucgccauucucaaaaagcuaaugcgcucgguaucaugccucaugggaaaacuaauggaccgcggccgccagguaauucacgaagaaauaggagaaaaccgggaaggaaaccaagacgacguccggaucgaaauggcgcgcccacgaagagugcgccacuggauguacagcccaguaauucucacaauccucgcaaucggccuagccgaagggugugacgaggucguacacgcggacucaaagcuagucucgugcaaacaaggcagcgguaacaugaaggagugcgucacuacaggccgagcacuacucccagcugucaacccgggacaagaggcuugccuacacuucaccgccccaggcucaccagacuccaaaugucuaaaaauaaaagucaagcgcauuaauuuaaaauguaagaaaagcucauccuacuucgucccagacgccaggucuagaugcacauccguaagaaggugcagaugggcuggcgacugccagucaggaugccccucccacuucacaagcaacuccuucagcgacgacugggccgggaaaauggaccgggcaggccuaggguucucaggcugcagcgacggaugcggcggagccgcauguggcugcuucaacgccgcacccagcugcaucuucuggcgaaaaugggucgaaaacccgcacggaauaauauggaaaguaucgccaugugcagcguggguaccgucggcaguaauugaacucacgaugccauccggcgaaguaagaacuuuccaccccaugagcggcauaccaacacagguauucaaaggcguaagcguaacauacuuaggcucggacauggaaguguccgggcuaaccgaccuaugcgaaauagaggaacucaaaucgaagaaauuagcccucgccccaugcaaucaagccggaaugggaguaguagguaaagucggggaaauacaauguaguucggaagaaucagcccguaccaucaagaaagacgguugcaucuggaacgcagacuuaguagggaucgaacuucgagucgaugacgcaguaugcuacucgaaaauuaccagugucgaggccguggccaacuacagugcgauacccaccacaauuggcggauuaagauucgaacggucacacgacagucaaggaaaaauauccgggucuccccuggacauaaccgccauucgcgggagcuucucgguaaacuacagagggcucagacuaagccucagugagauuaccgccacaugcaccggagaggucacaaacgucuccgggugcuacuccugcaugaucggagcaaaaguaagcauaaaacugcacagcagcaaaaacucgaccgcgcacguucgaugcaaaggagacgaaaccgcauucagcguccuagaaggaguacauagcuacacggucucccuuuccuuugaccacgcgguaguggacgaacaaugccaauuaaacugcggagggcacgaaagccaagucacccuaaaaggaaaccucauuuuccuugacgugcccaaguucgucgauggcuccuacaugcaaacauaccacagcucggucccaaccggggccaauauacccuccccgaccgacuggcucaaugcccucuucgguaaugggcucagccgcuggauccucggaguaauuggcgugcuccuuggcggacuagcgcuauucagccuaauaaugucacuauucaaacuaggcacgaaacaaguccugaggucuagaaccaaacuugccuag

SEQ ID NO: 16484 - RNA, 3222 nt, Artificial Sequence
  derived and/or modified CDS sequence (opt11) from SFTSV(SPL117A)__AB985321.1__GP
augaugaaaguaauaugguucagcucccucauaugccucguaauccaaugcuccggggauaccggccccauuaucugugccggacccauccacuccaacaaaagcgcaaacaucccacaucuacuaggcuacagcgagaaaauuugccagaucgacagacugauacacgugaguagcuggcuacgaaaccacucacaauuucagggcuacgucggccaacgagggggacgcucccagguaucauacuuccccgcggaaaacucauacagcagauggagcgggcuacucagcccaugcgacgcggacuggcugggaaugcuggucguaaagaaagcaaaaggcagcgacaugaucguccccgggccaucauaccguggcaaaguuuucuucgaacggccaacguucgacggcuacgucggauggggcugcggaagcggaaaaaguaggacagaaucuggagaacuguguuccucagauuccggaaccucaagcgggcuccuccccagcgacagaguccuguggauaggagacguggcaugccaacccaugacccccauaccugaagaaacguuccuagaacugaaaucauucagccaaagugaauuucccgacaucugcaaaaucgacggaaucguauucaaccagugcgaaagcgagucgcuaccucaaccguucgacguggcauggauggacguuggccacucucacaaaauaaucaugcgugaacacaagaccaaauggguacaggagagcuccaguaaagacuuugucugcuacaaggaagguacgggcccaugcagcgaauccgaagagaaaacaugcaaaaccucaggcuccugccgcggcgacaugcaguucugcaaaguagcggggugcgaacacggcgaagaagccuccgaagcaaaaugcagaugcucauuaguacacaagcccggagagguagucguaucauacggaggcaugagagugcgaccuaaaugcuacggcuucagccggaugauggcaacacucgaaguaaacccacccgagcaaagaauaggccagugcacaggcugccaccuugaaugcaucaacgggggaguacgacucauaacacuaacaagugaacuaaagucggccacagucugugcaagccacuuuugcuccagcgcgaccucgggaaagaaaucaacggaaauccaauuccacucagguagucuagucggaaaaacagccauacacgucaaaggugcccucguggauggcacagaauuuacguucgaaggguccuguauguuucccgacgggugcgacgccguagacugcaccuucugcagagaauuccuaaaaaacccccaaugcuaccccgcaaagaaauggcuauucauaauaauagucaucuuacucggauacgcaggucucaugcuguuaacaaacgugcuuaaagcgaucggagucugggggucguggguaaucgcccccguaaaacugauguucgcaauuauaaagaaacugaugcguagcgucuccugccucaugggaaagcuaauggaccgcggacggcaaguaauccacgaagagauaggagaaaaccgggaaggaaaccaagacgacguccguaucgaaauggcuaggccccgcagaguucgccacuggauguacucccccguuauccuaacaauacuggccaucgggcucgcagagggcugcgacgaaaugguacacgccgauagcaagcugguguccugcaaacagggcagcggcaacaugaaggaaugugucacgacugggcgagcacuccucccagcagucaacccgggccaagaggccugccuacacuucacagcgcccgggucaccggauagcaaaugccugaaaauaaaagucaaacggauaaaccuaaaaugcaagaaaucaagcagcuacuucguaccagacgcucgaagccgauguaccagcguacgaagaugcagaugggccggagacugccaauccggcugccccucacacuucacauccaacucauucagcgacgacugggccggcaaaauggaccgcgcaggccugggcuucagcgggugcuccgacggcugcggaggcgcggcaugcggcugcuucaacgccgcgcccagcuguauuuucuggcgcaagugggucgaaaacccacauggaauaaucuggaaagucagcccgugcgccgcuuggguacccagcgccguaaucgaacuaacgaugccauccggggaaguccgaaccuuccauccaaugagcggcauacccacgcagguguucaaagggguaucggucacauaccucggcagcgacauggaggucucaggccucaccgaccuuugcgaaauagaagaacucaaaucgaaaaaacuagcacuagcucccugcaaccaagccgguaugggcgucguuggcaaggugggagaaauccaaugcagcagcgaggaaagcgcccgaaccauaaaaaaagauggcugcauuuggaacgcagaccucgucggcaucgaacuccgcguagacgacgcggugugcuauaguaaaaucacaagcgucgaagcagucgcuaacuauucagccauacccacaaccauagggggacuccgcuucgagcgaagccacgacagccaaggaaagaucucaggcucaccucucgacauaaccgcaauacgcgggagcuucagcguaaacuaccgcggacuccggcucucacucuccgaaaucaccgcaaccugcacgggagaggugaccaacgucuccgguugcuacucguguaugacuggcgccaagguaagcaucaagcuccacuccagcaaaaacagcaccgcgcacguaaggugcaagggcgacgagacugcuuuuaguguccuggaaggaguccacuccuacacagucagccucagcuucgaccaugcagugguggacgaacagugccagcucaacugcggcggacacgagucucaagucacccuaaagggaaacuuaauauuccucgauguacccaaguuuguggacggguccuauaugcagaccuaccacagcagugugcccacaggcgccaacaucccaagccccaccgacuggcucaacgcccuguucgggaacggacuuucgcgcuggauacuaggcguuauaggaguccuccuagggggucuugcacuauucuuccugauaaugagccuguucaaacuaggaaccaaacaggucuuucgcucacgcacaaaacuagccuaa

SEQ ID NO: 16485 - RNA, 3222 nt, Artificial Sequence
  derived and/or modified CDS sequence (opt11) from SFTSV(SPL120A)__AB985322.1__GP
augaugaaagucaucugguucucuucgcuaauaugccuagugauccaaugcuccggggacacaggccccaucaucugcgccggcccgauccacuccaacaaaagcgccaacaucccccaucuccuaggcuacagcgaaaagaucugccaaaucgacagacucauccacguaagcucauggcugcgcaaucacucccaguuccaaggauacguaggacaacgcggaggcagaucccaggucuccuacuuccccgcagaaaacaguuacuccagguggagcggacuccuuagcccaugcgacgcagacuggcuagggaugcucgucgucaaaaaggccaaaggaucugauaugauaguacccggaccaucauacaaagggaaggucuucuuugaacgcccgacguuugacggcuacgucggauggggaugcggaaguggcaaaagccgcaccgaaucaggagagcucuguuccagcgacuccggcacaagcucaggccugcuccccagcgaccgaguuuuauggauaggagacgucgcaugccaaccaaugaccccaauacccgaggagaccuuccucgaacuaaaaaguuucagccaaagugaguucccagacaucugcaagaucgacggcaucguauucaaccaaugcgaaucugagucccugccccaaccuuucgaugucgccuggauggacgucggccacucccacaaaaucaucaugcgggagcacaaaacgaaauggguccaagagucauccagcaaagacuuugugugcuacaaagagggcacaggucccugcagcgagucggaggagaaaaccugcaaaaccagcggaaguugccgaggagacaugcaauucugcaaaguggccgggugcgaacacggcgaagaagccuccgaagcaaagugucgaugcagccugguccacaaaccgggcgaaguaguagucucauacggaggaaugagaguacgcccgaagugcuacggauuuucacgcaugauggcaacccuagaagugaacccgcccgagcaaagaauuggccaaugcaccggaugccaccucgaaugcauaaacggaggaguccgauuaaucaccuugacgucagaacuuaaaagcgcaaccguuugcgcgucccauuucugcagcagcgcaaccagcggcaagaaaagcaccgagauccaguuucacagcggcucccucguagggaaaacagccauacacguaaaaggagcccuaguugacggcaccgaguucaccuuugaaggcuccugcauguuucccgacgggugcgacgcaguagacugcacauucugccgcgaauuucuuaaaaacccccagugcuaucccgcaaagaaauggcuauucauaauaauaguaauucuacuaggcuacgcaggccuaaugcuccucaccaacguccucaaagcuaucggcguauggggcagcuggguaauagccccagucaaacuaauguucgcaauccuaaagaaacucaugcgaucagucucuugccucaugggaaaacugauggaccgcggacgccaggucauacacgaagaaaucggagaaaacagagaaggcaaccaagacgacgugcgaaucgagauggcacgcccacgcagagucagacacuggauguacagcccaguaauccucaccauucuggccaucggacucgcagaagguugcgaugaaguaguacacgcagauuccaaacuggucucaugcaaacagggauccggaaacaugaaagaaugcguuacaacuggcagagcccugcucccagcggucaacccaggacaagaagcgugccugcacuucaccgccccugggucaccggacaguaaaugucuaaaaaucaaaguaaaaagaaucaaccucaaaugcaagaaaaguucguccuacuuugucccagaugcacggucacgcugcacgagcguccggcgcugcagaugggcaggcgauugccagucaggaugcccaucccacuucacaucuaacucauucagcgacgacugggccggcaaaauggaccgagcaggccucggguucucaggcuguuccgauggaugcggaggcgcagcgugcggaugcuucaacgcagcucccuccugcauauuuuggagaaaauggguggaaaacccccacggcauuaucuggaagguauccccaugugccgcauggguacccucagccgucaucgaguugacaaugccaucaggcgaaguccgaacauuccaccccaugagcggaauccccacccaagucuucaagggcguauccguaaccuaccuaggauccgacauggaagugagcggucucaccgaccugugcgaaaucgaagaacuaaaaaguaaaaagcucgcccucgccccaugcaaccaggcgggaauggguguuguaggcaaaguaggagaaauccaaugcuccagugaagagagcgcaagaaccauaaagaaagauggcugcaucuggaacgcggaccucgugggcauagaacucagagucgacgacgcggucugcuacagcaaaaucacaucagucgaagcaguagcaaacuacuccgccaucccgacaaccauagggggccuaagguucgaacgcucacacgacucucagggaaagaucucaggcagcccucucgacauaaccgcaauacggggauccuucagcgucaacuaccgaggucuccggcugagccucucagaaauaacagcgacgugcaccggcgaaguaaccaaugucuccggaugcuacucgugcaugacgggugcaaaaguaagcauaaaacuucauuccuccaaaaacucaaccgcgcacguacggugcaaaggcgacgaaaccgcauucucaguacuggaaggaguacacagcuacacagucucacuguccuucgaccacgccguaguggaugaacaaugccaauugaauuguggaggccacgagagccaagugacgcucaaaggcaaucucaucuuccuggacgucccaaaauucguagacggcucuuacaugcaaacguaccacucgucaguuccgaccggcgcuaacauccccagcccaaccgacuggcucaacgcccuauucggaaacggacucucgagauggauccuaggugucauagggguccuacuggguggccucgcacucuucucacuaauaaugagucuuuucaaacucggaacaaaacagguauuccgaaguaggacaaagcucgccuga

SEQ ID NO: 16486 - RNA, 3222 nt, Artificial Sequence
  derived and/or modified CDS sequence (opt11) from SFTSV(SPL121A)__AB985323.1__GP
augaugaaagugauaugguucuccucccucaucugccucguuauccagugcucaggcgacaccggcccaauaauaugcgcaggcccaauccacagcaacaagagcgcuaacauaccucaccuacucggauauagcgagaaaauaugccaaauagaccgccugauccacgucagcuccuggcuacgcaaccacucgcaauuccaaggcuacguuggacaacgcggcggacggagccaaguauccuacuucccggcagagaacucauacuccagguggagcggucugcugagcccaugcgacgccgacugguuagguaugcuagucguuaagaaagccaaaggaucugacaugauaguuccaggacccucauacaaagguaaaguauucuuugaaaggccuacauucgacggcuacgucggcuggggaugcggcuccggaaaaagcaggaccgaaagcggagaacucugcagcuccgacagcggaacaagcucaggacuccugccaagcgaccgcguacuuuggaucggcgacgucgcuugucaacccaugacccccaucccggaggaaaccuuccuagagcuaaaauccuucucccaaucagaauuucccgacaucugcaaaauagacggcauuguauucaaccagugcgaaagcgaaucacuaccgcagcccuucgauguagccuggauggacguaggccacucccacaagauaaucaugagggaacacaaaacgaaguggguccaggaauccagcccaaaagacuucguaugcuacaaggagggaacaggucccuguagcgagagcgaagaaaagaccugcaaaacaucaggcuccugcaggggcgacaugcaauucuguaaagucgccgggugcgaacacggggaagaggcaagcgaagcgaaaugccgaugcagccucguccacaaaccaggcgaaguaguaguaaguuacggcggcaugcgcgugcggccaaagugcuacggauucuccaggaugauggcaacccuugaggucaacagccccgaacagcguauaggacaaugcaccgggugucacuuagaaugcauaaacgggggcguacgucuuauaacacuaacaagcgaacuaaaaucagccaccguaugcgccagucacuucugcuccagcgcaaccagcgggaaaaagaguacagaaauacaauuccauuccggcucacucguaggcaaaacagccauccacgucaaaggagcgcuaguagacggaacagaguucacauucgaaggcagcugcauguuccccgacggcugcgacgcaguagacugcacauucugucgcgaguuccucaaaaacccacaaugcuacccagccaagaaauggcuauucaucaucaucguaauccuacuaggauacgccggccugaugcuacucacuaauguacucaaagcaauaggcgucuggggaucuuggguaaucgcacccguaaaacucauguucgcuaucauaaagaagcucaugagaagcguaagcugccugaugggcaaauuaauggaccgcggccgccaggucauacacgaagaaaucggcgaaaacagggaaggcaaccaagaugauguacggaucgaaauggcccgcccacgacgaguccgacacuggauguauagcccgguaauccucacaauccuagcaaucggccuagccgaaggaugcgacgaaaugguacacgccgacucaaaacuggucucaugcaagcaaggaucaggaaacaugaaagaauguguaacuacgggaagggccuuacuaccggcaguaaauccgggacaggaagcaugccuacacuucacugcaccgggcagcccagacucaaaaugucucaaggucaaaguuaaacgaaucaaccuaaaaugcaagaaaucaucaucauacuucguaccugacgcacggucgcgcugcacaagcguccgucgcugcagaugggccggcgacugccagaguggcugcccaagccauuucaccagcaacuccuucagugacgacugggcagggaaaauggaccgagcaggacugggcuucucuggcuguagcgacggcugugggggcgccgcaugcgggugcuucaacgcggcacccagcugcauuuucuggcgcaaauggguggaaaacccacauggaaucauauggaaaguauccccaugcgccgccuggguaccaucggccguaauagagcugacaaugcccucaggagaaguccggacguuccacccaaugagcggcauccccacccagguuuucaaaggcguaagcgugaccuaccucggauccgacauggaaguaucuggauugaccgaccugugugaaauggaagaacuuaaaagcaagaaacuagcacucgcucccuguaaccaagccggcaugggagucgucggaaaaguaggagagauacaaugcagcucagaagaaagugcacgcacaaucaagaaagacggcugcaucuggaacgccgaccuggucggcauagaacuacgaguagacgacgccgugugcuauucuaaaauaaccagcguugaagccgucgccaacuacagugccauccccacaacaaucggcggacuacgcuucgaacgcagccacgacagccaaggcaaaaucucaggcucaccgcucgacaucacagcaauccggggaucauucucugucaacuacagaggacuacggcuuagccucagugaaauaaccgccacaugcacgggcgaggucaccaauguguccggcugcuauuccuguaugacgggggcuagggucagcaucaaacuacacaguaguaaaaacuccacagcacacguccgaugcaaaggcgacgaaacggccuucucaguccuggaaggcguccacuccuauacagugagccugagcuucgaccacgcaguagucgacgaacaaugccaacugaacugcggcggacacgaaucacaggucacucuaaaagguaauuugaucuuucuugacguccccaaauuugucgacggcagcuacaugcaaaccuaccacuccagcgucccaaccggagccaacauaccgagccccaccgacuggcucaacgcacucuucggcaacggucugucgcgguggauccucggcguuauaggaguacucuuagggggacucgcacuauuuuuccuaauaaugucacucuucaagcuaggaacaaagcaagucuucaggucgcguaccaaacucgccuaa

SEQ ID NO: 16487 - RNA, 3222 nt, Artificial Sequence
  derived and/or modified CDS sequence (opt11) from SFTSV(SPL124A)__AB985324.1__GP
augaugaaggucauaugguucaguucgcuuauauguuuagugauccaaugcuccggcgacaccgggcccauaauaugcgcgggcccaauacacagcaacaagagcgccaauaucccgcaucugcuaggauacucagagaaaaucugccaaauagaccgucucauacacguaagcucguggcuacgcaaccacucgcaauuucaaggguaugugggccagagagggggaaggagccaaguauccuauuuccccgcagaaaauucauacucacgguggucaggacugcugagccccugcgacgcagacuggcuaggaauguuagucguaaagaaagccaaaggaucggacaugaucgugcccggacccucauacaagggcaaagucuucuucgaaaggcccacauuugacggguacguaggauggggcuguggcucgggaaaaagcagaacagaauccggagaacuaugcuccagcgauagcggaacaucgagcggccuauugcccagcgacagagugcucuggauuggggacguagccugccagccuaugacucccauaccugaagagaccuuccuggagcucaagagcuucagccagucagaguuccccgauaucugcaaaaucgacggaaucguauucaaccaaugcgaaucagaaagccuaccccagccguucgacguagcauggauggacguggggcacucacacaagaucauuaugagagagcacaaaacaaaauggguccaagagucgagcuccaaggacuucgucugcuacaaagagggaacuggaccaugcuccgaaucggaagagaaaacuugcaaaacgagcggaucgugccggggcgauaugcaguucugcaaaguagccggaugcgagcacggcgaagaagcgagcgaagcuaaaugccgcugcagccugguccauaaaccaggcgaagucgugguaucauacggcggaaugcgagugcgaccgaaaugcuacggcuucucacgcaugauggcgacgcucgaagugaacucccccgagcaacgcaucggacaaugcacgggaugccacuuagagugcauaaacggagggguccggcuuaucacgcucaccagcgaacucaaauccgcaaccguaugcgcgagccacuucugcagcucagccacaucagggaaaaagagcaccgaaauacaauuccacagcggcucccucgugggaaaaacggccauacauguaaaaggcgcccucguggacggcacagaguucacguucgaaggcucaugcauguuccccgauggaugcgacgccguggauugcaccuucugcagagaguuucugaaaaauccacaaugcuacccggcaaagaaauggcuauucauaauaaucguaauacuacuaggguaugcgggccuaaugcuccuuacgaacgugcucaaagccauaggagugugggggagcugggucauagcuccaguaaaacuaauguucgccauuaucaaaaagcucaugagaucagucagcugucuaaugggaaagcugauggaccgcggcagacaagucauucacgaggaaauuggcgaaaacagagaagggaaccaggacgacgucaggaucgagauggcgcgccccagaaggguaagacacuggauguacagcccagucauacugacuaucuuggccauaggucuagcagagggaugugacgaaauggugcacgcggacuccaagcuaguaucuuguaaacaagggagcggaaacaugaaagaaugcguaaccacagguagggcacugcuacccgcagugaacccgggacaggaggcaugccuacacuucacggcgccaggcagcccagacucaaaaugccuuaaaauuagagucaaaagaaucaaccuaaagugcaagaaaucaucauccuacuucgugcccgaugccagaagccgcugcacauccgugagaagauguaggugggcgggggacugccagagcggcugcccaagccacuucacaagcaacuccuucagcgacgacugggcaggaaaaauggacagagccgggcugggauucucaggcugcagugauggcugcgguggggcagcaugcgggugcuuuaacgcagcaccgagcugcaucuucuggagaaaaugggucgaaaacccgcacgggaucauauggaaagucucgccaugcgcagccuggguacccagugcaguaauagaacucacaaugccaucaggagaaguccgaacuuuccaccccaugagcggaauaccaacccagguauucaaaggaguaucaguaacauaccucggcuccgacauggaagugucgggucuuacagaccuaugcgaaauagaggaacugaaaucaaagaaauuggcacuagcacccugcaaccaggcgggaaugggagucgugggcaaagucggggaaauacaaugcagcagcgaagagagcgcgcgcacaauaaagaaagaugggugcauauggaacgcagaucuggucgggaucgagcuccgagucgacgacgcaguaugcuauucgaagauaaccucaguagaagccguagccaauuacuccgccauacccacuacgaucgguggacuccgcuucgaacgcucgcaugacagccaaggaaaaauauccggcaguccccucgacauaaccgcuauaaggggcagcuucagcguaaauuacagaggccuccgccugucauugagcgaaauaacagccacgugcacuggagaagucaccaacguguccggaugcuacucgugcaugacgggggcucguguaagcauaaaacugcacuccagcaaaaacucaaccgcgcacgugagaugcaaaggagacgagaccgccuucagcguacuugaaggggugcacagcuacaccguaagccugagcuucgaucacgccgugguagacgaacagugucagcuaaacuguggcggacaugaaucucaagugaccuugaagggcaacuuaauauuccuagacguuccaaaauucgucgauggcucauacaugcaaacauaccauaguagcguaccaacaggcgcaaauauccccuccccaaccgacuggcuaaaugcccuauucggaaacggccugucaagguggaucuuaggagugauaggaguacuauuaggcggacucgcccucuucuuccugauaauaagucuauucaaacuaggaaccaaacaaguauuccgaagccggaccaaacuagcguga

SEQ ID NO: 16488 - RNA, 3222 nt, Artificial Sequence
  derived and/or modified CDS sequence (opt11) from SFTSV(SPL128A)__AB985325.1__GP
augaugaagguaauaugguucuccucccuaauaugucuaguaauccaaugcagcggcgacacaggucccaucauaugcgccggcccaauccacuccaacaagucggccaacauaccccaccuacucggauacagugagaaaauaugccaaauagauaggcuaauccacgucagcucguggcugcgaaaccacucgcaauuccaagguuacgucgggcagaggggcggcagaucgcaagucaguuacuuccccgcagaaaacagcuacucgagaugguccgggcuauuaucaccaugcgacgcggacuggcuugggaugcucgucguaaagaaagcuaaaggcuccgacaugauugucccaggacccucauacaaaggaaaaguguuuuucgaacguccaacuuucgauggauacgugggcuggggauguggcuccgggaaaagccgcacagaaucaggagaacuuugcuccagcgacagcggcacauccucgggacucuuaccuucagaccgggugcuauggaucggcgacguagccugccaaccaaugacccccauccccgaagaaaccuuccucgaacugaaaucauucagucaaagcgaguucccggacauaugcaagaucgacgggauuguauucaaccaaugcgaauccgaaucccuaccacaacccuucgacguagccuggauggacgucggccacucgcacaaaaucauaaugcgugaacacaaaaccaaauggguccaagaauccagcucgaaggacuucgucugcuacaaagaaggcacagggccaugcagcgaaucagaagagaaaacaugcaaaacaucaggcucaugucggggagauaugcaauucugcaaaguugcaggaugcgaacauggugaagaagcauccgaagccaagugccgcuguucccuuguccacaaaccaggagaagugguuguaucauacggcgggaugcgcguccgacccaaaugcuacggguucagccgaaugauggcaacgcucgaggugaacucccccgagcaacgcaucggccaaugcaccggcugccaccucgagugcauaaacggcggaguccgacucaucacccugacaagcgaacucaaaagugcaacagugugcgcuagccacuucugcagcuccgccaccuccggaaagaaaagcacagaaauucaauuccacucgggcagccucgucgggaaaaccgcaauacacgucaaaggcgcacucgucgacggaacagaguucacauucgaaggaucaugcauguuuccggacgggugcgaugcagucgacugcaccuucugcagggaguuccucaaaaacccccaaugcuaccccgcaaagaaauggcuauucaucauaaucgucauacugcucggguacgccgggcuuaugcuccuaacaaacguccucaaagcaaucggcgucuggggcagcuggguaauugcccccgugaaacuaauguucgcaauaaucaagaaacucaugcgaucagucagcugucucaugggcaaacucauggaccguggacgacaagugauacacgaagagauaggagagaacagggaagggaaccaagacgacguuagaauagaaauggcacgcccgcgaagggucagacauuggauguacucccccgucauucuaacgauccuagcaauaggacuagcggagggaugcgacgaaaugguacaugcagacucgaaauuagucucaugcaaacaggggagcggaaacaugaaagagugcguaacgaccggcagagcccuacucccugccgucaaccccggccaggaagccugcuugcacuucaccgcacccggaaguccagacucaaaaugccucaaaauccgaguuaaacgcauaaaccuaaaaugcaagaaauccucaagcuacuuuguaccagaugccaggagccgcugcaccuccguucgacguugccgcugggccggcgacugccaguccggcugccccagccacuucacaagcaacagcuucagcgacgacugggccgggaaaauggacagagcaggccucggauucagcggcugcucagacggcugcggaggggcagccugcggaugcuucaacgcagcuccaagcugcaucuucuggagaaaauggguagaaaacccacacggaauaaucuggaaagucagccccugcgcagcgugggugcccagcgccguaauagaacucacgaugccuuccggggaaguacgaaccuuccacccaauguccggcauccccacgcaaguauucaaaggagucucaguuacauaccucggcagcgacauggaaguaagcgggcuaacggaucuaugcgaaauagaagaacuaaaaucaaagaaacucgcccuagcuccaugcaaccaggccgggaugggagucguaggcaaaguaggagaaauccaaugcagcagcgaggaaagcgcacgaacaauuaagaaagacggcugcaucuggaaugcggaccugguggggauagaacugcgagucgacgacgcagucugcuacagcaaaauaacaagcgucgaggccguagccaauuacucggcaauccccaccaccauaggcggcuuacgguucgaaagaucacacgacucgcagggcaaaaucucagguucacccuuagauaucacagccauccgcggcucauucagugucaacuaccgaggccugagacuaagccuaagcgaaauaacagcuaccugcacaggagaagucaccaacguauccgggugcuauuccuguaugacuggcgcccgcguauccauuaaacuccacuccagcaaaaacucgacggcacacguccgaugcaaaggagaugaaaccgccuucucgguccucgaagggguccacuccuacaccgucucacuauccuucgaccacgcggucgucgacgaacagugccaacucaauugcggaggccacgagucgcaagucacccuuaaaggaaacuuaaucuuccuggacguaccuaaauuuguagauggauccuacaugcagacuuaccacucuuccguaccaaccggcgccaacauacccagucccaccgacuggcugaacgcacucuucggcaacgggcucucaagguggauacucggagcaauaggcguguuauuaggcggacuagcccucuucuuucugaucaucagccuauucaaauuaggaacuaaacaaguauuccggagucgcacaaaacucgcauga

SEQ ID NO: 16489 - RNA, 3222 nt, Artificial Sequence
  derived and/or modified CDS sequence (opt11) from SFTSV(SPL129A)__AB985326.1__GP
augaugaaagugaucugguuuagcagccugauaugccucguaauacaaugcuccggcgacaccgggcccauaauaugcgcaggacccauucacagcaacaaauccgcaaacaucccacaucuccugggauacucagagaaaaucugccaaauugaccgacuaauccacguaucgagcuggcuaagaaaucacucacaauuccaaggauacgucggccagcgcgggggaaggagccaggucagcuacuacccagcagaaaacagcuacagcagauggaguggacuccugagcccaugugacgcggacuggcuaggaaugcuuguggucaagaaggcaaaaggcagugacaugauugucccaggccccagcuacaaaggcaaaguauucuucgaacgccccacuuucgacggauacguaggguggggcugcggcagcggcaaaucacgaaccgaaagcggagaacugugcucaagugacucaggcacauccucgggccuacugccaagcgaccgaguccuauggaucggggacgucgcaugccagcccaugacaccaaucccagaagaaacguuccuagaacuaaaaucauucagccaaucagaguucccagacauaugcaagaucgacggaauagucuucaaccaaugcgaaagugaauccuugccccagcccuucgacgucgccuggauggacgucgggcacagccacaaaaucauaaugcgagaacacaaaacaaaguggguccaagaaucaagcuccaaagacuuugucugcuacaaagaaggcacaggaccaugcagcgagagcgaggaaaagaccuguaaaaccucaggcucaugcagaggcgacaugcaguucuguaaagucgcaggcugcgaacacggagaggaagccagcgaagccaaaugccgcugcagccuaguacacaaaccaggcgaagucgugguaucauacggagggaugcgcguccgaccaaaaugcuacggauucucgcgcaugauggcuacgcuagaaguaaacccgcccgaacaacgcaucggacaaugcaccggcugucaucucgaaugcauuagcgggggcguacgccucauaacccucaccagcgagcuaaaauccgccaccgucugugccucacacuucugcaguucagccacauccggaaagaaauccaccgagauacaguuucacucagggagccucgucgguaaagcagcgauccacgucaaaggggcacucguagacgggacagaguucacauucgaaggaagcugcauguucccugacgggugcgacgccguggacugcacguuuugccgggaguuccuuaaaaacccgcaaugcuaccccgccaagaaauggcuauucaucauaaucguaauccuccuaggauacgccggucucaugcuucugaccaacguccucaaagcaaucggcguauggggcaguuggguaauugccccagucaaacugauguucgccauaaugaagaaacucaugcgaagcguaagcugccucaugggaaaacuaauggaucgcggacgccaagucauacacgaagaaauaggcgaaaacagggaaggcaacagagacgacguacgcauagaaauggcgcgcccccgaagaguacgccacuggauguacagcccugucauacuaacaauccucgcaauaggccuugccgaaggcugugacgaaaugguccaugccgauagcaagcuagucagcugccgacagggcucaggaaacaugaaagagugcgucaccaccggacgcgcacuacuacccgccguaaaccccggccaagaagcaugcuugcacuucacagcccccggaucaccagacaguaaaugucuaaaaaucaaaguuaaaaggauaaaucuaaaaugcaagaaaagcucgucauacuucgucccagacgcacgaucacgaugcaccagcgugagacgaugccgcugggccggagacugccaguccggcuguccuucacauuuuacguccaacagcuucucagacgacugggcagggaaaauggacagagccggacucggauucucaggcugcucagacggcugcggaggcgcagcaugcgggugcuuuaacgccgcacccagcugcauauucuggcgcaaauggguagaaaacccacacgguaucauauggaaaguaucacccugcgcggcaugggugccaagcgcuguuaucgaacugacgaugccaucaggcgagguccgcaccuuucaucccaugagcggcauccccacgcaaguauucaaaggugugagcgugacauaccucggaucagacauggaggucagcggccuaacagaccucugcgaaaucgaagaacugaaaagcaagaaacuagcccucgcgccgugcaaccaagccggaaugggggucgucggcaaagugggcgagauacaauguagcagcgaagaaagcgcccgaacaauuaagaaagauggcugcauuuggaacgcagaccucgugggcauagaacuaagggucgacgacgcggucugcuacagcaaaauaacaucgguggaaaccguggccaauuacagugccauacccaccacaauaggcggacugcgcuucgaaagaucccacgauagccaaggaaaaauaagcgggucaccacuagacaucaccgccaucagaggcagcuucaguguaaacuacagaggccuaaggcuauccuuauccgagauaaccgcaacgugcacaggagaagucacgaacguaagcggaugcuacucaugcaugacaggggcaaaaguaucgaucaaacugcacagcuccaaaaacucaacagcacacguccgcugcaaagaggacgagaccgccuucagcguacuagaaggcguacacagcuacacugucucgcucagcuuugaccacgcagugguagacgaacaaugccaacuaaacugcggcggccacgaaucacacguaacacugaaaggaaaccugaucuuucuagacgugccaaaauucguagacgggucguauaugcaaacauaccacuccuccgugccgacaggagcaaacauaccguccccuacagacuggcucaaugcgcuauuuggcaacggccuuucccgauggauacugggagucaugggggugcucuugggaggccuagcacuguucuuucugauaaugagccuauucaaacuagggacaaaacaggucuucaggagccgaaccaaacucgccuag

SEQ ID NO: 16490 - RNA, 3222 nt, Artificial Sequence
  derived and/or modified CDS sequence (opt11) from SFTSV(YG1)__AB817987.1__GP
augaugaaaguaauaugguucagcucgcucauaugccugguaauacaaugcucaggcgacaccggaccgaucauaugcgcaggaccaauucacagcaacaagucagccaacauaccacaccuccucggguacuccgagaaaauaugucagaucgacaggcugauucacguaucaagcuggcuacgcaaccacagccaauuccaaggauacguaggacaacgcggaggacgaagccaagucagcuacuuucccgccgaaaacucauacuccagauggucaggacugcuaagcccaugcgacgcggacuggcugggaaugcuagucguuaaaaaggcaaagggaucugacaugauugugccgggucccucguacaaagguaaggucuucuucgaacgacccacauucgacggauacgugggcuggggaugcggaucaggcaagagcagaacagaaagcggcgaacucugcucaagcgacuccgggacgagcuccggccuacuaccgucggacagagugcuuuggaucggggacgucgcgugccaaccaaugacacccaucccagaagaaaccuuccucgaauuaaagagcuucucucaaagcgaguucccagauauaugcaaaauagacggaaucguauucaaucaaugcgaaagcgaaagccuaccucaaccauucgaugucgccuggauggacgucggacacagucacaaaaucaucaugcgugaacacaaaacaaaauggguccaggaaagcagcucaaaagacuucguaugcuacaaagaaggcaccggaccaugcucggaauccgaagagaaaaccugcaaaacaucaggauccugcagaggcgacaugcaauucugcaagguagccggaugcgaacacggagaagaaacauccgaagcgaaauguaggugcagccuggugcacaaaccaggugagguuguggucagcuacgggggcaugagaguccgcccgaaaugcuacggguucucccgcaugauggcgacccucgaggugaacccaccugaacaaagaauugggcaaugcaccggaugccaccuggaaugcauaaacgguggaguaagacuaauuacacuaacuagcgaacugaaaagcgcaacugucugcgcgucccacuucugcuccagcgcaacgaguggcaagaaaagcacagaaauccaauuccacucuggcagcuuaguaggaaaaacggcaauacacguaaaaggagcacugguagacggcacagaguucacauucgaaggcucaugcauguucccagacggaugugacgccguagacugcaccuucugccgcgaguuccucaaaaacccacaaugcuacccagcaaagaaauggcuauuuaucauaaucgucauccuccugggguacgcaggacugaugcuccuaacgaacguacuaaaagcgauaggaaucuggggaagcuggguuauagccccggugaaacuaauguuugcaauaauaaagaaacugaugagaucagucagcugccucaugggaaaacuaauggaccgcggccgccaagucauccacgaagaaauaggcgaaaacagagaagguaaucaagaggauguacgcaucgaaauggcccgcccgagacguguucgacacuggauguacuccccaguaauacuugccauacuagcaaucgggcucgccgaaggaugugacgagaugguacaugcggacagcaagcuaguaucaugcaaacaaggauccggaaacaugaaagaaugcguaaccacaggacgagcccuccucccagccgucaacccgggacaagaagccugccuccacuucacagcacccggaagcccagacuccaaaugccugaaaauaaaaguaaaacgaauaaaccucaaguguaagaaaucaucgucuuacuucguccccgacgcacgaucccgaugcacguccgugcgacgauguaggugggcaggcgacugccagucuggcugcccaagccacuucacaucaaacuccuucuccgacgacugggccgggaaaauggaccgcgccggccucggcuuuucaggcugcagcgacggaugcggcggcgcggcaugcgggugcuuuaacgccgcuccaagcugcaucuucuggcgaaaauggguggagaacccacacggaauaaucuggaaaguuucgcccugugcagccuggguaccuucugccgugauagagcugacgaugccaagcggagaggugcgcacauuccaucccauguccggaauccccacccaagucuuuaaaggaguaucggugacguacuuaggaucggacauggaggucucaggacuaaccgaccugugcgaaauugaagaacuaaaauccaaaaagcucgcccucgcccccugcaaccaggccggaaugggcguaguagggaaagucggagaaauacagugcagcucagaagaaagcgcacgcaccaucaagaaagacggcugcaucuggaacgcagaccuagugggcaucgaacuccggguagacgacgcggugugcuacagcaaaauaaccagcguagaggccguagccaacuacucagccauaccgaccacgaucggaggacuccgguucgaaaggucccacgacagccaaggcaaaauauccggcucaccacucgacauaaccgccauucgcggauccuucuccguaaacuacagagggcuacgccucucccuguccgagauaacagccacuugcacaggcgaaguaaccaacguaaguggcugcuacucgugcaugaccggcgcgaaagugagcauaaagcugcacucaagcaaaaacuccacggcgcacguacgcugcaaaggcgacgaaaccgcguucagcguccucgaaggcguccacucauacacagucagccuaucauuugaccacgccguuguggacgaacaaugccaacuaaacugcggaggucacgaaagccaggugacccucaaaggaaaccucaucuuccuagaugucccuaaauucguugacggaucauauaugcaaacauaccacagcucaguaccaaccggagccaacaucccaucaccaacagacuggcuaaacgcacuuuuuggcaaugggcuaucacgguggauuuuaggcgucauaggcguccuccuaggcggccuggcacuguucuuccucauaaugagcuuguuuaaacuagguaccaaacaggucuuucgaagcagaacuaaacuagccuga

SEQ ID NO: 16491 - RNA, 3222 nt, Artificial Sequence
  derived and/or modified CDS sequence (opt11) from SFTSV(SDTA_1)__KX641913.1__GP
augaugaagguuauaugguucagcucgcuaauaugccuaguaauccaaugcucaggagacagcggcccgaucauaugugcgggcccaauacacucgaacaaauccgccggaaucccccaccuacuuggauacagcgaaaagaucugccaaauagacagacugauccacgucucauccuggcugcgaaaucacucacaauuccaaggauacguaggacaacgcggaggccguagucaggucuccuacuauccugcagaaaacuccuacagccgcuggagcggacuacuaagcccuugcgacgccgacuggcuggggaugcucgucgugaaaaaggcacgagaaucagacaugauagugccaggccccagcuacaaaggaaagguuuucuucgaacggccaaccuuugauggcuacgugggcuggggcugcggaucaggcaaaucaaggacagaguccggagaauugugcaguucggacagcgggacaaguagcggccuacucccaucggaccgaguacuguggauaggagacguagcaugccaauuaaugacgcccauaccagaagaaacauuccuagaauuaaaaucauucagccagucggaguucccugauaucugcaagauugacggaaucguguucaaccaaugcgagggagaaucacuaccacagcccuuugauguagccuggauggacguaggacacucacacaagauaauaaugagggaacacaaaacgaaauggguacaggagagcagcucgaaggacuucguaugcuacaaagagggcacaggaccaugcucggaauccgaggaaaaagcaugcaaaaccagcggcaguugccgaggcgacaugcaguucuguaaaguggcagggugcgagcacggcgaagagacuuccgaagcaaaaugcagaugcagucugguccauaaaccaggagaaguuguagucagcuacggaggcaugcggguacggcccaaguguuacggguucucgcgcaugauggccacgcuggaagucaauccgcccgagcagcgaauaggacaaugcacagggugccaccuagaaugcauaaacggggguguacggcuaauaacgcuaacauccgagcuaaggucagccacagugugcgcaagccacuucugcagcagugccagcucaggcaagaaaagcaccgagauccacuuucacagcggcagucuaguaggaaagacagccauucacguaaaaggcgcccuaguagacgggacagaguucacauucgaagggucuuguauguuccccgacggcugcgacgccguggacugcacauucugcagagaguuccugaaaaacccccaaugcuacccggccaagaaauggcuauucauaaucaucguaauucuacuaggauacgccggccucaugcuacucacgaacgugcucaaagccauaggcgucuggggaagcuggguaauagcgccggucaaacucauguucgcuauaaucaaaaagcugaugcgcacagugucaugccuaguuggaaaacuuauggacagaggaagacaggucauccacgaagaaauaggagaaaacggcgaaggaaaccaggacgacguccggaucgaaaucgcuagaccacggagagucagacacuggauguacagccccgucauacuaaccauacuagcaauaggccuggccgagggaugcgacgagaugguacacgcggacucaaagcucguaagcugccggcaaggaagcggaaauaugaaggagugcaucaccacaggcagggcccuacuaccggccguaaaccccggccaagaggcuugccuccauuucacagcacccgggagcccggacagcaagugccuaaaaaucaaagucaaaagaauaaaucucaaauguaaaaagagcaguucguauuucguaccggacgcacgaagccggugcacaucgguacggagguguagaugggcgggagacugucagaguggcugucccccacacuucaccagcaacaguuuuagcgacgacugggcggggaaaauggaccgggcgggacugggauucucaggaugcagcgacggaugcggcggagcagcaugcgggugcuucaacgcugccccaucgugcaucuucuggaggaaauggguagaaaacccacauggaauaaucuggaaaguaagccccugcgccgcgugggugccgagugccgucaucgaacuaaccaugccgagcggggaaguaagaacuuuccacccgauguccggcauuccgacacaggucuucaagggaguaaguguaacauaucuggguucggacauggagguauccggacuaacagaccuaugugaaaucgaggaacucaaaagcaagaaauuagcccucgcaccaugcaaccaggcaggaaugggaguaguaggaaaagucggagaaauacagugcagcuccgaagagagugcgcgaacaaucaagaaagauggcugcaucuggaacgcggaccuggucggcaucgaauuaaggguagacgacgccguaugcuacagcaaaauaacaagcguagaggcaguagcgaacuacuccgccauacccacaacaauaggcggacucagguucgaacgcagccacgacucacaggggaaaauaucaggcaguccgcuggacauaacagcaaucagaggaaguuucucgguaaacuauagagggcuaaggcuaagccuaagcgagauaacagccacuugcacaggggaagucacaaacguaucagggugcuacagcugcaugacaggcgcaaaagugagcaucaaacuccacucuagcaaaaauuccacagcacacguccgaugcaaaggugacgaaacagcguucagcguacuagaaggcguccacagcuacaucgugucgcuaucauucgaccacgccguggucgacgagcaaugccagcuuaacugcggaggacacgaaucacaaguaacccuaaaagggaaccuaaucuuccuagacgucccgaaguuuguagacggaaguuacaugcaaaccuaccacagcacaguuccgacaggagcgaacauaccgagcccgaccgacuggcucaacgcacucuucggaaacggucugagcagauggauacugggggugauagggguacuacugggaggucuagcccucuucuuccuaauaauguuccuacugaaacugggaacaaagcaaguguuuagaucccgaaccaagcuggccuga

SEQ ID NO: 16492 - RNA, 3222 nt, Artificial Sequence
  derived and/or modified CDS sequence (opt11) from SFTSV(SDTA_2)__KX641914.1__GP
augaugaaagucauaugguuuagcucacucauaugccuagucauacaaugcagcggggacucagggccaaucauaugcgcgggacccauccacagcaacaaaucagcggggauuccucaccuacuaggguauuccgagaaaaucugccagauagaccggcuaauacacgucuccucguggcuacgaaaucacucgcaauuccaaggauacguaggucagagaggaggaaggucacagguuucguacuaccccgcggaaaacagcuacagccgguggucuggauuguugucucccugcgacgcagacuggcucggaaugcuagucgugaaaaaggcgaaggaaucggacaugauaguuccggggccaucguacaaaggcaagguguucuucgaaagaccgaccuuugacggguacguaggcugggggugcggaucaggaaaaagccgaacugaauccggagaacugugcucgagugacucagggaccucaucaggacuucuacccuccgacaggguacuauggauaggggacgucgcaugccaaccuaugaccccgaucccugaagaaacauuccucgaacuaaaaucauucagccaaucggaguuccccgacauaugcaagauagacggaauuguauucaaccagugcgagggugagagccuaccacagcccuucgacguggccuggauggacgucggccacucccacaaaauaauaaugagagaacacaaaacaaaauggguccaagaaagcagcucgaaagacuucguaugcuauaaagaaggaacaggcccaugcucagaaucggaggagaaggcgugcaagacgucgggaucgugccgaggggacaugcaauucugcaaggucgccggaugcgaacacggagaagaagcaucagaagcaaaaugccgauguagccuggugcacaagccaggcgaggucgugguaucguacggaggaaugcgcguaagaccaaaaugcuacggguucucaagaaugauggccacccuagaagugaacccgcccgagcacaugaucggacaaugcacugggugccaccuagaaugcauaaacggcggcguccgacugaucacgcugacgagcgagcucagaagugccaccgugugcgcgucccacuucugcagcuccgcaucgagcggcaaaaagagcacagaaauccacuuccacagcggaucgcuagugggaaaaacggcgauacaugucaagggcgcacucgucgacggcaccgaguucacauucgaaggcucaugcauguuucccgacggcugcgaugcaguggacugcacauucugccgagaguuccucaaaaacccgcaauguuaccccgcaaagaaauggcuguucaucauaaucguaauccuccuaggcuacgcaggacugaugcuacuaaccaacguacuaaaagccaucgggguauggggaaguuggguaaucgccccggucaaacuaauguucgcgauuaucaagaaacuaaugagaacaguaucaugccuagucggcaaacucauggaccgcgggagacaggugauacacgaagaaauaggcgaaaacggagaaggaaaucaagaugacguccgaaucgagauggcucgcccgcgccgcguucgacacuggauguacagcccagucauacugacgaucuuggcaaucggguuggccgagggcugcgacgagaugguacacgcagacucgaaacugguaucgugccggcaagggagcgggaacaugaaagagugcauaacaacagggagagcacugcuaccggcagugaaccccggacaagaagcaugccuccacuucaccgccccaggaagcccagacuccaaaugccugaagaucaaaguaaagagaaucaaccugaaaugcaagaaaagcucuagcuauuucgugccagacgcaagauccagguguacaagcguccgcagauguaggugggcgggcgacugccaaaguggcugcccaccacauuucacgagcaacucauucagcgacgacugggcuggaaaaauggaccgggcaggacucggguucucgggaugcucagacggcugcggaggggcagcgugcggcugcuucaaugccgccccauccugcaucuucuggagaaaaugggucgagaacccacacggaauaauauggaaaguaucucccugugccgccuggguccccuccgcaguaaucgaacuaacaaugccgagcggagaaguacgaaccuuccaccccaugucuggcauucccacccaagucuucaaaggagucucugucacguaccugggaagcgacauggaaguaaguggucucaccgaccuaugcgaaaucgaggaacuaaagucaaagaaacucgcgcuugcacccugcaaccaggcaggaaugggugucgugggaaaaguaggagaaauacaaugcagcucggaagaaucagcgcgcacaauaaagaaagacggcuguaucuggaacgcggaccucguagggaucgaacucagaguagaugacgccgucugcuacaguaaaauaaccucugucgaggccguggcaaacuacuccgccauacccacaaccauaggcggacuccgcuucgaacgaucacacgacagccaagggaaaauaucaggcucgccccuggauauaacggcgauacggggaucauucucuguaaauuaccgaggacugagacuaagccuguccgaaauaacagccacgugcacaggcgagguuaccaacguaucuggaugcuauagcugcaugacaggagcaaaagucucgauuaaacuccacucaagcaaaaacagcacagcccacgugcgaugcaaaggagacgagaccgccuucucaguacuagaaggaguacacaguuacaucguuagccucucauuugaccaugccguagucgacgaacagugucaacuaaacugcgggggacacgagucccaagucacgcucaaaggcaaccuaauauuccuagacgucccaaaguucguggauggaucauacaugcaaacauaccacagcaccguaccaaccggcgccaauauaccaagcccuacagacuggcuaaacgcguuauuuggcaauggacuaucgagguggauucuaggcgugauuggcgugcuccuaggcggacuagcacucuuuuuccugauuauguuccuccucaaacuaggaaccaaacaaguguucaggagccgaacaaagcuagccuga

SEQ ID NO: 16493 - RNA, 3222 nt, Artificial Sequence
  derived and/or modified CDS sequence (opt11) from SFTSV(SDTA_3)__KX641915.1__GP
augaugaaagucauaugguucuccagucuuaucugccuugucauacaauguagcggagacucaggacccaucauaugcgcaggcccgauacacuccaacaaaagcgccggaaucccacaccuccuaggauacagcgagaaaauaugucagauugauaggcugauacacguaagcagcuggcuccgaaaucacagccaguuucagggauacguaggucaacgcggaggaaggagccaggucuccuacuaccccgcagaaaacaguuacagcagauggagcggacugcucucgccaugcgacgcagauuggcuaggcaugcuggucguaaagaaagccaaagaauccgacaugauuguacccggccccucguacaaaggcaaaguauucuucgaacgccccaccuucgacggcuacgucgguuggggcugcggcuccggaaaguccagaaccgaaucaggcgaacuaugcagcagcgacaguggcacgagcagcggacuacugcccuccgaccggguccuguggaucggcgauguggcgugucaaccuaugacacccauacccgaagaaaccuuccucgaacucaaaucauucagccaauccgaguucccagacaucugcaaaaucgacggcaucguuuucaaccagugcgaaggggagucccucccccagcccuucgacguagcauggauggacguagggcauucacacaaaauaaucaugcgcgaacacaaaacaaaauggguacaggagagcucaagcaaagauuuuguguguuacaaagaaggcacgggaccaugcagcgaaucggaagaaaaagcaugcaagaccucaggaucaugccgaggcgauaugcaauucugcaaaguggcaggcugcgagcacggagaggaagcaagcgaagccaaaugccguugcagccucguacacaaacccggcgaagucguagucuccuacggcgguaugagaguccgccccaaauguuacggcuucuccagaaugauggccacccuagaaguaaacccgcccgagcaacgaauaggacagugcaccgggugccauuuagaaugcauaaacggaggagucagacuaauaacacucacaagcgaacucagaucugccacagugugcgcaagccacuucugcaguucagcgucgaguggcaagaaaagcaccgaaauacacuuucacucgggaucccucgucggcaagacagcaauucacguaaagggagcccuggucgacgguaccgaguucacguucgaaggcagcuguauguuccccgacggaugcgacgcagucgacugcacauuuugccgggaguuccugaaaaacccacagugcuacccagcaaagaaauggcuauucaucaucaucguaauucuacuaggauacgcagggcugaugcuccuaacgaacguccuaaaagccauaggcguguggggcagcugggucauagccccagucaaacuuauguucgcaauaaucaagaaacucaugcgcacaguuucaugccugguggggaaauuaauggaccgaggacgccaaguaauacacgaagaaaucggagaaaacggcgaagguaaccaggacgacguacggaucgaaguggccagaccgcgccgaguacgacauuggauguacuccccaguuauccuaacaauacuagccauaggacucgcugagggaugcgacgaaaugguccacgcagacucgaaacucgucucgugcagacaaggcucaggcaacaugaaagaaugcauaacaacagggagagcccuacugcccgcugugaacccaggacaagaagcaugccuccacuucaccgccccgggaucuccagacucgaaaugccucaaaaucaaagucaaacgcauaaaucugaaaugcaaaaagucauccagcuacuuugucccagacgcgagaagcagaugcacgucuguacgccgaugccgaugggcaggagacugccaaagcggaugucccccacacuucaccucaaacaguuucagcgaugacugggccgggaagauggaccgggcaggccuggguuucucgggcugcuccgacggcugcggcggggcagcgugcggcugcuucaacgcagccccaucaugcaucuucuggcgaaaauggguggagaacccacauggaaucauauggaaggucagccccugcgccgccuggguucccucggccguuauugagcugacaaugcccuccggagaggugcgcacauuccacccaaugagcggcauuccaacacaaguauucaagggaguauccgucacauaccuaggauccgacauggaagucagcggacuaacggaucuaugcgaaaucgaagaacuaaaaagcaagaaacucgcacucgcgcccugcaaccaggccggaaugggaguaguaggcaaagucggugaaauacaaugcucaucggaagaaagcgcacgcaccaucaagaaagacggcuguaucuggaacgcggaccuggucgggauugaacuaagagucgacgacgcgguuuguuacagcaagaucacaucgguagaagcgguagccaacuacagcgcaauccccacaaccaucgggggcuuaagauucgaacgcucucacgauucccaggggaagauauccggcucaccacuugacauuacagccauucggggaucauucucagucaacuaccgcggacuaaggcuaucucuaucagaaauaacggccacgugcaccggcgaagucaccaacguaucuggcugcuacagcugcaugacaggcgccaaagucagcauaaagcuacacuccuccaagaacucgaccgcccacguccgaugcaaaggggaugagacagcauucucaguccuggaaggcguacacucguacaucgugagucugagcuucgaccacgcgguaguagacgaacagugccagcuaaacugcggaggacacgaaagccaagucacccucaaaggcaaccuaaucuuccuagacgucccgaaauucguagacggguccuacaugcaaaccuaccacucaaccguccccacgggagcuaacaucccaucaccaacggacuggcuaaacgcacuguuugggaacggacucaguagguggauacucggagugauaggagugcuacuaggaggacucgcacuguucuuccucaucauguuccugcucaaauuaggaaccaaacaaguauuccgaagcaggacgaaacuagccuaa

SEQ ID NO: 16494 - RNA, 3222 nt, Artificial Sequence
  derived and/or modified CDS sequence (opt11) from SFTSV(SDTA_4)__KX641916.1__GP
augaugaaggucauaugguucagcagccuaauaugccuaguaauacaaugcaguggggacuccggucccauaaucugcgcggguccaauacacagcaacaaauccgcagggaucccgcaccuccuaggcuacucagaaaagaucugucaaauagacaggcuaauccacguaucaucauggcugcgcaaccacagucaguuccaaggauacguaggccaaagaggaggaaggucccagguaagcuacuauccggcggaaaauuccuauagcagauggagcggccuucuuagccccugugacgcggauuggcucgggauguuaguagugaagaaagcaaaagaaucagacaugaucgugcccgggcccucauacaagggcaaaguauucuuugaacgccccaccuuugacggcuacguaggguggggcuguggaucgggcaagagccggacagagagcggagaacucugcucguccgacagcggcacaagcagcggacuacugccaucggaccgcgugcucuggaucggcgacgucgccugccagcccaugaccccgauccccgaagagacguuccuggagcuaaagagcuuuagccaaagugaguucccggacauuugcaaaauagacggcauaguauuuaaccaaugcgaaggcgagucccuaccccaacccuucgacguagcauggauggacgucggacacagucacaaaaucauaaugcgggagcacaagaccaaaugggugcaggaguccaguucaaaagacuucgugugcuacaaagagggcacaggaccaugcagcgaaucagaagagaaagcgugcaaaacaaguggcucgugcagaggagacaugcaauucugcaaaguagcaggaugcgagcacggggaagaagcaucggaggcaaaguguagauguucccucguacacaaaccuggcgaaguaguagucaguuacggaggcaugcgcguacgaccgaaaugcuacggauucucaagaaugauggcgacacuggaagucaacccgcccgaacaaagaaucggacaaugcacuggaugccaccuagaaugcaucaacgggggaguacgauugauaacacuaacaagcgaacucagauccgcaaccguaugcgcaagccauuucuguaguucagccacguccggaaagaaaagcacggaaauucacuuucauagcgggucacugguaggcaaaacagcaauacaugugaaaggagcgcucguggaugggacugaguucacuuucgaaggaagcugcauauuuccggaugggugcgacgcaguagacugcacauucugcagggaguuccugaaaaacccgcaaugcuauccagcuaagaaauggcuauucaucaucaucguuauccuccuaggguacgcaggccugaugcuacuuaccaacguacucaaagcaauugguguaugggggagcuggguaauagccccagucaagcucauuuuugcgaucaugaaaaagcugaugcgcacgguguccugccuagucggcaaacuaauggaccgcggaagacaagugauacaugaagaaaucggagagaauggagaaggaaaccaagacgacguaaggaucgaaauggcacguccgcgaagggucagacacuggauguauaguccagucauccuaacaauccuagcuauaggccuagcugagggcugcgacgagaugguacacgccgauagcaagcuagucucaugccgccaaggaagcggaaacaugaaagagugcauaaccacaggcggggcccugcuaccugccgucaacccaggacaagaagccugcuugcacuucaccgcaccaggauccccggacaguaaaugccucaaaaucaaggucaagcgaauaaaccucaaaugcaaaaagagcucgagcuacuuugugccagacgcacgaucacgaugcaccagugugcggagaugcagaugggccggagacugucaaagcggaugcccgccccacuuuaccaguaacagcuucagcgacgacugggcagguaaaauggacagagccgggcugggcuucucgggaugcagugacggcugcggcggagccgccugcggauguuucaacgcggcccccagcugcauuuucuggcgaaaauggguagagaacccccauggcaucaucuggaaagucucgccaugcgcagcuuggguacccucagcagucauagaacuaacaaugccgagcggggaaguacgcacauuccaccccaugagcgggauuccgacacaaguguucaaaggaguaucugucacguacuugggaucggauauggaagugagcggacucacggaccuaugcgaaaucgaagaacucaagucgaaaaagcuagcacuagccccgugcaaccaggcaggaauggggguggucggaaaggucggggaaauccagugcagcagcgaggaauccgcgcgcacgauaaagaaagauggcugcaucuggaacgcggacuuggucggcaucgaacuaagggucgacgacgcggucuguuacucgaaaauaaccucggucgaggcaguagcgaauuacuccgccaucccaacaacaaucggcggacucagguucgaacgaucccacgacucccagggcaaaauaucaggcucaccccuagacauaaccgcgaucaggggaucguuuagcguaaacuaucgaggguugagauuaagccucagcgaaauuacggccacaugcaccggcgaaguaacuaacgugagcggcugcuacagcugcaugaccggagccaaggugucaaucaaacugcacucgagcaagaacucgaccgcccacguccgaugcaagggugacgagacagcauuuucaguacuugaaggaguacacagcuacauuguuucacucagcuuugaccacgcgguaguggacgaacagugccagcucaacugcgggggacacgaaucacaaguaacccuaaaaggcaaccuaaucuuuuuagacguaccgaaguucguugacggcucguacaugcagacauaccacuccacugugccgacaggcgcaaacaucccauccccuaccgacuggcuaaacgcacucuuugggaacggccugagcagauggauacugggagucauaggaguacuacuaggagggcuagcacucuucuuucugaucauguuccuccucaagcugggaacaaaacaagucuucagaucuagaaccaagcuagcguga

SEQ ID NO: 16495 - RNA, 3222 nt, Artificial Sequence
  derived and/or modified CDS sequence (opt11) from SFTSV(HBGS13_human_2015)__KY440773.1__GP
augaugaaagucauaugguucucgucccucaucugcuucguaauacaaugcuccggagacagugggccaaucaucugcgcaggcccgauccauucgaacaaaucagcagacaucccgcaucugcugggguacucagaaaagaucugccaaaucgaccgacuuauccacgucagcagcuggcugcgaaaucacucccaguuccaaggguacguuggacaaagaggaggcaggagccagguaucauacuacccggcagaaaacagcuacagccgcuggucaggccuacucucaccaugcgaugccgacuggcucgggaugcucguuguaaagaaagcaaaaggaucagauaugaucgugccagggcccucguacaaagguaagguguucuucgagcgaccgacuuucgacggauacgugggcuggggcugcggaucaggcaaaagccgaaccgagagcggagaguuaugcucgucugacuccggcaccagcaguggcuuguuacccuccaaccggguccuuuggauaggcgaugucgcaugccaaccuaugaccccaaucccugaagaaacguuccuagagcuaaaaaguuuuagccaaagcgaguucccagacauaugcaaaaucgacggaaucgucuucaaccagugcgaaggagaaucccuaccccaacccuucgauguagccuggauggauguaggucacucacacaaaaucauaaugcgagaacacaaaacgaaauggguucaggaauccucaaguaaagacuucguauguuacaaagaaggcacaggcccgugcagcgaguccgaagaaaagacgugcaaaaccaguggcagcugccgcggagacaugcaauucugcaaaguagcgggcugcgaacacggggaagaagcauccgaggccaagugccgaugcagccucguccacaaacccggcgaaguuguagucucauacggcgggaugcgaguccgucccaaauguuacggguucagcaggaugauggcaacgcuugaaguaaaucaaccagagcaaagaauagggcagugcaccgggugccaccuagaguguaucaacggcggcgugagacuaauaacccucaccagcgaacuaaagagcgcgaccguuugcgccagccacuucugcagcagcgcuacaucaggcaagaaaagcacggaaauacaguuucacagcggcagccucguaggcaaaacagcaauccacguaaaaggcgcucuugucgacgggacagaguucaccuucgaaggcagcugcauguucccagacgggugcgacgccguggacugcaccuucugcagagaguuccucaagaacccccaaugcuaccccgccaagaaaugguuauucaucauaauagucauccuacucggauacgccggucugaugcuacuaacgaacguccucaaggccaucggcaucuggggaagcugggugauagccccugucaagcuaaucuucgcaaucauaaagaaacucaugcgcaccguaagcugucuaaugggcaaacucauggaccgagggcgacaaguaauacacgaagaaauaggggaaaaccgagaaggcaaccaggacgacguacgaaucgaaauggcacgcccgcgaagaguacgacacuggauguacagcccagugauacuaacaauccuggcaauaggcaucgccgagucaugugacgaaaugguccacgcagacuccaaacugguauccugccggcaaggcagcggaaacaugaaagaaugcgugacaacaggucgcgcccuauuaccggccgugaacccagggcaggaggcgugccuacacuucaccgcacccggcagccccgacucgaaaugccuucgaaucaaaguuaaacgaaucaaccucaaaugcaagaaaagcagcagcuauuucguaccagacgcacgaucgagaugcacguccguaaggcgauguaggugggccggcgacugccaauccggcugucccccacacuucacaagcaacucguucuccgacgacugggccggcaaaauggacagagcgggccugggauucucgggaugcucggauggaugcggcggcgccgcuugcggaugcuuuaacgcagcaccaucuugcaucuucuggcggaaauggguugagaacccacauggcauuauauggaaagugagcccaugcgcagcgugggucccuagcgccguaaucgaacuaacaaugcccucaggcgaaguaagaacauuccacccgaugucaggaauacccacacaaguguucaaaggggucucggugaccuaccuaggaucagacauggaaguaucuggacuuacagaccuaugcgagaucgaagaacucaaauccaaaaagcuagcccuagcgccaugcaaccaagcaggaaugggcgugguaggcaaagucggugaaauacagugcagcucagaagaaucggcacgcacaaucaagaaagacgggugcauauggaacgcggaucuaguuggaauagaacuaagagucgacgacgccguuugcuacucaaaaaucaccagcguagaagcaguugcgaauuacagugccauuccuaccacaauaggaggucuucgguucgaacggagccacgacucccagggaaaaaucagcggcucaccccucgacauaacagccauccgagggagcuucucagugaacuacagaggauuacgccugagccucagcgagauaaccgcgacaugcacaggagaggucacaaacguaagcggaugcuacagcugcaugacaggcgcaaaggucagcaucaaacugcacucguccaaaaauucgaccgcgcacgugcgcugcaaaggggacgaaacagcguucaguguccucgagggaguccacagcuacacaguaagccucagcuucgaccacgcggugguagacgaacaaugucaacuaaauugcggaggacacgaaucacaagucacacuaaaagggaaucuuaucuuccuagacguccccaaauucguugacggcuccuacaugcaaacguaucacuccacagucccaaccggagccaacaucccaaguccuaccgacuggcuaaacgcccuguucggaaacgggcucuccagguggauccuuggcgugaugggagugcuguuaggaggauuggcccuauucaucaucaucaugagccucuucaaacucggcaccaaacaaguauucagaucgagaaccaaacucgcauaa

SEQ ID NO: 16496 - RNA, 3222 nt, Artificial Sequence
  derived and/or modified CDS sequence (opt11) from SFTSV(HBMC16_human_2015)__KY440776.1__GP
augaugaaagucaucugguucagcucucuggugugccuagucauccaaugcagcggagauagcggacccaucaucugcgcgggcccaauccacaguaacaaaucagccgggaucccgcaucugcucggcuauucugagaaaauaugccaaaucgacaggcucauacauguaucuucuuggcuacgaaaccacucacaauuccaaggguacguaggccagaggggaggacggagccaagucucauacuacccagcagaaaacagcuacagccgguggucggggcuacucucaccaugcgacgccgacuggcuaggaauguuaguagugaaaaaggccaagggaucggacaugaucguccccggaccaaguuacaaaggaaaagucuucuuugaacgaccaaccuucgacgguuacgugggauggggcugcggcuccggcaaaagccggaccgaguccggggaauuaugcucaagugacuccgggacaucgucaggacuccuacccucugaccgaguucucuggaucggagacguggcaugccagcccaugacacccaucccagaagaaaccuuccucgagcucaagagcuucagucaguccgaguucccugacaucugcaagauagacgggauaguauucaaccagugcgaaggcgaaagucugccccaacccuuugacgucgcuuggauggacgucggacacucgcacaaaauaauaaugagagaacauaaaaccaaaugggugcaggaaucguccucaaaagacuucgucugcuacaaagagggcaccggaccaugcagcgaaucggaagaaaaagcaugcaagacuagcgguucaugccgaggcgacaugcaauucugcaaaguagccggcugcgaacacggagaggaggcuucagaggcaaagugccgaugcagccuaguucacaaaccaggcgaaguaguugucucguacggagguaugcguguacgcccaaaaugcuacggauucucccgcaugauggcaaccauggaaguaaauccgcccgaacaaagaaucggacaaugcacaggcugccaccuugaaugcauaaacggcgguguacgacucaucacacucaccagcgagcucaagagcgcaacagugugugcaagccacuucugcagcagcgccacgagcgguaagaaaaguacagaaauacacuuccacaguggaucacucgugggcaaagcagccauccacgucaagggcgcgcuagucgacgggaccgaguucacauucgaaggcucauguauguuccccgacgggugcaacgcaguugacugcacauucugccgugaguuccuaaagaacccccaaugcuaccccgcaaagaaauggcucuuuauuaucaucgucauccugcuagguuaugcaggucugaugcuccuaacgaacguacucaaagcgauaggcgucugggggagcugggucauagcacccgucaaacuuauguucgccauuaugaagaaacuaaugcgcacuguaucuugcuuagucgggaaauugauggacagaggacgccaaguaauacacgaagagauaggagaaaacggcgaagggaaccaagacgacgugaggauagagauggcacgaccccggagagucaggcacuggauguacagcccggucauccuaacaauacuggcgauaggacuggcggaaggcugcgacgagaugguccacgccgacaguaaacugguaucaugccggcaagguucugggaacaugaaagaaugcguaaccacaggacgggcccugcucccugccgugaacccgggccaagaagcaugccuacacuucacagcaccagggagcccagacagcaaaugucuaaaaaucaaagucaagcgcauuaaccugaagugcaaaaagagcucauccuauuucgugccagacgcaaggagcagaugcacaagcguacgacgaugcagaugggcaggcgacugccaaagcggcugcccgccccacuucaccucgaacaguuuuagugacgacugggcagggaagauggaucgcgccggccuaggcuucucuggcugcagcgauggcugcggcggcgcagcaugcgggugcuucaacgccgccccauccugcauuuucuggcgcaaaugggucgagaacccgcacggaauaauauggaagguuucgccaugugccgcguggguacccucagcaguuaucgagcucacaaugccgagcggagaagugcgcaccuuccaccccauguccggaaucccuacacaggucuuuaagggaguaucaguaaccuauuugggcagcgauauggaagucagcggucucacugaccugugcgagaucgaggaacugaaaaguaagaaacucgcacucgccccuugcaaccaagcagggaugggaguuguaggaaaagucggugaaauacaauguucuuccgaagaaagcgcucggaccauaaagaaagauggcugcaucuggaacgcggaccuggucgggaucgaacuccgagucgacgacgccguuugcuacagcaaaauaacauccgucgaagcgguggccaacuacagcgccauacccacgaccauaggaggccuacgauucgaacgaucacacgacagccaagggaaaauaucaggcucacccuuagacauaacagccauacgaggcucauucucaguaaacuacagaggucuacgcuugagccucucagaaauaacggcaacgugcacaggcgagguaaccaacgucagcggcugcuacagcugcaugacaggugcaaaagucagcauaaaacuccacucgaguaaaaacuccaccgcccacguucgaugcaaaggcgacgagaccgcauucucgguacucgaggggguacacucauauacugugagccuaucauucgaccacgcggucgucgacgaacaaugccaacucaauugcggaggacacgaaucgcaagugacacuaaaaggcaaccuaauauuucucgacguccccaaauucguugacggcucauacaugcaaacauaccacagcacugugcccacgggagccaacauccccucccccaccgacuggcugaacgcacucuucggcaauggccuaaguagauggauacuaggagugaucggcguacuacucggcgggcuagcgcuguucuuccuaaucauguuccuauucaagcucgggaccaaacaggucuuccgaaguaggaccaaacuagccuga

SEQ ID NO: 16497 - RNA, 3222 nt, Artificial Sequence
  derived and/or modified CDS sequence (opt11) from SFTSV(HBMC5_human_2016)__KY440770.1__GP
augaugaaagucaucugguucagcucgcugguaugucucgugauucaauguagcggcgacucgggcccgaucauaugcgccggcccuauccacucaaacaaaucggccggaaucccucaucugcuaggguacagugaaaagauaugccagauagacaggcucauccacgugaguucguggcuacguaaccacucacaauuccagggauacgugggacagcgcggaggcaggagccaagucagcuacuauccggcagaaaacagcuacagcagauggagcggccugcuuucacccugcgacgcggacuggcuaggaaugcuggugguaaagaaggcaaagggcagcgacaugaucguccccggacccuccuacaaaggcaagguccuauucgagcgcccuaccuucgacggauaugucggauggggcugcggaucaggcaagagccgcacggaaagcggagagcucugcagcagcgacagcgggacaucuaguggacugcugccuagcgaccgaguccuauggaucggagacguagcgugccaaccuaugacacccaucccggaggaaacuuuccuagagcucaagagcuucagccaaagcgaguucccggacauauguaagaucgacggaauagucuuuaaucaaugcgaaggggaaucccuaccgcaacccuucgacguugcauggauggacgucggacacucacacaaaaucaucaugagggaacacaagacaaaaugggugcaagaaucgagcucgaaggacuucgucugcuacaaagaaggaacgggccccugcagcgaaagcgaagagaaagccugcaaaacauccggaucuugcagaggcgauaugcaauucugcaaggucgccggcugcgaacacggagaagaagcaagcgaagcaaaaugccgcugcagccucguacacaagccuggagagguagucguaagcuacgguggaaugagagugagaccaaaaugcuacggauucucccggaugauggcaaccauggaaguaaauccaccggaacaaaggauaggccagugcaccggaugccaccucgaaugcaucaacggaggcguccgccugauaacccucacgagcgagcugaaaagcgccacgguaugcgcuagucacuuuugcagcucggcaaccagcggaaagaaauccaccgaaauccacuuccacucaggcucgcuagucggcaaagccgccauccacguaaagggcgcccuaguggacggaacagaguucacguuugaaggaucaugcauguucccggacggcugcaacgcaguagacugcacauucugcagagaauuucuaaagaacccacaaugcuacccagcgaagaaauggcuauucaucauaaucguaauacuccuaggauacgcgggacugaugcuccucacaaacguccucaaagcuaucggaguguggggaagcuggguaaucgccccggucaaacuaauguucgccaucaugaagaaacucaugaggaccgucucuugccuaguagguaaacucauggaccgcgggcgucaagucauacacgaagaaauaggagaaaacggagaaggaaaccaagaugacgucagaaucgaaauggcgcgaccgcggcgaguccgucacuggauguauagcccggucauacuaacaauacuagccauaggacucgcagaaggcugcgaugaaaugguccacgccgacagcaagcuaguauccugccggcaaggaagcggaaacaugaaagagugcgugaccacaggcagggcauuacuccccgcagucaaucccgggcaggaagcaugucuacacuuuacugcacccggaagcccagacagcaaaugccucaaaaucaaagucaaacgcauuaaccugaagugcaaaaagagcucgagcuauuucguuccagacgcgcgaaguaggugcacgagcguacgacgaugucguugggcgggagacugccaaagcggaugcccgccgcacuucaccagcaauuccuucagcgacgacugggccggcaaaauggaccgugcuggguuaggauucucaggaugcagcgacggcugugggggagccgccuguggaugcuucaacgcagcaccaagcugcauauuuuggcgaaaguggguagaaaacccccacggaauaauauggaaggucagcccaugcgccgcguggguacccagcgcaguaaucgagcuaacaaugcccagcggggagguacggaccuuccacccaaugagcggaauacccacccaaguauucaaaggcguaagcguaacuuaccugggcucggauauggagguauccggacuaacagaccucugugaaauagaagaacuaaaaucaaagaaauuagcccuggcuccuugcaaccaagccggaauggggguagugggcaaaguuggagaaauccaaugcucaagcgaagaaagcgcgcgcacaaucaagaaagacgggugcaucuggaaugcggaccuugucggaaucgaauugcgaguugacgacgccguuugcuacucaaaaaucaccagcgucgaagccgucgcuaacuauucggcaauaccgacaaccaucggcggacuucgauucgagcguucacacgacucacaaggaaaaauuuccggaucaccacucgacauaacagccauccggggaucauucagcguaaauuaucgcggccuccguuugucguuaagcgagauaacagcgacaugcacgggcgaagucaccaacguaagcggguguuacaguugcaugaccggagccaaagucagcauaaaacuucacucauccaaaaacucgacugcacacguccgaugcaaaggcgacgagacagccuucucaguccuagaaggaguacacuccuacacugucucccucagcuucgaccacgccgugguagacgaacagugucagcugaacugcggcggacacgaaucacaaguaaccuuaaaaggaaaccucaucuuccuagauguccccaaauucgucgacggaagcuacaugcaaacauaccacuccacagugccgacaggagcaaacauaccuuccccuacggacuggcuaaacgcccucuucgggaauggacuaagccgauggauucucggcguaaucggcguccuucuagggggucuagcgcuguuuuuccugauaauguucuuauucaaacuaggaacaaaacaaguguuccgcagccgcaccaaacuggccuaa

SEQ ID NO: 16498 - RNA, 3222 nt, Artificial Sequence
  derived and/or modified CDS sequence (opt11) from SFTSV(HB29)__KP202164.1__GP
augaugaaaguaauaugguuuucgucacuaauaugccuggucauacagugcagcggagacucagguccgauaauaugcgcaggaccaauccacagcaacaaaucagccggaauaccgcaccuccucggcuacuccgagaaaaucugccagauagaccgccuaauccacgucuccucauggcuccggaaccacucacaauuucaaggcuacguaggccagcgcggaggcagaagccaagucagcuacuacccagcggaaaauagcuacucccggugguccggacugcucucaccaugcgacgcggacugguuagggaugcuagucgugaagaaagcaaaagaaucagauaugaucgugcccgggccguccuacaagggaaaagucuucuuugagcgacccacuuuugauggguacguaggcuggggcugcggguccgggaagagucgaacggagagcggagagcuaugcagcagcgacucgggaaccucgagcggccuacuacccucagaccggguacuauggaucggagacguugccugccaaccaaugacgccuauacccgaagagacguuucucgagcuaaagagcuucagccaaagcgaguucccagacaucugcaaaaucgacggaauagucuucaaccaaugcgaaggcgaaagucuaccccaaccauuugauguagccuggauggacguagggcacucacacaaaaucauaaugagagaacauaagacaaaauggguccaagaaucgagcuccaaagacuucguaugcuacaaggagggaacaggacccugcagcgaauccgaagaaaaagcgugcaaaaccuccggcagcugcagaggcgacaugcaguucugcaaagucgcuggcugcgaacacggggaggaagcuagcgaagcaaaaugucgaugcagccuaguacacaagccgggggaagucguggucucauacggaggcaugcgcguacgaccaaaaugcuacggauucuccaggaugauggcgaccuuagaaguaaacccgcccgaacaacguauagggcaaugcacaggaugucaccuagaaugcauaaacggaggagugcgccuaaucacacucaccuccgaacuacgauccgcaaccgugugcgcgagccacuucugcuccuccgcaucaaguggaaagaaauccaccgagauacacuuccacucaggcucacucgugggaaaaaccgcaauucacguaaaaggcgcccugguggacggcacggaguucacauucgaaggaagcuguauguucccagacgguugugaugcaguagauugcaccuuuugcagagaguuccucaaaaacccgcaaugcuacccagccaagaaaugguuauucauuauaaucgugauccaccuaggcuacgcgggacuaaugcugcuaaccaacguacucaaggccaucggcguauggggcagcugggucaucgccccgguuaaacucauguucgcaauaauaaagaaacuaaugagaacaguaagcugccuggucgggaaauuaauggacaggggccgccaagucauacacgaagaaauaggagaaaacggggaagggaaucaggaugacguacgaaucgaaauggcacgccccagacgggucaggcacuggauguauucaccagucauccugacaauccuagcaauuggacuagccgaaggaugcgacgaaaugguccacgccgacagcaaacuugugagcugcagacaaggaucuggcaauaugaaagaaugcaucaccacaggccgugcacugcuucccgccgucaacccgggccaagaagcaugccuacauuucacagcgccagggagcccagacuccaaaugucuaaaaauaaaagugaaacgcauaaaccucaaaugcaagaaaagcagcuccuacuucgugcccgacgcaagaagccgaugcacaagcguacgcagaugcagaugggccggcgacugccaauccgguugcccgccccacuucaccagcaacuccuucagcgacgacugggccgggaaaauggacagggcaggguugggguucucagguugcuccgacgguuguggaggagcagccugcggguguuucaacgcagcaccaaguugcauuuucuggcgaaaauggguagaaaacccacacggcauaauauggaaagucaguccaugcgcagccuggguacccuccgcaguaauagaacucacaaugccgagcggggaagugcgaacauuccaucccauguccggaauaccaacucaggucuucaaaggagucucaguuacguaccuaggcagcgauauggaaguaagcggacugacggaccucugcgagaucgaggaacuaaagucgaagaaacuugcgcucgcacccugcaaccaggcaggcaugggagucgugggcaaagucggagaaauacaguguucauccgaggaauccgcacggacaauaaagaaagacggauguauauggaacgccgaccuagucgggauagaacuucgcguggacgacgcagucugcuauuccaaaauaacuagcguugaagcugucgcuaacuacagcgccaucccaacaaccaucggcggacuacgcuuugaacggucacacgacagccaaggcaaaaucucuggaagcccacuagacauaacagccauacggggauccuuuagcgugaacuaccggggccuccgacucagccucuccgaaauaaccgccacaugcacuggagaaguaacgaacguaaguggcuguuacagcuguaugacaggcgccaaaguaucgauaaaacuacacaguucuaaaaacaauaccgcccacguccgaugcaaaggcgacgagacagcguucuccguacuggaagggguccacagcuacaucgugagccucucguuugaccacgcaguaguagacgaacagugccagcuuaacugcggugggcacgaaucccaaguaacgcuaaaaggcaaccucaucuuccuagacguaccaaaauucguagacggcucguacaugcagaccuaccacucgaccgucccaacaggagccaacauccccucgccaacagacuggcuuaacgcccucuucggcaacggccugagccgauggauccucggagucaucggaguacuguuggguggacucgcucuauucuuccugaucauguuccugcugaaacucggaacaaaacaagucuucagaagccggacuaaacuagccuaa

SEQ ID NO: 16499 - RNA, 3222 nt, Artificial Sequence
  derived and/or modified CDS sequence (opt11) from SFTSV(HNXY_115)__KC292312.1__GP
augaugaaagucaucugguucucuagccuaaucuacuucguaauccaaugcuccggcgacucggguucaauaaucugugccggcccaauacauagcaacaaauccgcagacaucccccaccuccucggauacuccgagaagaucugccaaauagacaggcucauccacgucagcuccugguugcgcaaccacucccaauuccaaggauacgugggacaacgcggcgggcgcagucaaguaaguuacuaucccgcagagaacucauacagccgaugguccggccugcucagccccugcgacgccgacuggcucggcaugcuggucgucaagaaggcaaagggcucagacaugaucguacccggaccaaguuacaagggaaagguguuuuucgaacgaccaaccuucgacggauacguaggcuggggcugcggauccgguaaaucacgaaccgagaguggcgagcugugcagcagcgauagcggaaccucaaguggccuacugccguccgacaggguccuauggauaggcgacguggcaugccaaccaaugacccccauuccagaagaaacauuccuagagcucaagagcuucucacaaucagaguucccagacauaugcaagauagauggaauagucuucaaucagugcgagggcgaaagccuuccccaacccuucgacgucgcguggauggacgucgggcacucccacaagauuauaaugagagaacacaaaaccaaguggguacaggaaagcagcagcaaggacuucguaugcuacaaagaaggcacaggccccugcucagaaagcgaagagaaaacaugcaaaaccucgggcuccugccgaggcgacaugcaguucugcaaaguagcaggcugcgagcacggcgaagaagcaagcgaagcgaaaugcagauguagccucguccacaaacccggcgaagucguugugucguacggcggaaugagggugcgccccaaaugcuacggauucagccgaaugauggccacccucgagguuaaccagccugagcaaagaaucggucaaugcaccgggugccaccucgaaugcaucaacggcggcgugcgcuugaucacacucaccucggagcucaaauccgccaccguaugcgccagccacuuuugcagcagcgccacuagcggaaagaaaagcacagaaauccaauuccacagcggaagccucgugggcaaaacggcaauacacgucaaaggcgcacucgucgauggaacagaauuuacauucgaaggcucuugcauguuccccgacgguugugacgccguugacugcacauucugccgggaguuccugaaaaacccccagugcuaccccgccaagaaauggcuauuuauaaucaucgugauucuucucggcuacgccggacuaaugcuacuaacaaacgugcucaaggcaauaggaauauggggcucaugggucaucgcaccaguaaagcuaauuuucgcaaucauaaagaaacucaugcgaacaguguccugccuaaugggcaaacugauggaccgaggucgccaagucauacacgaagaaauuggcgaaaaccgagaagguaaccaagacgacguacgaauagagauggcccgaccaaggcgaguacgccacuggauguacagccccguaauacucacaauccuagccauaggccuagccgaaagcugcgacgagaugguucacgcggacagcaagcuagucuccugcagacaaggcaguggaaauaugaaagaaugcguaacaacaggacgugcacuacucccagcugucaauccaggccaagaagcgugccuacacuucaccgcccccggcuccccagacucaaaaugccucaaaaucaaaguuaaacgcaucaaccucaaaugcaagaaaagcagcagcuacuucguacccgacgcgcguuccagaugcacaagcguacgaagaugccggugggccggugacugucaaagcggcugcccaccacacuucaccucaaacucauucucagacgacugggcaggcaaaauggaccgggcagggcucggauucucaggcuguuccgacgggugcggcggcgccgcauguggcuguuucaacgcggccccaagcugcaucuucuggaggaaauggguagagaacccacauggaaucauauggaaagucagucccugcgccgccuggguaccgagcgcaguaauagaacucaccaugccaucaggagaaguccguaccuuccauccaauguccggcaucccaacccaagucuucaaaggggugucagucaccuaccucggaucagacauggaggucagcgggcugacagaccuaugcgaaaucgaggaacucaaaagcaagaaacucgcgcucgcuccaugcaaccaagccggcauggggguagugggcaaagucggagagauacaaugcuccucugaagagagcgcgcgcacaaucaagaaagacggaugcauuuggaacgcagaccuagucggcaucgaacugcgcguagacgaugcaguaugcuacucuaaaauaaccagcguagaagcagucgcaaacuacuccgcaauccccacaaccauaggcggccuacgcuucgagcguucccacgauucucaaggcaaaauaagcggcucgccacuagacaucaccgcaauacggggcagcuucagugucaauuacaggggccuaagacucagccuauccgagaucaccgcaaccugcacaggagaagucacaaacgucuccggaugcuauucaugcaugacaggcgcaaaagucuccaucaaacugcacuccuccaaaaacucaacagcccacguacgcugcaaaggagacgaaacagcauucucaguccucgaaggcguccacucauacaccgucucccugagcuucgaccacgcagucguugaugaacaaugccagcuaaacugcggaggacacgagucacaaguaacacucaaagggaaucucauauuccuagaugugccaaaauucguagacggcucauacaugcaaaccuaucacagcacaguuccaacaggcgccaauauuccgucacccacagacuggcuaaaugcccuguucggcaacggccuauccagauggauccuaggagugauaggagugcuccuaggcggacuagcacucuucuucaugauaaugagucuguuuaaacucgggaccaaacaaguauuccgaucacgaacaaaacucgcguaa

SEQ ID NO: 16500 - RNA, 3222 nt, Artificial Sequence
  derived and/or modified CDS sequence (opt11) from SFTSV(HNXY_144)__KC292307.1__GP
augaugaaagugauaugguucagcucacuaaucugcuucgucauccaaugcuccggagacucgggaccaaucauaugcgcaggcccaauccauuccaauaaaucagccgacaucccccaccuccuaggauacucagagaaaaucugccagaucgacaggcuaauacacgucuccuccuggcuaaggaaccauagccaauuccaaggguaugugggucaacgaggcggacgcagccaagucaguuacuacccagccgaaaauucauacucacguuggagcgggcuucuuucacccugcgacgccgacuggcucggcaugcuggugguaaagaaagccaaaggaucagacaugauagucccaggacccuccuauaagggcaaagucuucuucgaacgacccaccuuugacggcuacgugggauggggcugcgguucuggcaaauccagaaccgaaagcggagaacucugcagcuccgacuccggcaccucaagcggacuacuuccaagugauagaguucucuggaucggcgauguagccugccaaccgaugacaccgauccccgaagaaacauucuuagagcuaaagagcuucagccaaagugaguuccccgacauuugcaaaauugacgggaucguauucaaccaaugcgaaggagaaagccucccccagccauucgacgucgccuggauggacgucggccauucacacaaaauuauaaugcgagaacacaaaaccaaauggguccaagaaagcucaucaaaagauuucgucugcuacaaagaagggacuggcccaugcagcgaauccgaagagaaaaccugcaaaacaucagggucuugccgcggcgacaugcaauucugcaaagucgccggaugcgaacacggagaagaagcaucagaggccaaaugccguugcagccuaguacauaaaccgggcgaagucgucguaucauacggagguaugcgcguccgaccaaaaugcuaugguuucagucguaugauggcgacccuagaaguaaaccaaccagaacagagaaucggccaaugcaccggcugccaccucgaaugcaucaacggggguguucgcuuaauaacauuaacgucggaacugaaauccgcaaccgucugcgcgucacacuucugcagcuccgccacauccgggaagaaaagcaccgaaauacaauuccacuccggcagccuugucgggaaaaccgccauacaugugaaaggagcacucgucgacggcacagaguucaccuucgaagguagcugcauguucccggacgguugcgaugccguagacugcaccuucugcagagaguuccuaaagaacccgcaaugcuacccagcgaaaaaguggcuauucaucaucauaguaauacugcucggcuacgcgggucuaaugcuccucacaaacguccucaaagcuaucggaaucuggggaucaugggugauagcacccgucaagcucauauuugccauuauuaagaaacucaugcgcacaguuagcugucuaaugggcaaacuaauggaucgugggcgucaaguaauucacgaagaaauuggcgaaaaccgugaaggaaaccaggaugacguccgaauagaaauggcacgccccaggcgaguacgacacuggauguauagcccagugauccucacgauccuagccaucggauuagcggaaagcugugacgaaaugguccacgcagacuccaaacuggucagcugccgccaaggcagcggcaacaugaaagaaugcgucacaaccggccgagcacuccugccagccguaaacccaggccaagaagcgugucuacauuucaccgcccccggaucaccggacaguaaaugccucaaaaucaaagucaagaggaucaaccucaaaugcaagaaaucgucaaguuacuucgucccggacgcaaggagccgcuguaccagcgucaggcgcugccgaugggcaggcgacugucaaagcgggugucccccacacuucacauccaacagcuuuuccgacgacugggcugggaaaauggaccgggccggacugggcuucagcggaugcucagacggcugcggaggcgccgcgugcgggugcuucaacgcagcacccagcugcaucuucuggaggaaaugggucgaaaacccacacggcaucaucuggaaagucagccccugcgccgcauggguaccgucagccgucaucgagcuaacaaugccaagcggcgaaguacgcaccuuucacccuaugagcgggauacccacacaagucuucaaaggagucucagucaccuaccuggguuccgacauggaggucagcggucuaacagaccuaugcgaaaucgaggaacuaaaaucaaagaaacuagcccucgcaccaugcaaccaagccgggaugggcgugguaggcaaagucggagaaauccaauguuccucagaagaguccgcgcgcacaaucaagaaagacggcuguaucuggaacgccgaccucgucggaaucgaacuacgcguggacgacgcugucugcuacuccaaaaucaccuccguagaagccguugccaacuacucagccauaccaaccaccauaggaggacucagauucgagaggucccacgauagccaaggcaaaaucuccggaucaccccuagacaucacagccauccgcggguccuucagcgugaacuacaggggcuuacgccuaagccucuccgaaaucaccgcaacaugcacgggagaagucaccaacguaagcggaugcuauagcugcaugacaggagccaaggucagcaucaagcuccacagcuccaagaacuccaccgcccacguacgcugcaaaggcgacgaaacugcauucagcguccuagaaggaguacauucguauacggucagcuuaucauucgaccacgccgucguagacgagcagugccaacuaaacugcggcggacacgaaucccaagucacccugaaagggaaccucaucuuucucgacguacccaaauucgucgacggcagcuacaugcaaaccuaccacagcaccguccccacaggcgccaacauacccagccccaccgacuggcugaacgcacucuucggaaauggccucucaagauggauccucggcgucaugggaguacucuugggcggucuagcacucuuuuucaugauaaugucguuauucaaacuagggaccaagcaaguauuucgaagucggacuaagcucgcguaa

SEQ ID NO: 16501 - RNA, 3222 nt, Artificial Sequence
  derived and/or modified CDS sequence (opt11) from SFTSV(HNXY_157)__KC292305.1__GP
augaugaaaguaauaugguucagcucacugaucugcuucguuauacaaugcagcggggacucggggcccauuauaugcgcaggcccgauacacagcaacaaaucugcagacaucccccaccuacugggauacucggagaaaaucugccaaauagaccgcuuaauacacgucaguucguggcugcggaaccauagccaauuccaaggcuauguagggcaaagaggagggcgcagccaagucucauacuacccggcagaaaacuccuauucccgaugguccggccuacucucaccgugcgacgccgacuggcucggaaugcuaguagucaagaaagcaaaaggcucagacaugauaguucccggacccucauacaaagggaaagucuucuucgagcgacccacauucgacggguacguaggauggggcuguggaucagguaaaagcagaacagaaagcggagagcuaugcuccagugauagcgguacgagcagcgggcuccugcccucgaacagaguacuguggauaggcgaugucgcgugccagccgaugacccccaucccagaggagaccuuccucgagcuaaagagcuucucccagagugaguucccggacauauguaaaaucgacggcauaguauucaaccaaugcgaaggagaaucacucccacagccauucgacguagcguggauggaugucggccacucacacaaaauaauaaugagggaacauaaaacgaaauggguacaggaaagcagcagcaaagacuuugucugcuacaaagaggggaccggacccugcagcgaauccgaagagaaaacaugcaaaacgagcggaagcugccgaggagacaugcaauucugcaaaguagccggaugcgagcacggagaagaagccagugaagcgaaauguagaugcagcuuagugcacaaacccggugagguaguggucagcuacggagggaugcgcguacgaccuaaguguuacggguucucacggaugauggcaacacuagagguaaaccaacccgaacaacguauaggccaaugcacagggugccaccucgaaugcaucaacgggggcguacgccugauaacacuaacuagcgaacucaaaagcgcaacagugugcgcgucacacuucugcagcuccgcaacgucggguaagaaaaguacggagauacaguuccacagcggcagccuugugggaaaaacagcuauacacguaaaaggagcccuaguagacgggaccgaguucacauucgaaggcagcugcauguuccccgacggaugcgacgccguagacuguacguucugcagggaguuccucaagaacccacaauguuauccggcuaagaaguggcuguucauaaucaucguaauucuacuaggcuacgccgggcucauguuacucacgaacguacucaaagcgauaggcauauggggaaguugggucauagccccggucaaacucauauucgccauaaucaagaaauugaugcgcacaguaagcugccuaaugggcaaacugauggaccgcggcaggcaagucauacacgaagaaauaggggaaaaccgggaaggaaaccaggacgacgucagaauagaaauggcgcguccacggagaguaaggcacuggauguauuccccagucauacuuacaauucuggcgauagggcuggccgaaagcugcgaugaaaugguccacgccgacagcaaacucguaucaugccgccaaggaaguggcaacaugaaggaaugcgucacgacagggagagcacugcugccggcagugaacccaggacaagaagccugccuacacuucacagccccggggaguccagacuccaagugucucagaaucaagguuaagcgaaucaaccugaagugcaagaaaaguagcagcuacuucgucccagacgcacgaagccggugcacaucgguccggcgaugccgcugggccggagacugccaaagcggcugcccgccccauuucaccagcaacagcuucucagacgacugggcaggaaaaauggacagagcaggccucggauucagcggaugcucagacgguugcggaggcgcagcgugcgggugcuucaacgcggccccgagcugcaucuucuggagaaaauggguagaaaacccacacggcaucauuuggaaggucucacccugcgcagcauggguacccuccgccguaauagaacuaaccaugccaucaggggaaguccgcacauuccacccaaugagcggcauacccacacagguauuuaaaggaguaucagucacguaccuuggaagugacauggaggucucaggccugaccgaccugugugagauagaagaacugaaaagcaagaaauuagcacuugcacccugcaaccaggcgggaaugggcgucguaggaaaaguaggcgaaauacaaugcuccagcgaagaaagugcacgcacaauaaagaaagacgguugcaucuggaaugccgaccuggugggcaucgaacuccgagucgacgacgcggucugcuacagcaaaaucacaagcgucgaggccgucgcgaacuacagcgccauccccacaacuauaggagggcuuagauucgagcgaagucacgacagccagggcaaaauaagcggaaguccccucgacauaacggccauuagagggagcuucagcguaaacuaucgcggccuacgccugagccuaagcgaaaucaccgccacaugcacgggagagguaacgaacgucagcggcugcuauagcugcaugacaggagcaaaggucucaauaaaacuacauagcagcaaaaauucgacagcgcacgugcgcugcaaaggugaugaaacagcauucucaguacucgaggguguccacuccuacacagucagccucagcuuugaccaugccgucguugacgaacaaugccagcuaaauugcggcggccacgaaucgcaggucacccucaaaggaaaucuaauauucuuagauguaccgaaguucguagacggaagcuacaugcaaacauaccacucaacagucccgacaggagcgaacaucccgagucccaccgacuggcucaaugcgcuauucggcaacgggcuauccagauggguacuaggggucaugggaguauuacucggcggacuugcgcuguucuucaugauaaugagccucuucaaacuaggcacgaaacaaguauucagauccagaaccaaacuagcguga

SEQ ID NO: 16502 - RNA, 3222 nt, Artificial Sequence
  derived and/or modified CDS sequence (opt11) from SFTSV(HNXY_170)__KC292304.1__GP
augaugaaaguuaucugguuuuccagccuaaucugcuucgucauccaaugcaguggagacucaggccccaucauaugcgcgggacccauccacuccaacaaguccgcagacaucccacaucuacuaggcuacagcgagaaaaucugccaaauagaucgccuaauacauguuucauccuggcuacgaaaccacucccaauuccaaggauacgucggccaaagaggugggcgaagccaaguauccuauuacccagcagaaaacucauacagccgauggagugggcuacucagccccugcgaugcagacuggcuagggaugcuugucguaaagaaagcaaaaggcagcgacaugaucgugcccggccccagcuacaaagggaaaguguucuucgagagaccaaccuucgacggguacgucggcuggggaugcggcuccggcaaaaguagaaccgaaagcggagaauuaugcagcagcgacagcggcacaucuaguggccuccuccccuccaaccgagugcucuggauuggagacguugcaugccaaccgaugacgccaauacccgaagagaccuuccucgaacucaaaaguuucagucaaagugaguucccagacaucugcaaaauagacgguauaguauucaaccaaugcgaaggcgagucguugccccaaccauucgacguugcauggauggacguaggacauagccacaaaauaauaaugcgcgaacacaaaacgaaguggguccaagaauccucauccaaagacuuuguaugcuacaaagaaggaacgggucccugcuccgaauccgaagagaagacaugcaaaaccuccggaucaugucggggagacaugcaauucugcaaaguagccggcugcgagcacggcgaagaagccagcgaagccaagugccgcugcucacugguccacaaacccggugaaguagucguaucauacggcggaaugcgcguacgcccgaaauguuacggcuucucccgcaugauggcgacccuugaagucaaucaaccagagcaacgcauaggacaaugcaccggaugucaccucgaaugcauaaacggaggaguacgauugaucacgcuaacaucggaacucaaaagcgcgacggucugcgccucacacuuuugcucaagcgccaccucaggaaagaaaucuacagaaauccaguuccacagcggaagccucgucggcaaaacagccauccacguaaaaggcgcgcugguagacggaaccgaauuuacguucgaagggucaugcauguucccagacggaugcgacgcagucgacuguaccuucugccgagaguuccucaaaaacccucaaugcuaccccgcuaagaaauggcuauuuaucaucaucguaauccuacuaggcuacgcaggucucauguuacuaaccaauguccugaaagcaauuggaauauggggauccugggugaucgccccagucaaauuaaucuucgcuauaauaaagaaacucaugcgcaccgucucaugccucaugggcaaacucauggaccgaggacgacaagucauccacgaagaaaucggagagaaccgggaaggcaaccaggacgacgucagaaucgagauggcccgcccaaggcgaguccgacacuggauguacuccccgguuauccucacaauacucgccaucggacuggccgaaucaugcgacgaaaugguccacgcagacuccaaacucguauccugccgccaaggaagcggcaacaugaaagaaugcgucacaacgggccgcgcgcuccuccccgcggucaauccaggacaagaggccugccuccacuucaccgcccccggcucgccagacuccaaaugccuaagaaucaaagucaaacgcauaaaccuaaagugcaaaaagucgucaucuuacuucgucccagacgcaaggucacgauguacgagcguacgacgaugcagaugggccggcgacugccaaagcggaugcccaccacacuucaccucaaacagcuucagcgacgacugggcaggcaaaauggaccgagcagggcuaggauucucaggcugcucagacggauguggcggcgccgcauguggcugcuucaacgcagccccaucaugcauauucuggaggaaaugggucgagaacccgcacggcaucaucuggaaagucucaccaugcgccgccugggugccauccgcaguaaucgagcucaccaugccaagcggagaaguacgcacguuccaccccaugagcgggauacccacacagguauuuaaaggagucagcguuacguaccuagguuccgacauggaaguaagcggccuaacagaucucugcgagaucgaggaacucaagagcaagaaacucgcacuagcuccuugcaaccaagccggcaugggaguaguaggaaaagucggagaaauccaaugcuccucagaagaaagcgcacgaacaaucaagaaggacggcugcaucuggaaugccgaccuaguaggcaucgaacuaagagucgacgacgccgugugcuacucgaagauuaccuccguugaagccgucgcaaacuacagcgccauuccaaccaccauaggcgggcuacgauucgaacgcucacaugacucccaaggaaaaauaagcgggagcccgcucgacaucaccgccauaagaggcagcuucucugucaacuacaggggauuacggcuaucacucagcgaaaucaccgcgacaugcacuggagagguaaccaacguauccgggugcuacucaugcaugacaggcgcaaaagucuccauaaaacuccauucauccaaaaacagcacggcacauguaaggugcaagggggacgagaccgcauucaguguccuagaaggaguccacuccuacacaguaagccucuccuucgaccacgccguugucgacgaacagugccagcucaacugcggcggccacgaaagccagauaacccucaagggcaaccuaaucuuccucgacguccccaaauucgucgauggaagcuacaugcagaccuaccauuccacuguaccaaccggagccaacaucccgaguccuaccgacuggcucaacgcccucuucggcaauggacuuagucgaugggucuugggcgucaucggcguucugcucggcggccuagcacucuucuucaugauuaugagccuauucaaacuaggcacuaaacagguauuccguagccgaaccaaacuugcguag

SEQ ID NO: 16503 - RNA, 3222 nt, Artificial Sequence
  derived and/or modified CDS sequence (opt11) from SFTSV(HNXY_174)__KC292306.1__GP
augaugaaagucaucugguucucaucgcuaauaugcuucgucauacaaugcuccggagacagcggcccuaucauaugcgccggccccauccacagcaacaaaucggccgacauaccgcaccuacuaggcuacucugagaagauaugucaaauagaccgccucauccacgugagcuccuggcuccgaaaccacagucaauuccaaggguacgugggacagcgcggaggccgaagccaagucagcuacuaccccgccgaaaauagcuacagccgcugguccggccugcuauccccaugcgacgcggacuggcuaggcaugcuaguagucaagaaagcuaaaggcucagauaugauaguacccgggcccagcuauaaaggcaaaguauuuuucgaacgucccacauucgauggauaugugggcugggggugcggcucgggaaagagccgcacagaaagcggggaacucugcuccagcgacagcgggaccuccagcggacuacucccaagcgaccggguauuauggaucggcgacgucgccugucagcccaugacccccaucccagaagagaccuuccuggaacuaaaauccuucagccaaucggaguucccugacaucugccgcaucgacgguauugucuucaaccaaugcgaaggagaaucacucccccagcccuuugacguggccuggauggacgucggacauucccacaaaauaauaaugagggaacacaaaacaaaauggguccaggaaagcuccuccaaagacuucgucugcuacaaagaggggacgggacccugcucagagagcgaagagaaaacaugcaagaccagcggaucaugccgcggggacaugcaauuuugcaaggucgccgggugcgaacacggagaagaggccucggaggcaaaaugccgcuguucgcuaguacacaagccaggagaagucguagucagcuacggcgggaugagggugcgcccgaaaugcuauggauucucacgcaugauggcaacucuagagguaaaccaaccagaacaacgaaucggacaaugcacaggaugccaccuagaaugcaucaacggaggcgugagauuaauaacgcucaccagcgaacuaaaaagcgcaacagugugcgcgagccauuucugcucaagcgcgacgagcgggaagaaaagcaccgagauacaauuccacagcggaucccuugucggcaaaacagcgauacacgugaaaggcgcccugguagacggcaccgaauuuaccuucgaaggaucgugcauguucccugacggaugugacgccgucgacugcaccuucugccgggaauuucucaaaaacccacaaugcuaccccgccaaaaaguggcuauucaucaucauaguaauccucuuaggauacgcaggcuuaaugcugcuuacgaauguacuuaaggccaucggcauaugggggucauggguaauagccccagugaagcugaucuucgccaucauaaagaagcucaugcgaaccgugaguugccucaugggcaagcuaauggaccgugggagacaaguuauacacgaagaaaucggagaaaacagggaaggaaaccaggacgacguccggauugaaauggcaaggccuaggagagugagacacuggauguacagcccagugauccuaacaauccuggccauaggccuagcagagagcugcgacgaaaugguccacgcagacagcaaacucgucagcugcaggcaagguagcggaaacaugaaagaaugcguaaccacgggcagagcucuacuaccggcggucaacccgggccaagaggcaugccuucauuucacagcccccggaagccccgacagcaaaugccuaaggauaaaagucaaaagaaucaaccugaaauguaagaaaagcuccagcuacuucgugcccgaugccagaagcagaugcacauccgucaggcgcugcagaugggcaggcgacugccaaagcggaugcccgccacacuucacaagcaacagcuucucagacgauugggccgggaaaauggacagagccggccucggcuucucaggcugcagcgacggcugcggaggggccgccugcggaugcuucaacgcagccccguccugcauauucuggaggaaaugggucgaaaacccgcacgggauaaucuggaaagucagcccaugcgccgccuggguucccucagcagucaucgaacucacaaugccaagcggagagguacgcaccuuccacccaaugucaggcaucccaacccaggucuucaaaggggucuccgucacauaccuaggaagcgacauggagguaaguggccuaacugaccuaugcgaaauagaagaauuaaaaagcaagaaacuagcacuagcgcccuguaaccaagccggaaugggcguagucggcaaagucggcgagauucaauguucaucagaggaaagcgcacgcacaaucaagaaagauggcugcauauggaaugcagacuuagucgggaucgaacuacgugucgacgacgcagucugcuauuccaaaaucacaagcguggaagccguagcaaacuacagcgccauccccacaacgauaggaggacuccgauucgagcgaagccacgacucccaagguaagauuuccggcagcccccuggacauaaccgcgaucaggggcagcuucagugugaacuacaggggucuucgacucagccucuccgaaauaacggcaaccugcaccggugaggucacgaacguaucaggaugcuacuccugcaugaccggagcaaaagucagcaucaaacuccacucgagcaaaaacucaacagcucacguacgauguaaaggagacgagacagccuucucaguccucgaaggaguacauagcuauacagucucacuaucguucgaccacgccguaguggacgaacaaugccaacuaaacugcgguggccacgaaagccaaguaacuuuaaaaggaaaccuaaucuuccucgacguaccaaaauucgucgacggaucguacaugcaaacauaccauagcaccguaccgacgggagccaauauaccuuccccgaccgacuggcugaacgcccuuuucggcaacggaaugagccgguggauauuaggagucaugggcgugcuccucggcgggcucgcacucuucuucaugauaaugagccuauuuaaacuaggaaccaaacaaguguuccgcagccgcacaaaacucgccuag

SEQ ID NO: 16504 - RNA, 3222 nt, Artificial Sequence
  derived and/or modified CDS sequence (opt11) from SFTSV(HNXY_182)__KC292324.1__GP
augaugaaagucauaugguucagcucacugaucugcuucgugauacagugcuccggagacucaggaccaaucaucugcgcagggccgauucacagcaacaaaagcgccgacauaccacaccuacaaggcuacucggagaagauaugccaaauagacagacuaauccacgucagcucguggcuacgcaaccacagccaauuccaaggcuacgucggucaacgaggagggcgcagccagguaucguacuauccugccgagaauagcuacucgagguggagcggccuccuaucucccugcgacgccgauuggcuaggcaugcucgucguaaagaaagcaaaagggagcgacaugaucguacccgggcccucauacaaaggcaaaguauucuucgaacgaccgacguucgacggauacguaggcuggggcugcggcucgggcaaaagcagaaccgaaaguggagaauuaugcagcagugacagcggcaccagcagcggacugcuaccauccgaccggguacuguggauaggggacgucgcaugccaaccaaugacaccaauaccagaagaaaccuuccucgaacucaagagcuucucacagagcgaguuccccgacaucugcaaaaucgacggcauaguauucaaccagugugaaggcgaaagccucccacagccguucgacguggccuggauggacgucggucacucacacaaaaucauaaugagagaacacaagaccaaaugggugcaagaaagcuccaguaaagacuucguaugcuauaaagaaggcaccgggccaugcucggaaucagaagagaaaacaugcaagacauccggcuccugucgcggggauaugcaauuuugcaaaguagcagguugcgaacacggggaagaggcuuccgaagcaaaaugccggugcagccuagugcacaaacccggcgaaguaguagugucuuacggaggcaugcgggucagaccaaaaugcuacggauucagcagaaugauggccacccuagaagucaaccagccagaacaaagaauugggcaaugcaccgguugccaucucgaaugcaucaaugggggcguaagacucaucacacugacauccgaacuaaagagcgcgaccgucugcgccagccacuucugcuccucagcaacaagcggcaaaaaguccaccgaaauacaauuccauuccggcucgcuaguaggcaaaacagccauacacgugaagggagcucuagucgacggcacagaguucacauucgaagggagcugcauguuccccgacggaugugacgcaguagacugcacauucugcagggaguuccucaaaaacccacaaugcuacccagccaaaaaguggcuguucauaauaauagucauccuccuuggauacgccggacuaauguuacucacaaacguccuaaaggcaaucggcauauggggaucauggguuaucgcaccggucaagcugaucuucgcaaucaucaagaaacucaugagaacagucagcugcuugauggguaaacugauggaccgaggccgacagguaauccacgaagaaaucggagaaaaccgggaagguaaccaggacgauguaaggaucgaaauggcccgacccagaagagugaggcacuggauguacucaccaguaauccuaacgauccucgccauaggccucgcagaaucaugcgacgaaaugguucacgccgacucaaagcuaguauccugccgacaaggguccggaaacaugaaagaaugcgugaccacaggccgcgcauuacucccagcaguaaacccgggacaggaagccugccugcacuucacugcaccaggcagccccgacagcaaaugccucaaaauaaaagucaaaagaauuaaccuaaaaugcaagaagaguucgagcuacuucgugcccgaugcccgaagucgaugcacgucagugagacgaugccgaugggcaggcgacugccaauccggaugucccccucacuucaccagcaacagcuucagcgacgacugggcaggaaaaauggacagagccggccucggguucuccggcugcucagacggcugcggcggggcagcgugcggaugcuucaacgcggcuccaagcugcaucuucuggagaaaaugggucgaaaauccacacgguauaaucuggaaagucucaccaugcgcagcauggguacccucagccgugaucgaacugacaaugccaucaggggaagugcgaacuuuccauccaaugagcgggaucccaacccaaguauucaaaggagucuccguaaccuaccugggaucagacauggaaguaagcggacugacagaccuaugcgagaucgaggagcucaaaucaaagaaacuggcacucgcacccugcaaccaagcaggaauggggguaguuggcaaagucggagaaauucaaugcaguucggaagaaucagccagaacaauaaagaaagacgggugcauauggaaugcggaucuagucgggaucgaacugaggguagacgacgcugucuguuacuccaaaauaaccaguguagaggccgucgccaacuacucggcaaucccaacaacaaucggcggccuacgauucgagcgcagucacgacucccaaggaaaaaucuccgggagcccacucgacaucaccgcaaucaggggcucguucagugucaacuaccggggacucaggcuaagccugagcgagauaacggccacgugcacgggugaagucacgaacgucagcggcugcuacuccugcaugacaggcgccaaaguaagcaucaaacuacacucaagcaaaaacucaaccgcacacgugcgcugcaaaggggacgagaccgcguucaguguccuggaaggcguacacuccuacacagugucccugucauuugaccacgccguggucgacgaacagugccaguuaaacugcggcggccacgagucccaaguuacccucaagggaaaccuaauauuccucgacguaccuaaauucgucgacggcucauacaugcaaaccuaccacagcaccguuccgacgggugcaaauauaccaucaccuacagacuggcugaacgcacucuucggcaacggacugagccgguggauccucgggcuuaucggaguccuacucgggggacuagcccuguucuucaugauuaugagccucuucaagcucggcacuaaacaggucuuuaggucgaggacaaaacuagccuga

SEQ ID NO: 16505 - RNA, 3222 nt, Artificial Sequence
  derived and/or modified CDS sequence (opt11) from SFTSV(HNXY_188)__KC292301.1__GP
augaugaaaguaauaugguucagcagccuaaucugccucgucauacaaugcgggggcggaacaggaccgaucaucugcgccggcccaauacacucaaacaagucagccgacaucccgcaccuccucggguacagcgagaaaauaugccaaauagacagacuaauacauguaucgagcuggcugcgcaaccacagccaauuccaaggcuacguaggacaaagaggcggcaggucccaaguaucguacuaucccgcagaaaauaguuauagcagaugguccggacuguuaagcccgugcgacgccgacuggcuagguaugcuagucgugaagaaagccaagggcucggacaugauugugccagggccaagcuacaaaggaaagguauucuuugaacggccgaccuucgacggauacguaggcuggggaugcggaucgggaaagagccgaacagaaaguggagaacugugcucaagugacagugggacaucgucaggacucuuaccaucggacaggguacucuggauaggcgacguggcaugccagcccaugaccccaauaccggaggaaacauuccucgagcucaagagcuucagccaaagcgaguucccagacauaugcaaaaucgauggaauagucuucaaccaaugcgaaggagagagccuaccucaacccuucgacguggccuggauggacgucgggcacagccacaaaauaauuaugagagagcacaagacaaaguggguacaagagagcuccagcaaagacuucgugugcuacaaagaaggcaccggcccaugcagcgaaucggaggagaagacaugcaaaacgucaggaucguguagaggagacaugcaguucugcaaaguagcaggaugcgagcacggcgaagaagcauccgaagcaaaauguagaugcagccucguacauaaacccggcgaaguaguggucucguauggagggaugagggugcgcccaaaaugcuacggguucucgcgcaugauggccacgcuagaggugagccaaccagaacaacgcaucgggcagugcacgggaugccaccuggaaugcauaaauggcgggguccgccugauuacgcuaacaagcgagcuaaagagcgcaacaguaugugcaagccacuuuugcagcuccgcgacgagugggaagaaaagcacagagauacaauuucacagcggcucacucguaggaaaaacagccauccacgucaaaggagcucuagucgacggaacagaguucacguucgaaggcucaugcauguuccccgauggaugcgacgcagucgacugcacauucugcagagaguuccuaaagaauccacagugcuacccagcaaagaaauggcuauucauaauaauaguaauccuccuaggauacgcgggacuaaugcugcucaccaacguccuaaaagcaauaggggucuggggcagcuggguuaucgcgcccguaaaacucguauuugccauaauaaagaaacuaaugcgcgcgguaagcugccuaauggggaaacucauggacagaggacgacaagugauccacgaagaaauaggcgaaaacagagaaggaaaucaggacgacguccggauagaaauggcacgaccgcgaagaguacgacacuggauguacagcccgguuauacucacuauccuggcuaucggccuggcagaggggugcgacgaaauggugcacgccgacagcaaacucgugucaugcagacagggaagcggcaacaugaaagaaugcgugacaacaggccgagcccuccucccggcagugaacccaggccaagaagcaugcuuacacuucacagcgcccgggagccccgacaguaaaugccucaagauuaaggucaagcgcaucaaccugaaaugcaaaaagagcuccuccuacuucguccccgacgcaaggucccgcugcacaagcguaagacgguguagaugggcgggagauugccaaagcggauguccuccccacuucacaaguaauuccuucagcgacgacugggccgggaaaauggacagagcaggacuaggauuuagcggcugcucagacggcugcggcggagcugcguguggcugcuucaacgcagcaccguccugcauauucuggaggaaaugggucgagaacccacacggcauaauauggaagguaagucccugcgcagcauggguccccucggcagucaucgagcugaccaugccaagcggcgaaguccgaacguuccaccccauguccggcaucccaacacaggucuucaaaggcgucagcgucaccuaccuuggauccgacauggaagugagcggccugaccgaccucugcgaaaucgaggaacucaagagcaagaaacuugcgcucgcgcccuguaaucaagccgggaugggggucguaggcaaagucggcgaaauucaaugcagcucagaggaaucggcacgcacuauaaagaaagacggcuguauuuggaacgcggacuuaguuggcauagaacuccguguggacgacgcgguaugcuacucaaaaauaaccucaguggaggccguagcuaacuacuccgcuauaccuacaacaaucggcggccuacgauuugagagaucccacgacagccaaggcaaaauaagcggaaguccacucgacauuacagcuauaagaggcucguucagcguaaacuacaggggguuacguuugucauuauccgaaaucacagcaacaugcacgggagaaguuacaaacgugagcgggugcuauagcugcaugacaggggcgaaagucagcaucaaauuacacucuuccaaaaacucaaccgcgcacgugcgcuguaaaggagacgagacugcguucucagugcuggaagggguacacucauacagcgugucccugagcuucgaccacgcaguaguggaugagcaaugccagcuaaacugcggaggccaugagucgcaagucacacugcgcgggaaccugauauuccuagacgucccaaaauucgucgacggcagcuacaugcaaaccuaccacagcaccguccccacaggagcgaacauccccagcccaaccgacuggcugaaugcccuauucgguaacggccugaguagauggauacuaggggucauagggguacuccuaggaggacuagcgcuauucuuccucaucaugagcuuguucaaacucgguacaaaacagaucuuccgaagccgaacaaagcucgcauaa

SEQ ID NO: 16506 - RNA, 3222 nt, Artificial Sequence
  derived and/or modified CDS sequence (opt11) from SFTSV(HNXY_191)__KC292323.1__GP
augaugaaaguuaucugguucagcagccuuauaugccucgucauacaaugcggaggagacacggguccgaucaucugcgcaggccccacccacagcaacaaauccgccgacauaccgcaucugcuaggauauucagagaaaaucugccaaauagaccgacucauacacguaucaucauggcuacgcaaccacucccaguuccagggauacgucgggcagcgaggaggcaggagccaagugucauacuaccccgcagaaaacaguuauucacgcuggucaggucuacucucacccugcgacgcggauuggcuugggaugcuugucgucaaaaaggcaaaagggagcgauaugauaguacccggaccauccuacaaggggaaaguauuuuucgaacgcccgacauucgacggauacgucgggugggguugugggucaggaaaaagcaggaccgaaagcggagaacugugcuccagcgacagcgggacgagcagcggacuacucccuucagaccgcguacuguggauaggcgacguugcgugccaaccuaugacaccuauuccggaagagacuuuucucgagcucaagagcuuuagucaaagcgaguucccagacaucugcaagauagacggcauagucuucaaccaaugcgaaggcgaaagccuaccccaaccguuugacguggccuggauggaugucggacacucacacaagaucauaaugagagaacacaaaacaaaauggguccaagaaucaagcucgaaagacuucguaugcuauaaagaagggaccggcccgugcucugaaucagaagagaaaacaugcaagaccucaggcuccuguagaggagacaugcaauucugcaaaguagccggaugugaacacggagaagaagccucagaagcgaaaugcagaugcucccuuguccacaaacccggcgaggucguaguuucguacggaggaaugcgaguaagacccaaauguuacggauucucgcguaugauggccacccucgaagugagccagcccgaacagcgcauaggucaaugcacagguugccaccuugagugcaucaacggcggggucagacugauuacacucaccagcgaauugaaaagcgccacagucugcgcaagccacuucugcagcagcgccacgagugggaagaaaagcacugaaauacaauuccacucagggagccucguaggaaaaacagcgauacacgucaaaggagcccuaguagacggaaccgaguucacauucgaagggucgugcauguuccccgacgggugcgacgcaguggacugcaccuucugcagggaauuucucaaaaacccacaguguuaccccgcaaagaaauggcuauucaucaucaucgucauacuccuaggauacgcaggccuaaugcuccugacgaacguauuaaaagccauaggcguguggggcuccugggucaucgcccccgucaaacucguguuugccaucauaaagaaauuaaugcgagccguuagcugccugauggguaaacuaauggaccgaggaaggcaggucauccacgaagaaaucggcgaaaaccgcgaaggcaaccaagacgacguccgaauagaaauggcgcggccgcgacgagucagacacuggauguacagcccaguaauacugacaaucuuagccauaggacucgccgaaggaugcgacgagaugguccaugcagacaguaagcuagucagcugccgacaaggcagcggaaacaugaaagaaugcgucacaaccggacgcgcgcuccuaccagcagucaaccccggccaggaagcaugccuacacuucacagcgcccggaagcccggacaguaagugucucaaaaucaagguuaaacgcaucaaucucaaaugcaaaaagaguucaagcuacuucguacccgacgcacgcucacgauguaccucaguacggcgaugccggugggccggagacugccagagugguugcccgccacacuucaccuccaauagcuucagcgacgacugggccgggaaaauggauagagccggacuaggguucuccggcugcuccgacggcugcggcggagcggcaugcgggugcuucaacgccgcaccgaguugcauauucuggcggaagugggucgagaacccgcaugguauaauauggaaagucagccccugcgcagcgugggugcccucagccgucauagaacucacaaugcccucaggugaagugcgcacauuccacccaaugagcggcauccccacccaggucuucaaaggcguauccguaacauaccucggcagcgacauggaaguaagcggacucacagaccucugcgaaaucgaggaacucaaauccaagaaacucgcucucgcgccauguaaccaggcaggcaugggagucgugggaaaagucggagaaauacagugcuccucagaagaauccgcacgaacaaucaagaaagacgggugcaucuggaacgcugaccucguaggcauagaguuaagaguagacgacgcaguauguuauagcaaaaucacaagcgucgaggccguugcgaacuacagugccauacccaccaccauagggggucuaagguucgaacgaucacacgacagccaaggaaaaaucucagguucgccccuggacauaaccgcaauaaggggcucauucucaguaaacuacagaggauugcgccucagccugagcgagaucacagcuaccuguacgggugagguaacaaauguuaguggcuguuacagcugcaugacgggagccaaaguaagcauaaaacuacacucaagcaagaacucgacggcgcacgucaggugcaagggagacgagaccgcuuucaguguccuggaagggguccacagcuacagcgugagccuuagcuucgaccacgccgucguggacgaacagugucaacuaaacugcgggggacacgagucccaagugacucugcgcgggaacuugauauuccucgacgucccgaaguuugucgacggauccuauaugcaaacauaucacagcacagucccaacaggagcaaauauaccgagcccgaccgacuggcuaaacgcacuuuucgggaacggccuauccagauggauacuaggcgucauagggguacugcucggaggacucgcgcuuuucuuucuaaucaugagccuauucaaacuagggacaaagcaaaucuucagaagccguaccaagcucgcguga

SEQ ID NO: 16507 - RNA, 3222 nt, Artificial Sequence
  derived and/or modified CDS sequence (opt11) from SFTSV(HNXY_195)__KC292326.1__GP
augaugaaggugaucugguucagcucgcucauaugcuucgucauccaaugcuccggcgacaguggacccaucauaugugcaggccccauacauagcaauaagucggcggacauuccacaccuacagggauacuccgagaaaaucugucaaauagacaggcucauucacgucagcagcuggcucagaaaccacucacaauuccaagguuauguaggccaacgcgggggaagaagccaagucuccuacuaccccgcagaaaacaguuacucccgcuggucaggccuccugagccccugcgacgcagacuggcuagggaugcucguaguuaagaaggccaaaggguccgacaugauagugccaggcccgagcuacaaaggcaaaguauucuucgaaagaccaacguucgacggauacgucggauggggaugcggauccgggaaaagcagaaccgaaagcggagaacuuugcucgagcgacaguggcacuucgaguggacuacucccuucggacagagucuuauggauuggagacgucgccugccaacccaugacacccauccccgaggaaaccuuccucgaacuaaaaucauucucccagagugaguuccccgacaucugcaaaauugacgggauagucuuuaaucaaugcgaaggagaaucacucccccaacccuucgacgucgccuggauggacgugggccacucccacaaaauaaucaugagggagcacaaaacaaaaugggugcaagaaucgagcagcaaagacuucgugugcuacaaagagggcacaggaccaugcagcgaauccgaagagaaaacgugcaaaacguccggcucgugcaggggagacaugcaauucugcaaaguagcaggcugcgaacacggagaagaagccagcgaagcaaaaugcagaugcagccugguacauaaaccgggggaagucguaguauccuauggagggaugcgcgugcggccaaaaugcuacggguucucgagaaugauggcgacgcuagaagugaaccaacccgaacagagaauaggacaaugcaccggcugccaccucgaaugcaucaacggaggcguacgcuuaaucacccugacaagcgaacucaaaucggcaaccgugugcgccagccauuucugcagcuccgccacgagcgggaagaaaaguacagaaauacaauuccacagcgguucacuuguaggcaaaacggccauccacguuaaaggcgcccuugucgacgggacggaguucacauucgaaggcucgugcauguucccagacggaugcgaugcaguagauugcaccuucugucgcgaguuccuaaagaacccccagugcuacccggccaagaaaugguuauucaucaucauagucauccuccuuggcuacgcaggacuaauguuacuuaccaauguacucaaggcgaucggcaucuggggaucauggguaaucgccccagucaagcucauauucgccaucauaaagaaacucaugagaacggucucaugccucaugggaaagcugauggaccgaggccgccaggucauccacgaagaaaucggagaaaacagagaaggaaaccaggacgacguccgaauugaaauggcccgaccgcgcaggguaaggcauuggauguacucacccgucauccuaaccauacuagcaaucggccuagccgaaagcugcgaugaaaugguacaugcagacagcaagcuagucagcugccgccaagggagcggcaacaugaaggagugcgugaccacagggagagcacucuuaccggcagucaacccgggacaagaagccugccugcacuucacggccccagguagcccagacucaaaaugccuaaaaaucaaggucaagaggaucaaccucaaauguaaaaaguccagcagcuacuucgucccagacgcacgcuccagauguacgucuguacgcagaugcagaugggcaggagacugccaaagcgggugcccgccccacuucacuagcaacagcuucagcgacgacugggccggcaaaauggaccgagcaggacucggauuuuccggcugcagugacggcugcggcggagccgcaugcggcugcuucaacgcggcgcccagcugcaucuucuggcgaaaaugggucgaaaauccccacggaaucauauggaaaguuagcccgugcgcggcauggguacccagcgccguuaucgagcugacaaugccauccggggagguacgaaccuuccacccgaugagcggcauacccacacagguguucaaaggcgucagcgucacauaccuuggguccgacauggaagucuccggccuaaccgacuuaugcgagaucgaagaacuaaaaucgaagaaacucgcacuagcccccugcaaccaagcuggaaugggcguaguggggaaaguaggagaaauccaaugcucuagcgaagaaagcgcccgaaccaucaagaaagacggcugcauauggaacgccgaccucguggggaucgaauuaagagucgacgaugcaguaugcuauagcaaaaucaccaguguagaggccguagcgaacuacucagcgauacccaccaccauaggcgggcucagguucgaacgcucucacgacucccagggcaaaauaucaggcuccccguuagacaucacagccauccggggcagcuucucagugaacuacagaggacuccgacuaucgcugagcgaaaucacggcaaccugcacaggcgaaguaaccaacguaucgggaugcuacagcugcaugacaggcgcgaaaguaagcauaaaauuacauaguagcaagaacucgaccgcacauguaagaugcaaaggcgacgagacagcguucucagucuuagagggaguacacagcuacacugugucauuaucauucgaccacgcaguagucgacgaacaaugccaguuaaacugcggcggccacgagagccaaguaacccuaaaagggaaucugauauuccuagacguaccaaaguucgucgacggcucguacaugcaaacguaccacagcacugucccaaccggcgccaacauaccgagccccaccgacuggcuaaacgcccuuuucggaaacggccucagccgauggauccucggugugauaggaguccuguuaggcgggcuagcccuauucuucaugaucaugagccuauucaagcucggaacaaagcaagucuucagaagccgcaccaagcuagccuaa

SEQ ID NO: 16508 - RNA, 3222 nt, Artificial Sequence
  derived and/or modified CDS sequence (opt11) from SFTSV(HNXY_2)__KC292318.1__GP
augaugaaaguaauaugguucagcagccuaauaugcuuuguaauucaaugcagcggagacagcggcccaaucaucugcgcaggaccaauccacucaaacaaaucagccgacaucccacaccuacuaggauacagcgaaaagaucugccagaucgaccgacuaauacacgucucguccuggcucagaaaucacucgcaauuccaaggauacguagggcaaagagggggucggagccagguauccuacuacccagcagagaacagcuacagcagauggucagggcuacucucgccgugugacgcugacuggcuaggaauguuaguagugaaaaaggcaaagggcucagacaugaucgucccagggccauccuacaaaggcaaaguauuuuucgaaagaccuacauucgauggcuacgucggcuggggcugcggcagcggcaagagccgaacggaaucaggggaacucugcagcagcgacuccgggacaagcagcggccuacuccccucagacaggguacuauggauaggagacgucgccugccaaccaaugacgcccaucccugaagagacguuucuagagcuaaagagcuucagucaguccgaguuccccgacauaugcaaaauugauggaauaguuuuuaaucaaugcgaaggagaaucacuuccccaaccauucgacgucgccuggauggaugucggccacagccacaaaauaaucaugagagagcacaagacgaaauggguccaggagucgagcuccaaagacuucguuugcuacaaagaaggcacagggccgugcucggaaagcgaggagaaaacaugcaaaaccuccggaagcugcagaggcgauaugcaauuuugcaaaguggccgguugcgaacacggagaagaagccagcgaagcuaaaugcagaugcagccucguccacaagccgggagaggucguggucucauacggcggcaugcgugugagaccaaaguguuacggauucucgcgcaugauggcgacacuagaagucaaccaaccagagcagaggaucggacaaugcacaggaugccaccucgagugcauaaacggcggcguacgccucaucacccuaacaagcgagcuaaaauccgcaaccgugugcgccagccacuucugcuccagcgccaccagcggaaagaaaagcacagaaauucaauuccacagcggcagucucguaggcaaaacagcaauacacgucaaaggagcacucguagacggaacagaauuuaccuucgaaggaagcugcauguucccagacggaugcgacgccguugacugcaccuucuguagagaguuccucaaaaacccacaaugcuacccagccaagaaauggcuauucaucaucauagugauccuccuuggguacgcuggccugauguuacucacaaacguccugaaagcaauagggauauggggaucgugggucaucgccccugucaagcuaauauucgcaauaauuaaaaagcucaugaggacagugaguugccuaauggguaaacugauggaccgcggacgucaagucauacacgaagagaucggcgaaaacagggaaggaaaucaagacgacguccgcaucgagauggcaagaccaagacgcguaagacacuggauguauaguccgguaauccucacgauccucgcaaucggccucgcggaauccugcgacgaaaugguccacgcggacuccaaacugguaucgugccgccaaggaagcggaaacaugaaagagugcguaacaacgggcagagcucugcugccagccguuaacccggggcaagaggccugccuacacuucacugcaccaggcagcccggacuccaaaugccucaagaucaaagucaaaagaauaaaccugaaaugcaagaaauccucaagcuauuucguaccugacgcucggagccguugcaccagcguccgaagaugccggugggccggagacugccagagcggcuguccaccccauuucacguccaacagcuucagcgacgacugggccggaaaaauggacagagcaggccucggguucucaggcugcuccgacgguugugguggcgccgcaugcggaugcuuuaacgccgcccccagcugcauauucuggcggaaauggguagaaaacccacacggaauaauauggaaagucucccccugugccgccugggugccaagcgcaguaauagaacucacaaugccgucaggagagguccgcacguuccacccaaugucgggaaucccaacacaaguuuucaaaggcgugagcgucacguaccugggcucggauauggaggucagcgggcugaccgacuuaugcgaaauugaggaguuaaaaucgaagaaacuggcacuggcaccgugcaaccaagccggcaugggagugguaggaaaaguaggggaaauccagugcuccucggaagaaucagcacgaaccauaaagaaagauggaugcauuuggaacgccgaccugguugguauagagcuuagaguagacgacgcaguaugcuacagcaaaauaaccaguguagaagcggucgcgaacuacucggccauaccaacaaccauaggcggccuucgguuugagcgaucgcacgacucccagggcaaaauaucaggcucgccccuggacauaacagcaauaagaggcucauucucagucaauuacagaggccuaagacugagccugucagaaaucacagcaaccugcaccggggaggucaccaauguauccggaugcuacuccugcaugacaggggccaaaguaagcaucaaacugcacucgaguaaaaacucgaccgcccauguacgcugcaaaggggaugagaccgcauucagcguccuggaaggcguucacagcuacacagucucccugagcuucgaccacgcugucgucgacgaacaaugccaacucaacugcggcggccaugaaucacaagucacacuaaaaggaaaucucauauuccuagacgugccgaaauucguagacggaucauacaugcaaaccuaccacuccacagugccaaccggcgccaacauaccaagucccacugauuggcucaacgcacucuucggcaacggcaugucgagguggauauugggaguaauagguguacuacuaggcggacuagcacucuucuucaugaucaugagcuuguuuaaauuggggaccaaacaaguauucagaagccggacgaaacuggccuga

SEQ ID NO: 16509 - RNA, 3222 nt, Artificial Sequence
  derived and/or modified CDS sequence (opt11) from SFTSV(HNXY_202)__KC292325.1__GP
augaugaaagucauaugguuuagcucccuaauaugcuucgucauccaaugcagcggagauagcggaccaauaauaugcgcgggacccauacauuccaacaaaucggcagacauaccucaucugcucggcuacucagagaaaauaugccaaauagaccgccuaauccacguaagcuccugguuacgaaaccacucgcaauuucaaggauacguaggccaaagagggggacguagccaggucagcuacuaccccgcggaaaacagcuauagccgguggagcggccuccucuccccaugcgacgccgacuggcucgggauguuagucguaaagaaggccaagggcucagacaugaucgugcccgguccaucuuacaaaggcaaaguauucuuugaacgcccuaccuucgacggguacgucggcuggggaugcggcucaggcaaaucuaggacagagaguggugaacugugcuccagcgacucggguaccucgucugggcuccucccaagcaacagaguccuuuggauaggagacguagcaugccaaccgaugacgccaauacccgaggaaacauuccuagagcucaagagcuucagccaaagcgaauuucccgacauaugcaaaauagauggaaucguauucaaccagugcgaaggcgaaagccucccccaaccauucgacguggcauggauggacgucgggcacagccacaaaauaaucaugagagaacacaaaaccaaauggguccaagaaagcuccucaaaagauuucguuugcuacaaagaaggcaccggccccugcagcgaaucagaagagaaaaccuguaaaacuuccggcucgugccgcggugacaugcaguucugcaaagucgcagggugcgaacacggagaagaagcgucggaagcaaaaugucgaugcagccuagugcacaaacccggugaggucgucgucucauauggcggaaugcgaguacgcccgaaaugcuauggauucucacgcaugauggcuacccuagagguaaaccagcccgagcaacggauuggccaauguacugggugccaccucgaaugcaucaacggaggcguacgacugauaacacucacauccgaacucaagagcgcaaccgucugcgccucgcacuuuugcaguucggccacguccggcaaaaagagcacagagauacaauuccacuccggcucccugguaggaaaaaccgccauacacguaaaaggcgcccucgucgacggaacagaguucacguucgaaggcagcugcauguucccagacggaugcgaugccgucgacuguacauucugcagagaguuccucaagaacccacaauguuacccagcaaagaaauggcuauucauuauaaucguuauccugcucggcuacgccggccuaaugcuacuaaccaacguccuuaaagcaaucggcaucuggggaagcuggguaaucgcucccgucaaauuaauauucgcgaucauaaagaaauuaaugcgaacgguaucaugccuaaugggcaaacucauggaccgcggccgacaaguaauacacgaagaaaucggcgaaaacagggaaggaaaccaagacgacguccgcaucgaaauggcccgcccccgccgcgucagacacuggauguacagcccaguaauacuaaccauccuggcaauaggcuuggcagaauccugcgacgaaaugguucacgcggacaguaaacucguuagcugccgccaaggcagcggcaacaugaaagaaugcguaaccacggggagagcacuacuacccgcgguaaaccccggacaagaagcaugccuccacuucaccgccccuggauccccggacuccaaaugccuccgcaucaaaguaaagaaaauuaacuugaaaugcaaaaggagcuccagcuauuucguccccgacgcacggagccgaugcacaagcguacgccgcuguaggugggccggcgauugccagucugggugcccaccgcacuuuacaagcaauuccuucagcgacgacugggcaggcaaaauggaccgggccgggcucggcuucucaggaugcuccgacggaugcgguggagcagcaugcgguugcuucaaugcugccccaagcugcauauuuuggagaaaaugggucgaaaacccacacgguaucauuuggaaagucagccccugugccgcauggguccccucagcagucauagaacuaacaaugcccagcggagagguacgaacguuccaccccaugagcggaaucccaacacaaguauucaaagguguaagcgugaccuacuuaggcucagacauggaggucuccgggcugaccgaccuuugugaaaucgaggaacugaaaucgaaaaagcucgcgcuagcgcccugcaaccaagcgggaaugggagucguaggaaaaguaggggaaauacaaugcagcagugaagaaucagcucgcaccauuaagaaagacggcugcauauggaacgccgaccuggucggaaucgagcuacgcguagaugaugccgucugcuacuccaaaauuacaagcguagaagcaguagcuaacuacagcgccauaccaacaaccaucggcggacuccgauucgagagaucgcacgacagucaaggaaaaaucucaggcagcccccucgacauaacagcgauuaggggguccuucagcguaaauuacagaggccugcgccugucccuguccgagauaacagccacaugcaccggagaagucacuaacguaagcggcugcuacagcugcaugacgggagcgaaaguaagcauaaaacugcacucuuccaaaaacuccaccgcacacguacgauguaagggagacgaaacggccuucagcguacuggaaggcguccacuccuacaccgucucacuaaguuucgaccacgcugucgucgaugaacagugccaauuaaacugcggcggccacgagagucaggugacccuaaaaggaaaccucaucuuccuagacguacccaaguucguugacggcucauacaugcaaacguaccacucaacagucccaaccggagcaaauauuccuagccccaccgacuggcuaaacgcacuauucggcaacggucuauccagguggauacugggagucauggggguacuuuuaggaggccucgcccucuucuucaugaucaugagccuuuucaagcuaggcacaaaacaagucuuccgaagccgcaccaaacucgcauaa

SEQ ID NO: 16510 - RNA, 3222 nt, Artificial Sequence
  derived and/or modified CDS sequence (opt11) from SFTSV(HNXY_206)__KC292302.1__GP
augaugaagguuauaugguucagcucucucauaugccuagucauccaaugcggcggugacacaggccccaucaucugcgcgggcccaauccauagcaacaaaucagccgacauuccacaccuucugggguacuccgaaaagaucugccaaauagacaggcuaauccacguaagcuccuggcuccgcaaccacucucaauuccaaggguacguaggacaacgcgggggccggagccaagucucguacuaucccgcagaaaacagcuacagccgcuggucuggccugcuaucgccgugcgaugcagacuggcuaggcaugcuaguagugaaaaaggccaagggaagcgauaugaucguacccgggcccuccuacaaaggcaaaguauucuucgaaagaccgacuuucgacggauacguugguugggggugcgguucgggcaaaagcaggaccgagagcggggaguugugcuccucagauagcggaaccucauccggccuacuacccucagacaggguucuuuggauaggcgacguagcuugccaacccaugaccccgauaccggaagaaaccuuucuagaacucaagagcuuuagccagagcgaguucccagacaucugcaaaaucgacggcaucguuuuuaaccaaugcgaaggcgaaagccucccccaacccuucgacguggccuggauggacgucggacacagccauaaaaucaucaugcgcgaacauaaaacaaaauggguccaagaaucgagcagcaaagauuucgucuguuacaaagagggaacaggaccgugcucggaaucggaagagaaaacgugcaaaaccuccggcuccugccgcggagacaugcaguucuguaaaguggcagggugcgaacacggcgaggaggcguccgaagcaaaaugucgaugcagccucguacacaaacccggugagguaguaguauccuacggaggcaugcgcguaagaccuaaaugcuacggauucucccgcaugauggcgacacucgaaguaagccaaccagagcagagaauagggcaaugcacaggaugccaccucgaaugcauuaacggcggcguccgacugauuacucuaacaagcgaguuaaaaagcgcaaccguaugcgcaucgcacuucugcagcagcgcgaccucgggcaaaaagagcacagaaauacaauuccacucgggaucccucguaggcaagaccgcgauccacgugaaaggagcccucguagacggaaccgaguucacguucgaagguucgugcauguuuccggacgggugcgaugcaguggacuguacguucugcagggaauuucucaagaacccgcaaugcuaccccaccaagaaauggcuauucaucauaaucguuauacuccuuggcuacgccggguuaaugcuacugacaaacguacuaaaagccauaggcgugugggggagcugggucauagccccagucaaacucguguucgcgaucaucaaaaaguuaaugcgagcagucucaugccucauggguaagcuaauggaucgcggaaggcaagucauacacgaagaaaucggcgaaaacagggagggcaaccaagacgauaucagaaucgaaauggcgcgaccgagacggguaagacacuggauguacuccccggucauucugacaauccuagcuauuggccucgccgaaggcugugacgaaaugguacacgccgacucaaaacuggucucgugccgacaagggagcggcaacaugaaagagugcgugaccaccgggagagcacugcugccagcagugaacccaggacaagaagcaugccuacacuucacaacaccaggaagcccagauucgaaaugucuaaagaucaaggucaaacgcaucaaccucaaaugcaaaaagucaucaagcuauuucgugcccgacgcaaggucaagguguacuagcguacguaggugucggugggcgggcgauugccaaagcgguugcccgccccacuucacauccaacagcuuuagcgaugacugggcagggaagauggacagggccggccugggguucuccggaugcagcgacggaugcggcggcgcggccugcggaugcuucaacgccgccccgaguugcaucuuuuggaggaaauggguagaaaacccacacggcaucauuuggaaaguaagccccugcgcugcgugggucccaagcgcugugaucgaacucacuaugccgaguggggagguacgcaccuuccacccaaugaguggaauaccgacccaaguuuuuaagggcgucuccguaacauacuuaggaucggacauggaagucagcgggcugacagacuuaugcgaaaucgaggaacuaaaauccaaaaagcucgcacucgcaccaugcaaccaggccggcauggggguuguaggcaaggucggagaaauacaauguagcagcgaggaaagcgcacgaaccauaaagaaagacggaugcaucuggaaugcagaccucgucggaauagaacuacggguggacgaugcagucugcuacucaaagauaaccucggucgaagccguggcgaacuacagcgccaucccaaccaccauaggaggacuaagguucgaacgcucccacgauagccaaggaaaaauaucggggucuccacuggacaucaccgccauaagaggcucauucuccgucaauuacagaggcuuacgauuaagccuaagcgaaauaacggcgaccugcaccggcgaagugacgaacguuagcgggugcuauagcugcaugacaggcgcaaaaguaagcaucaaacuacacucgagcaagaacucgaccgcucacguacgauguaaaggggacgagacagcguucucuguccucgaagggguccauaguuacucagucucccucagcuuugaccacgccguggucgacgaacagugccagcugaacugcgggggccacgaaagucaaguaacucuccgcggaaaccuaauauuccuugacguuccaaaauucgucgacggcucuuauaugcaaacguaccacagcacagucccaaccggggcaaacauaccgagcccuacagauugguuaaaugcccucuucggcaacggccuaagccgauggauacuuggaguaauagguguacuacugggagggcuugcacucuucuuucucauaaugagccucuucaagcuaggaaccaaacagauauuccggaguaggacaaagcuagcauaa

SEQ ID NO: 16511 - RNA, 3222 nt, Artificial Sequence
  derived and/or modified CDS sequence (opt11) from SFTSV(HNXY_207)__KC292315.1__GP
augaugaaggucauaugguuccccagucuaauaugcuucguaauacaaugcagcggcgacuccgguccaaucauaugcgcagggccgauacacagcaauaaaagcgcagacaucccccaccuacuaggauacuccgagaaaaucugccaaauagacagacuaauacacguaaguuccuggcuaaggaaccauucgcaauuccagggauacguuggccagcggggcggccgaagccaggucucauauuacccugcugaaaacagcuacucacgauggucaggccuacucuccccaugcgacgcugacuggcucgggaugcuugucguaaagaaagccaaaggaagcgacaugaucgugccuggaccaucauauaagggaaaggucuucuucgaacggccaaccuuugacggcuacgucggauggggcugcggcagcggcaaaagccggacagaaagcggugaacugugcucgagcgauucagggaccucauccggacuccuaccaucagaccgaguucuauggauaggagauguagccugccagccaaugacaccaauaccggaagaaaccuuccucgagcuaaagagcuucagccaaagcgaguuccccgacauuugcaaaauagacgguauagucuucaaccaaugcgaaggggaaucccucccccagccauucgacgucgccuggauggacguaggccacucccauaaaauaauaaugcgcgaacacaaaacgaaaugggugcaagagucaagcaguaaggacuucguaugcuacaaagaaggaacagggccgugcucagaaagcgaagagaaaaccugcaaaaccagcggaucaugcaggggagacaugcaauucugcaaggucgcaggaugcgaacacggagaagaagccuccgaagcaaaaugccgcugcucacugguacacaagccgggugaaguaguggugaguuacggcggcaugcggguaagaccuaaaugcuacggauucagccgcaugauggcaacucuggaggucaaccagccggagcaacgcaucggccaaugcaccggcugccaccuagaaugcaucaacggaggcgugcgccugauaacacuaacguccgagcucaagucagcgacagugugcgccucacauuucugcuccucugccacgucuggcaagaaaagcaccgaaauacaauuccacagcggcagccucgugggaaaaacagccauccacguaaaaggggcucuagucgacggcaccgaauuuacauucgaaggauccugcauguucccagacggaugcgacgccgucgacugcacguuuugcagggaguuccucaagaacccacaaugcuacccagcgaagaaguggcuuuucauaaucaucgucauacuucucggauacgcaggucucauguuacucaccaacguccuaaaggcgaucggaauauggggaagcuggguaaucgcucccgucaaacuaauguucgcgauaauaaagaaacucaugagaacuguuuccugccuaauggggaaacucauggaccgcggccgucagguaauccacgaagaaauaggagagaacagagaaggcaaccaagacgacguccgcaucgaaauggcacgcccaaggcgggugcgacacuggauguacagccccgucauauuaaccauccuggccauagguuuggcagagagcugcgacgagaugguccacgcggacuccaaacugguaagcugcaggcaaggaagugggaacaugaaagaaugcgucaccacaggccgagccuugcuccccgcagucaacccgggacaggaagccugccugcacuucaccgcaccaggcaguccagacucaaaaugcuugaaaaucaaagucaagcgcauaaaucugaaguguaagaaaagcagcucguacuucguaccggacgccagguccaggugcaccagcguacgcagaugcagaugggccggugacugccaaagcggguguccaccccauuucaccagcaacuccuucucagacgacugggcaggaaaaauggauagagcaggucucggcuuuuccgguugcuccgacggaugcggcggcgccgcaugcgguugcuucaacgcggcgccaucgugcauauucuggcgcaaguggguagaaaacccgcacggcaucaucuggaaagucagcccaugcgcagcaugggugcccagcgccgucauagaacucacaaugccaagcggagaggugcgcaccuuccacccaauguccggaaucccaacccaaguuuuuaaagggguguccgucaccuaccuaggcucagacauggaggucucugggcucacggaccugugcgaaauagaagaacuaaaaagcaagaagcucgcgcuggcaccaugcaaccaggccgguaugggaguagucggcaaagucggcgaaauucaaugcagcuccgaagaaagcgcaagaaccaucaagaaagacggauguaucuggaaugccgaccucguagggaucgaacuaagggucgacgaugcgguuuguuacucaaaaaucacuucgguggaggccguagccaacuacagcgccauaccgacgaccaucggaggccuaagauucgaacgcucccaugacucccaaggaaagauaucgggaagcccccuagacaucacagcaauacgcggcuccuucucaguaaacuacagaggccuucgucuaucacuaagugaaauaacagcgaccuguaccggcgaaguaacaaacguaucagggugcuacagcugcaugaccggcgcaaaagucaguaucaaacuacacuccagcaaaaacuccacagcacacguacgcugcaaaggagacgaaaccgcauucagcguccucgaaggggugcauagcuacaccgucucacuauccuucgaccacgccguaguagacgaacagugccaauuaaacugcgggggacacgaaagccagguaacacugaaagggaaccuaauauuccucgacguaccaaaauucguagacggaagcuacaugcaaacauaccacucaacgguaccuaccggagccaacaucccgagcccaaccgacuggcucaacgccuuauucggcaacggccugagccgauggauacucggcgucauuggcgugcuguuaggaggacuagcacuauucuucaugauaaugucgcuauucaaacuuggcaccaaacaaguguucagaagccgaacaaagcuagcauag

SEQ ID NO: 16512 - RNA, 3222 nt, Artificial Sequence
  derived and/or modified CDS sequence (opt11) from SFTSV(HNXY_224)__KC292317.1__GP
augaugaaaguuauaugguucagcucucucauaugcuucgucauucagugcuccggagauucgggcccgauaauaugcgcagggccaauacacucaaacaaaagcgcagacaucccacaccuacuaggcuauuccgagaaaauuugccagaucgaccggcucauacauguauccucauggcuacgaaaccacagccaauuccaaggguacguaggccaacgaggaggacgaagccaggugagcuacuaucccgcugaaaacagcuauagccguuggucaggccuccucucaccaugcgacgcagacuggcucggaaugcuagucgucaaaaaggccaagggcuccgacaugaucguacccggacccuccuauaaaggcaaaguauuuuucgaacgcccuaccuucgacggauacgugggauggggcugugguuccggaaaaagccgaaccgaaaguggggaacuaugcucauccgacagcggaacaucaaguggccucuuacccucggaccgcguccucuggaucggagacgucgcgugccaaccuaugacuccaaucccagaagaaaccuuccucgaacuaaagaguuuuucccaguccgaguucccagacaucugcaaaaucgacggcauuguauucaaucagugcgaaggagaaucccucccccaacccuuugacgucgcauggauggacguaggccacucacacaagaucaucaugagagaacauaaaaccaaauggguccaagaauccuccuccaaagauuucguaugcuauaaagaaggaacaggaccgugcucugagagugaagagaaaacaugcaaaacauccggcucaugcagaggagauaugcaauucuguaaggucgccggaugcgaacacggagaggaagccuccgaagcaaagugccgcuguucgcucguacacaagcccggcgaagugguaguaagcuacggagggaugcgcguacgccccaagugcuacggauucucgcgaaugauggcaacgcucgaggugaaccaaccggagcaacgaaucggccaaugcaccggaugccaccuagagugcauaaacgggggcguccgacucaucacguuaacaucagaacuaaaaagcgcaaccgucugcgccagccacuucugcaguuccgcaacgagcggcaaaaagucaacggaaauacaauuccacucaggcucgcucguggguaaaaccgccauccacgucaagggagcccuagucgacgggaccgaguucacguucgaaggcucuugcauguucccggauggaugcgacgcagucgacugcaccuucugccgagaauuucucaaaaacccccaaugcuaccccgccaagaaguggcuuuucaucaucgucgucauacuucuaggcuacgccggccuaaugcuccucacgaaugugcucaaagcuauaggcaucuggggauccugggucauagcccccguaaaacucauguucgcaaucaucaaaaagcuaaugcgcacaguaucgugccugauggggaaacuaauggaccgcggacgccagguuauacacgaagaaaucggcgagaaccgugaaggcaaccaggacgacgucaggaucgagauggcgcgaccacgacggguccgccacuggauguauagccccguaauacuaaccauacuagcaauaggccucaccgagucaugcgaugaaaugguucacgcagacuccaagcucgugagcugucgucaaggaagcgggaacaugaaagagugcgucaccaccggacgcgcgcuucuaccagccguaaaccccggacaggaggccugccuacacuuuacggcacccgggagcccggacucaaaaugccucaaaaucaaaguuaaacgaauaaaccuaaaauguaagaagucuuccagcuacuucgugcccgaugccaggagccgaugcacuagcguacguaggugccgaugggcaggagacugcgaaagugggugcccaccccacuucaccuccaacagcuucucagacgacugggccggcaaaauggaccgcgcaggacucggcuucuccggcugcuccgacggcugcgggggagccgccugcggcuguuucaacgcagccccuucaugcaucuucuggaggaaauggguagaaaauccccacggcauaaucuggaaaguuuccccgugcgccgccuggguacccuccgccgugaucgaacuaacaaugcccagcggagaaguccgcacguuccaacccaugagcgguaucccaacacagguauucaaaggaguaucaguuacauaccuagggucggacauggaagucuccggucuaacagaccucugugagauagaggaacugaaaagcaagaaacucgcucucgccccaugcaaccaagcaggaaugggagucguaggaaaagucggcgagauacaaugcagcuccgaagaaucagcacgaacaaucaagaaagacggcugcauuuggaacgcagaccuagucgggauagaacuccgcgucgacgacgccgucugcuacucuaaaaucaccucggucgaggcaguagccaacuacagcgcuaucccuacaacaaucggaggcuuacgguucgagcgcagccacgauagccagggcaaaaucucaggcagcccccuagacauaacagcaauccgcggauccuucuccgugaacuaucgaggacuaaggcugagccuaagugaaauaacagccacuuguaccggagaaguuaccaacguaagcggaugcuacagcuguaugaccggagcgaaagugagcaucaaacuccacuccuccaaaaacagcacagcccacgugcgcugcaaaggggacgaaaccgcauucucaguccucgaaggaguccacagcuacaccgugagccucucauucgaccacgcgguaguagacgagcaaugccaacuaaacugcgguggacacgaaagccaggucacacuaaaaggcaaccuaauauuccucgacgucccaaaauucgucgacggaucuuacaugcaaacauaccacuccaccgucccgaccggggcuaauauacccagcccaaccgacuggcuaaacgcccucuucggaaauggacuaaguagauggauccuuggagucaucggcguguuauuaggcggacuagcucuauucuucaugauaaugagcuuauucaaacucggcaccaaacaaguauucagaucaagaacaaaacuagccuaa

SEQ ID NO: 16513 - RNA, 3222 nt, Artificial Sequence
  derived and/or modified CDS sequence (opt11) from SFTSV(HNXY_231)__KC292313.1__GP
augaugaaggucauaugguucagcucccuaaucugcuucguaauacaaugcagcggcgauagcgguccgaucaucugcgccggacccauacacucgaacaagucagcaggaauaccgcaccuccuaggauacucagagaaaauaugccaaauugaccgacucauccacgucuccagcuggcucagaaaccacucccaauuccagggauacgucggccagcgcgggggucggagccagguaucguacuaucccgcagaaaauagcuacuccagauggagcggccuccucucacccugcgacgcugauuggcucggaaugcuagucgucaagaaggccaaagguuccgacaugauagugcccggaccauccuauaagggaaagguuuucuucgaacgcccuaccuucgacggcuacgucggcuggggcugcggauccggaaagucacgaacugaaucuggggaacuaugcucaucggacagcggaacgagcuccggguuacuccccagugaccgcguacuauggaucggggacguagccugucagcccaugacuccgauccccgaagaaaccuuccucgaacucaaaucauucagucaauccgaauuuccagacauaugcaaaaucgacggaaucguauucaaccaaugcgaaggugaaagccugccgcaacccuucgaugucgcguggauggacgucgggcacagccacaaaaucaucaugagagaacacaaaaccaaguggguacaagaauccaguucgaaagacuucgucugcuauaaagagggcaccggaccgugcucggagucagaagagaagaccugcaagaccuccggaucgugccgcggcgauaugcaauucugcaaaguagccggaugcgaacauggggaagaagccucggaagcaaaaugucgauguucauuaguccacaaacccggcgaggucguagugagcuacggcggcaugcgcguacgcccaaagugcuacggguucucacgcaugauggcuacacuggaaguaaaccagcccgaacaacguaucggccaaugcacagggugccaccucgaguguauaaacggaggcguccgacuuaucacccuuacaucagaacuaaaaagcgcuacggugugcgccucacacuucugcucaucagccacauccggaaagaaauccaccgaaauccaauuccacucggguagccucguugguaaaacagccauacaugucaagggcgcgcuuguagacggcacagaguucacauucgagggcuccugcauguuccccgacgggugcgacgcuguggauugcacuuuuugccgcgaguuccuuaaaaacccccaaugcuacccagcaaagaaaugguuguucaucauaaucgucauccuacuaggcuacgccggacucaugcuccuaaccaauguccuaaaagccaucggaauauggggaucauggguaaucgcacccguuaaguuaauauucgcaauaaucaaaaagcuaaugaggaccgucucgugccugaugggcaaacuuauggaccgaggacgacaagucauccacgaagaaauaggagagaaccgcgaaggcaaccaagacgaugucaggaucgaaauggcacgcccccgccggguucgucacuggauguacucccccgugauacuaaccauacuggcaauuggacuagcugaaucaugcgaugaaaugguacacgccgacagcaagcuaguaucaugcagacagggcuccgggaacaugaaagaaugcgucacuacaggccgugcccuguuacccgccgugaauccaggccaagaagccugccugcacuucaccgcgcccggcucccccgacucgaaaugucugaagauaaaaguaaagcgaauaaacuuaaaaugcaagaaaagcuccuccuacuucguccccgacgcaagaagccgaugcaccaguguccgccgauguagaugggccggagauugccaaagcggaugcccgccacacuucaccagcaacucauucuccgacgacugggccggaaaaauggaccgcgcggggcucgguuucucgggaugcuccgacggcugcggcggagcggccugcgggugcuucaacgcagcgccauccugcaucuucuggcgcaaaugggucgaaaacccucauggcauaauauggaaagucucccccugcgccgccuggguccccagcgccguaauagaacucaccaugcccucuggcgaaguccggacauuccacccaauguccggcauaccaacgcaaguauucaaaggagucucugucacguaccucggauccgacauggaagugagcggacucaccgaccuuugcgaaauagaagaacucaaauccaagaaacuagcacuagcgcccugcaaccaagcaggcaugggcgucguagggaaaguaggagagauacaaugcaguucagaagaguccgcccgaacaaucaagaaagacgguugcaucuggaacgccgaucuggucgguaucgaacuacgaguugacgaugccgucugcuacagcaaaauaacguccgucgaagccgucgcaaacuacucagccauaccuacaacaaucggcggccugcgcuucgaacggucacaugacucacaaggcaaaaucuccggaagcccacuugauauaacggcaauacguggauccuucagcguuaacuaccgcggacucaggcuaagccuaucagaaauaaccgcaacaugcaccggggaagucaccaacguaucagggugcuacuccugcaugaccggcgcaaaagucucgauaaaacugcacucaagcaaaaacuccaccgcacacguacgcuguaaaggcgacgaaacggccuuuucgguccucgaaggcgugcacagcuacacagucagccuaucguucgaccaugcgguagucgacgaacagugccaacucaacugcggcggccaugaaucgcaaguaacccucaaaggcaaccucaucuuccuagacguacccaaauucgucgacggaaguuauaugcaaacuuaccacuccaccgucccaacgggagcgaacauaccaagcccaaccgauuggcucaacgcacuuuucggcaacggccucucacgcuggauacuaggggucaucggcguacuccuuggagggcucgcacuauucuucaugaucaugagcuuauucaaacuaggaacaaagcaagucuuccguagccgcaccaaacucgcauag

SEQ ID NO: 16514 - RNA, 3222 nt, Artificial Sequence
  derived and/or modified CDS sequence (opt11) from SFTSV(HNXY_245)__KC292320.1__GP
augaugaaagugauuugguucagcucacucauauguuucguaauacaaugcagcggcgacagcggcccaauaauaugcgcgggcccaauccacuccaacaaaucugccgacauaccccacuuacucggguacagcgagaagauaugccaaaucgacagauuaauacacgucuccucaugguugagaaaccauucacaauuccaaggauacguaggacaacgaggugggaggucccagguaagcuacuaccccgcggagaacucauauagcagauggagcgggcugcucaguccuugcgacgcagacuggcuaggaauguugguagugaaaaaggcaaagggaagcgacaugaucguaccgggaccaagcuauaaggggaaagucuucuucgaaaggccgaccuucgacggguacguaggauggggaugcggaaguggaaaaucaagaacggaaucaggagaacucugcagcucagacucgggaacaagcuccgggcuucuccccucaaaccggguccucuggaucggcgacguagcaugucagccgaugacacccaucccagaagaaaccuuucuggagcucaaaaguuuuagucaguccgaauuuccggauauuugcaaaaucgacgguauugucuucaaccaaugcgaaggagaaagccucccccagcccuucgacgucgccuggauggacgucgggcacucccacaaaauaaucaugcgagaacacaaaacaaaaugggugcaggaaagcaguagcaaagacuucguaugcuacaaagaaggcacaggacccugcucggaaucagaagagaaaacaugcaaaacaucaggcucaugccgaggagauaugcaguucugcaaaguagccgggugugaacacggggaagaagccagcgaagccaaaugccgcugcagccuaguacauaagccaggggaggucgucgucucauacggcggcaugcguguccgacccaaaugcuacggauucagccgcaugauggcgacacucgaaguaaaccaacccgaacaacgcauagggcagugcacaggcugccaccucgagugcaucaacggaggcguaaggcuaaucacgcuaaccucagagcuuaagagcgcaacggucugcgcaucccacuucugcuccagcgccacaagcggaaagaaauccaccgaaauccaauuccacagcggaagccucgugggcaaaacagccauucauguaaaaggcgcauuagucgacgggaccgaguucaccuucgaaggcucaugcauguucccagacgguugcgacgccguagacuguaccuuuugccgggaguuccuuaaaaacccacaguguuacccagccaagaaauggcuauucaucauaaucguaauacuacucggguacgccggacuuauguuacucacaaacgugcucaaagcaauagguauauggggaagcugggugauagcacccguaaaacuaauuuucgcuaucauaaagaaacucaugcgaaccguauccugcuuaauggggaaacugauggaccgggggagacaaguuauacacgaagaaauaggagaaaaccgagaagggaaucaggacgacgugcgcaucgaaauggcacgaccacgacgggucagacacuggauguacuccccugugauccuuaccauccucgccaucggcuuagcagaaagcugcgacgaaaugguacacgcggacuccaaacuugugagcugcagacagggcuccggcaacaugaaagaaugcguaacaaccgggagagccuugcucccagccguaaacccgggacaggaagccugccuacacuucacagcacccggaucuccagacuccaaaugccugagaaucaaaguuaagcgcaucaacuuaaagugcaagaaauccagcagcuacuucguaccagacgcacggucaaggugcaccuccgugcgacgauguagaugggcuggcgauugccagagcgguugcccaccccacuucacauccaacaguuucucagaugacugggcaggaaaaauggacagagccggacugggguuuagcggcuguagcgacggcugcggaggagcagcaugcggaugcuucaacgccgcaccauccugcaucuucuggcgcaaaugggucgaaaacccgcacggcaucauauggaaaguaucgcccugcgccgcgugggugcccagcgccguaaucgaacuaacaaugccaagcggggaaguaagaacauuccaccccaugucaggcaucccgacccaagucuucaaaggaguauccguaaccuaccuaggcagcgacauggaagucagcgggcucacggacuuaugcgaaaucgaagaacucaaaagcaaaaagcuagcgcucgccccaugcaaccaagccgggaugggaguugucgguaaggucggggaaauccagugcuccucagaagagagcgcccggaccauaaagaaagacggcugcaucuggaacgcagaucuaguagggaucgaguugcgggucgacgacgcaguaugcuacucaaaaauaaccucagucgaggcugucgccaacuacucagcaaucccaaccaccauaggaggccucagguuugaacgaagccacgacagccaaggcaaaaucuccggcagcccacucgacaucaccgcuauaaggggcagcuucagcguaaacuauagggggcuacgacucagccugagcgaaaucacagcaacaugcaccggcgaagucaccaacguaagcggcugcuacaguugcaugacaggagcaaaaguaagcaucaaacuucauagcaguaaaaacaguaccgcacacgugcgaugcaaaggugacgagacagccuucagcguacuggagggaguacacagcuacacaauaagccucagcuucgaccacgcggugguggacgaacaaugucaacuaaacugcgggggacacgaaucccaaguuacccuaaaagguaaccugaucuuccuagacguccccaaguucgucgacggcucuuacaugcaaaccuaccacuccacagucccaacaggggcgaacaucccgagcccgaccgacuggcugaacgcccucuucggcaacggacuaucacgauggauacuagggguaauggguguccuacucggcggacuggcacuauucuucaugauaaugagccucuucaaacucgggacgaaacaaguguucagaagccgcaccaaacuagccuaa

SEQ ID NO: 16515 - RNA, 3222 nt, Artificial Sequence
  derived and/or modified CDS sequence (opt11) from SFTSV(HNXY_262)__KC292309.1__GP
augaugaaaguuaucugguuuuccucccucauaugcuucguaauacaaugcagcggcgacucgggcccaaucauaugugccggccccauccauuccaacaaaucagccgacaucccgcaucugcucggguacuccgagaaaaucugccaaauagacagacucauccacguaagcagcugguuacgcaaccacucacaguuccaaggcuacgucggccaacgcggcggaagaucccggguauccuacuacccggcagagaacaguuacucacgauggucaggacuacucucaccaugcgacgcagacuggcuaggcaugcuaguggugaaaaaggcuaaaggcagugacaugaucgucccagguccaucauacaaagguaaagucuucuucgaacgcccgaccuucgacggcuaugucggcuggggcuguggcucuggcaagagccgcacagaaagcggggaacucugcucaagcgacagcggaaccuccucaggccuacuaccaucugaucgaguacucuggauaggcgacguagcaugucaacccaugacaccaauucccgaagagaccuuucuugaacucaagagcuucagccagagcgaguucccagacaucuguaaaauagacggaauaguauucaaccagugcgaaggcgagagcuuaccccaaccauucgacguagcauggauggacgugggccacagccacaaaauaaucaugcgcgaacacaaaacgaaauggguacaagaguccucaagcaaagacuuugugugcuacaaagaaggcacaggacccugcucagaauccgaagagaaaacgugcaagaccucgggcucaugcagaggagacaugcaauucugcaaaguagccggaugugaacacggagaagaagcgagcgaagcaaagugccgcugcucccugguacauaaacccggagaaguggucgucucauacgggggcaugcgaguacgaccgaaaugcuacggauucagucgaaugauggccacccucgaaguaaaccagccagagcaaagaaucggacaaugcacggggugccaccuagaaugcauuaacggaggcguacgccugaucacccucaccagcgaguuaaaaucagcaaccguuugcgccucccauuucugcucaucagccacguccgguaaaaagucgacagaaauucaauuccacuccggcucucucgugggcaaaaccgccauacacgucaagggagcgcucguagacgggacugaguucacauucgaaggauccugcauguuccccgacggaugugaugcugucgacuguaccuucugccgcgaguuccucaagaacccacaaugcuacccagcaaagaaauggcuguucaucauaauaguaauauuacugggcuacgcaggacuuaugcuucucaccaacguccucaaagcaauagguauauggggcucauggguaaucgcaccaguaaaacuuaucuucgcaauaaucaagaaacucaugcgcacuguuuccugccuaaugggcaaacucauggauaggggacggcagguuauacacgaagaaaucggagagaacagggaaggaaaccaagacgacguccgcaucgaaauggcccguccacgccgagugagacacuggauguauagucccgucauacugacaauccucgccauaggacuggccgaaagcugcgacgaaaugguccacgcagacucaaaauuaguaucgugccggcaaggguccggaaacaugaaagagugcgucaccaccggcagagcccuacucccggccguaaacccgggccaagaagcgugccugcacuucacggcucccggcucgcccgacaguaaaugccuaaaaauaaaagucaaaagaauaaaccugaaaugcaagaaaaguucaagcuacuucguuccagacgccagaagccgaugcaccuccgucagacgcugccggugggccggugacugccagucgggcuguccuccccacuucacguccaauaguuuuuccgacgacugggcaggcaaaauggaccgugcaggacucggguucagcggaugcucggacggaugcggaggggcagcauguggaugcuucaacgccgcccccagcugcauauucuggagaaaauggguugaaaacccacacggcauaaucuggaaaguaucacccugcgccgccuggguaccgucagccguaaucgagcucacaaugcccagcggggaagugcgcacauuccaccccaugagcgguauccccacgcaagucuuuaaaggagucagcgucaccuaccucggaagcgacauggaagucuccggacugacagaccuaugcgagauagaagaacugagaagcaagaaacucgcgcucgcaccaugcaaccaggcaggaaugggcgucguaggaaaagugggcgaaauacaguguucaagcgaagaauccgccagaaccauaaagaaagacggcugcauuuggaacgcagaccuugucggcauagaacuacgagucgacgacgcgguaugcuacagcaaaauaacauccgucgaagcaguagccaacuacuccgcaauacccacgacaauaggcggacuccgguucgagcgcucacacgacagccaaggaaaaauaucuggcucacccuuagauaucaccgccauacgaggauccuucagcgugaacuaccgcggucugcgacucucacugagcgaaauaacagcuaccugcacaggagaagucacaaacgucaguggaugcuauagcugcaugacgggcgccaagguaucaauaaaacuccacucaagcaaaaacagcacugcccacgugcgaugcaaaggggacgagaccgccuucagcguccucgaaggcguccacucauacaccguaucacucagcuuugaccacgcaguaguggacgaacaaugccaacucaauuguggcggacacgaaucccaagucacacucaagggaaaccuaauauucuuggacguccccaaguucguagacggcuccuacaugcaaaccuaccacuccaccguccccaccggcgcgaacauacccucccccaccgacuggcucaacgcccucuucggcaacggucucagccgcuggauacucggagucaugggcguccugcugggcggccuagcccucuucuucaugauaaugagccucuuuaagcucggcaccaaacaaguguucagaagccguaccaagcuagccuaa

SEQ ID NO: 16516 - RNA, 3222 nt, Artificial Sequence
  derived and/or modified CDS sequence (opt11) from SFTSV(HNXY_278)__KC292322.1__GP
augaugaaaguaaucugguuuagcucacucauaugccucgugauacaaugcggcggggauaccggcccaauaaucugugccggcccaacccacagcaacaaauccgcagauauuccccaucugcuaggauacucggaaaagaucugccaaaucgacagacuaauccacguaagcucauggcuccgaaaccacucccaauuccaaggauacguaggccaacgaggcgggagaagccaaguaucguacuacccagcggagaacagcuacucccgauggagcgggcuacucaguccgugcgacgcagauuggcuagggaugcucgucgugaaaaaggcaaaagguagcgacaugaucguucccggacccuccuacaaagggaaagucuucuucgaaaggccaacauucgacggcuacgugggcuggggcugcggcucgggaaaaagccgcacagagagcggcgaacuaugcagcagcgacagcgggaccucuaguggucuccucccaucggacagggugcuauggaucggagacguagcaugccagcccaugacaccaaucccagaagaaaccuuccucgaacucaagagcuuuucccagagcgaguucccagacauuugcaaaauagacggcauaguauucaaccaaugcgaaggagaaagucuaccacaaccauucgacgucgcauggauggauguaggacacucccacaaaaucauaaugagggagcacaaaacaaaguggguacaagaaucuucaucgaaggauuucguguguuauaaagagggaacaggcccgugcagcgaaucagaggagaaaaccuguaaaacgggcggcuccugccgaggugacaugcaauucugcaaaguagcggggugcgaacacggcgaagaagccagcgaagccaaauguaggugcucgcucguccacaaacccggagaaguggugguaagcuacgggggaaugcgagucagaccgaaaugcuacggguucucucgaaugauggcgacauuggaggugucccaacccgaacaaagaaucggacagugcacaggaugccaucuagaaugcauaaacggcggaguccgacugaucacacuaacaucagaacuaaaguccgccaccgucugcgcuagccacuucugcagcucggccaccagcggcaagaaaagcacagaaauacaauuccacuccggaagccuagucggaaaaaccgcaauucacgugaaaggcgcccuagucgacggaacagaguucaccuuugaaggaucaugcauguucccagacggcugcgacgcaguagacugcacauucugccgggaguuccucaaaaacccccaauguuauccagcuaagaaauggcuauucaucaucaucgucaucuuauuaggguacgccggacugaugcugcuaaccaacguacugaaagccauugguguaugggggagcugggucaucgcccccgucaagcucguguuugccaucaucaagaaacuaaugcgggcagucuccugccuaauggguaaacuuauggaccgcggccgccaggucauucaugaagaaauaggugaaaaccgagagggaaaucaagaugacguacguaucgaaauggcacgcccacgccgcgucaggcacuggauguacaguccggucauacucaccauacuggccaucggacuggcggaaggcugcgaugaaaugauccacgccgacucgaaacucguaucaugcagacaaggauccggaaacaugaaagaaugcguaaccacgggcagagcccuccucccugcagugaacccgggccaggaagccugucuacacuucacagcacccggaucaccagacucaaaaugccuaaagauaaaagucaaacgaauaaaccuaaagugcaagaaaagcucaagcuacuucgucccagacgcgcgcaguagguguacaagcguuagacgaugccgaugggccggcgacugccaguccgguugcccaccgcacuucacgccaaacagcuucagcgacgacugggcugggaaaauggacagggcaggccuuggauucagcggcugcagcgauggcugcggcggggcugccugcgguugcuucaacgcggcaccaagcugcauuuucuggcggaaaugggucgaaaacccccacgggaucaucuggaagguaagcccaugcgcagcauggguacccucagcaguaauugaacucacaaugcccagcggagaagugcguaccuuccacccaaugucagguauaccaacacagguauucaaagggguaucgguaacauacuuagguucagacauggaagugagcgggcucacagaccuaugcgaaauagaggaacucaaaagcaagaaacucgcgcuagccccaugcaaccaagcagggaugggagucguaggcaaaguaggcgaaauacaaugcagcucggaggaaagcgcacgaaccauaaagaaagacggcuguaucuggaacgcggaucuagugggaaucgaacuuagaguagacgaugcagucugcuacagcaaaauaacgagcgucgaagccguagccaauuauagcgccauaccuacaacaauaggcggccucagauucgaacgaucacacgacucccaaggcaaaaucuccggcagcccucuagauaucacggccaucagagggucauucagcgucaacuaccgcgggcugcgucugucacucagcgaaaucaccgcgaccugcacgggagaaguaacaaacguaagcggaugcuauagcugcaugacaggcgcgaaagugaguauaaaacuacacucauccaagaacucaacagcacacguacgauguaaaggcgacgaaaccgcauucucgguccucgaaggaguacacuccuauucagugagccucuccuucgaccacgccguuguagacgaacagugccagcuaaacugcgguggccacgaaagccaagucacccuccggggaaaccuaauauuccuugacguaccgaaauucguagacggcuccuacaugcaaaccuaccacagcacagucccgaccggagccaacauaccaucacccacagacuggcugaacgcacucuucggcaacggacucagccgcuggauacucggagugaucgggguucuacugggaggacuggcccucuuuuuccuaaucaugagccucuucaaacucggcaccaaacaaaucuuccguucccggaccaaacuugcguga

SEQ ID NO: 16517 - RNA, 3222 nt, Artificial Sequence
  derived and/or modified CDS sequence (opt11) from SFTSV(HNXY_31)__KC292310.1__GP
augaugaaagucaucugguucucuaguuuaauaugcuucgucauccaaugcagcggagacuccggaccaauaauaugcgcaggcccgauccacuccaacaaauccgcugacauaccgcacuugcugggauacuccgaaaagaucugucagauagaccgacucauccacgucagcaguuggcuacgaaaccauucgcaauuccaaggauacgugggccagcgaggaggacggucccagguauccuauuaccccgcggaaaauuccuacucccgcuggagcgggcuacuguccccaugcgacgcagacuggcucgggaugcugguagugaaaaaggcgaagggcuccgacaugauaguaccaggccccuccuacaaaggcaagguauucuucgagagaccgaccuucgauggcuacguaggcuggggcugcggauccggaaagagcaggaccgaaagcggggaacuaugcucuagcgacagcggaaccucaagcgggcuacuccccucggaccgcguacuauggauaggagacguggccugccaaccaaugacccccaucccagaagaaacguuccuagaacucaagucguucucacaaagugaguuccccgacaucugcaagaucgacgguauagucuucaaccaaugcgaaggcgaaagccucccucagcccuuugacguagcauggauggauguuggacacagccacaaaaucaucaugcgugaacacaaaaccaaauggguacaagaaagcagcucaaaagacuucgugugcuacaaagagggcacaggcccgugcucggaauccgaagagaagacgugcaaaacuucgggcuccugcagaggugacaugcaauucuguaagguggccgggugcgaacacggagaagaagcaucagaggccaagugcagaugcagcuugguacauaaaccgggcgaaguagucguaagcuacgggggcaugcgcguccgcccaaagugcuacggauucuccagaaugauggcgacacuggaggugaaccagcccgaacaaagaaucggccaaugcaccggcugccaccuggaaugcauaaacgggggcgugcgccuuaucacacugaccucugaacuuaaguccgcgacugucugcgcaagccacuucugcuccucagcaacuagcggcaaaaagaguacagaaauccaauuccacucuggaagccuggucggaaaaaccgcaauccacgugaaaggagcucuaguagacggcacagaguucacauucgaaggcuccugcauguuccccgacggaugcgaugcaguagacugcaccuuuugucgcgaguuccucaaaaacccgcaaugcuacccagccaagaaauggcuauucauuauaaucguuauccuacucggauacgccggacuuaugcuacucaccaacguccucaaagccauaggaauaugggggucaugggucauagcacccguaaaacucauauucgcaaucaucaagaaacuaaugcgaacggucuccugccuuaugggaaaacuaauggaccgagggcgucaaguaauacacgaagaaauaggugaaaaccgggaaggaaaccaggacgacgucagaaucgaaauggcgcgaccccgacggguccggcacuggauguacagccccguaauccucacaauccuagcaaucggacucgccgagagcugugacgaaaugguccacgcagacuccaagcuagucuccugccggcagggaagcggaaacaugaaagagugcgucaccacgggcagagcccuccucccagcagucaacccaggccaggaagcgugccuacacuucaccgcgcccggcuccccugacucuaaaugccucaaaauaaaaguaaaaagaauaaaccugaaaugcaagaaauccucgagcuacuucguacccgacgcacgaucacggugcacaagcguucgccgaugucgaugggcgggcgauugccaaagcggauguccaccccacuucacaucaaacagcuucuccgaugacugggcugggaaaauggaccgagccggucugggauucucagguuguagcgacggaugcggcggcgcagcaugcggcugcuucaaugcugcaccgaguugcauauuuuggcgcaaaugggucgaaaacccccauggcaucauauggaaaguaucaccgugcgccgcguggguacccucggcuguaauagagcucacaaugcccagcggcgagguacgaaccuuccaccccaugagcggaaucccaacccaaguauucaaaggagucagcgucaccuauuuaggauccgacauggaagucagcggacucaccgaccucugcgagauagaagaacucaaaucaaagaaacuagccuuagcgcccugcaaucaagcagguaugggggucgucgguaaaguaggagagauccagugcagcucagaagagagugcacgcacaaucaagaaagauggaugcauauggaacgcagaccucguggggaucgagcuaagggucgacgacgcggucugcuacuccaaaauaacaucggucgaggcaguagccaauuacagcgcgauccccaccaccauaggcgggcuacgguucgaacgcagccacgacagccaaggcaaaaucucagggucaccauuagacauaacagccauccgcgguucauucucggucaauuaccgaggcuuacgacucagucuaucagaaaucacagccacgugcacaggagaaguaacaaacguaagcgggugcuacagcugcaugaccggcgcaaaaguaagcaucaaauugcacuccagcaaaaacuccaccgcacacgugagaugcaaaggagacgagaccgcauucucaguacuagagggaguccacuccuauagcguaucacucucauucgaccacgcaguggucgaugaacagugccagcuaaacugcgggggccacgaaucacaaguaacccuccgcggcaaccugauauuccucgacguccccaaauucgucgacggcagcuacaugcagacguaccacuccaccguaccaacaggagcaaacauccccagcccaacagacuggcucaacgcacucuucggaaacggcuuaagccgguggauucuaggcgucauagggguccugcuaggcggccuagcauuguucuucaugauaaugucucucuucaaacuggggaccaaacaaguauucagaucuagaacaaaacuagcuuag

SEQ ID NO: 16518 - RNA, 3222 nt, Artificial Sequence
  derived and/or modified CDS sequence (opt11) from SFTSV/FTLSV(2011YGS5)__KF711925.1__GP
augaugaagguuauaugguucagcagccuagugugcuuagucauacaaugcagcggagacucaggccccaucauaugcgcuggccccauacacagcaacaaaagcgcagcaaucccacaccuccucggguacagcgagaaaaucugccaaauagacagacuuauacaugucagcucguggcugagaaaccacucccaguuccaaggcuacguagggcaacgcggaggcagaagccaagucagcuacuacccggccgaaaacagcuauagcagauggucagggcuauuaaguccgugcgacgccgacuggcucgggauguugguaguaaagaaagcgaaaggaucagacaugauuguaccaggacccucauacaaaggaaagguauucuucgaaaggccaacauucgacggcuaugucggauggggaugcgguuccggaaagaguaggacagagagcggcgaacuuugcaguagcgacagcggaacaucgaguggccuucuacccagcgaccgcguacuauggaucggcgacguagcgugccagccaaugacacccaucccagaggagaccuuccucgaguuaaagagcuucucgcaauccgaguucccagacaucuguaaaaucgacggaauaguuuucaaccagugcgaaggcgaaagccucccccaacccuucgacguagcguggauggacguaggccacucacacaaaauaaucaugcgggaacacaaaacaaaauggguccaggaaagcagcagcaaggacuucguaugcuacaaagagggcaccggcccgugcucagaaagcgaggaaaaagcgugcaagacaagcggcucaugccggggcgacaugcaguucugcaaagucgcaggaugcgaacauggggaagaagccuccgaggcgaaaugccgcugcucccuaguacacaagccaggagaaguagucguaagcuacggaggcaugcggguacgacccaaaugcuacggcuucucaagaaugauggcaaccauggaggucaacccaccagagcaacgcaucggacagugcacggggugccaccucgagugcaucaacggaggaguacgcuugauaacccuaaccagcgagcucaaaagcgcaaccgucugcgccagccacuucugcagcuccgcaacaaguggaaagaaaagcaccgaaauccacuuccacucaggaagccugguagggaaaacagcaauacacgugaaaggagcgcugguagacgguacagaguucaccuucgaaggcucaugcauguucccagacgguugcaaugcaguagacugcacauucugcagggaguuccuaaagaacccgcagugcuaccccgcaaagaaguggcuauuuaucaucauaguaauacuacugggauacgccggucugaugcuccugacaaauguacuaaaggcaaucggaguauggggaaguugggucaucgcccccgucaaacucauguuugcgaucaugaagaaacugaugcgcacggucagcugcuuggucgggaaacugauggaccguggacgccaaguaauccaugaagagauuggagaaaacggggaagggaaccacgacgacguaagaaucgaaauggcgagaccccgccgagucagacauuggauguacagcccaguaauacuaaccauucucgccauagggcucgccgagggcugcgacgaaauggugcacgcggacucaaaacugguauccugcagacaggggagcggcaacaugaaagaaugcgugacaaccgguagggccuuacucccagccguaaacccgggacaagaagcaugccugcacuucaccgcgccaggaucuccggacucaaaaugccugaaaaucaaaguaaaacgaaucaaccuaaaaugcaagaaaagcagcagcuacuucgucccugacgcacgcaaccguugcacaucaguaagacgcuguaggugggcgggagacugccaaaguggaugucccccacacuucacgagcaacagcuuuagcgacgacugggcaggaaaaauggacagggcaggacuaggauucagcggcugcagugacggcugcggcggagcggcaugcggaugcuucaacgccgccccaucaugcauauucuggcgcaaaugggucgagaacucacacggaaucaucuggaaaguuagcccgugcgccgcaugggucccguccgcaguaaucgaacucacaaugccaucaggugaaguacgcacguuccaccccaugagcggcauaccgacacaagucuucaagggggugucagucacauacuuaggcucggacauggagguaagcggacuaacagaccugugcgaaaucgaagaacugaaaaguaaaaagcucgcccuggcgccgugcaaccaagcagggaugggggucguaggcaaagugggcgaaauccagugcagcagcgaagagagcgcaagaacaauuaagaaagacggaugcaucuggaacgcagaccuagucggcaucgaacuacggguagacgacgcgguaugcuacuccaaaaucacgagcguggaagcagucgcgaacuacagcgccauccccacgaccauagguggccugcgcuucgaacggagccacgacagccagggcaaaauaucgggcuccccucuagacauaaccgcgauacgaggauccuucucagucaacuacagaggucuccgacuaagccugagugagauaaccgcuacgugcacgggcgagguaacuaacguaagcggauguuacucaugcaugacaggcgccaaggugagcauuaaacuccacaguagcaaaaacucaacagcucacguccggugcaaaggcgacgagacagccuucagcguccucgaaggaguacacagcuauacgguuagucuuagcuucgaccaugccgugguggaugaacagugccaguuaaacugcgggggacacgagucacaagugacucuuaaagggaaccuaauauucuuagacguccccaaauucgucgaugggagcuacaugcaaaccuaccauucaacugucccgaccggcgccaacauccccagccccaccgacuggcucaaugcccuguucggcaacggacucucaagguggauacugggcgucauaggcguacugcuaggaggacucgcgcuguucuuccuaauaauguuccuauucaaauuagggaccaagcaaguauuccggucacgaacaaaauuagccuag

SEQ ID NO: 16519 - RNA, 3222 nt, Artificial Sequence
  derived and/or modified CDS sequence (opt11) from SFTSV/FTLSV(2011YGS7)__KF711922.1__GP
augaugaaagucaucugguucucaucgcuagucugccuggucauccaaugcagcggagauagcggaccaaucauaugcgcagguccaauacauagcaacaaaucagccgcaauaccgcaccuacuaggcuacagugaaaagaucugccaaauagaccgacuaauacacgugagcagcuggcugcgcaaccacucgcaauuccagggauacgugggccagcgaggagguagaagccagguaucauacuaccccgccgaaaacucguacaguagauggucaggccuccucucgcccugcgacgcagacuggcugggcaugcucgucguaaagaaggcaaagggaucggacaugaucgugccaggaccguccuacaagggcaaaguauucuucgaacgacccacauucgacggauacguaggauggggcugcggauccggcaaaagccgaacagagagcggagaacugugcuccagcgacagcgggacauccagcggacugcuacccuccgaccggguacuauggauaggcgacguagccugucaacccaugaccccaauaccagaagaaacauuucuagaacucaagucauuuagccaauccgaauuuccagacauaugcaagauagacgguaucguauuuuaccagugcgaaggagaaagucuaccccaaccauuugacguugccuggauggacgucggucacucgcacaaaauaauaaugagggaacauaaaacuaaaugggugcaggaaucgucaucaaaggacuucgucugcuacaaagaaggaacaggcccaugcuccgaaagugaagagaaagcaugcaaaacgaguggcucaugccgaggcgauaugcaauucugcaaggucgccggaugcgagcacggagaagaagccucugaagccaaauguaggugcagccucguacacaaaccaggcgaagucgucguaucauacggagggaugcgagucagaccaaagugcuacggguucagcagaaugauggccacaauggaggugaacccgccagaacagcgcauagggcaaugcaccggcugccacuuagagugcaucaaugggggugucagacuaauaacccuaacaucagagcucaagagugcaacaguaugcgcaagccacuucugcuccucagcaacaagcgggaagaaauccacugaaauacacuuccacucggguagccucgucgggaaaaccgcaauacacgucaaaggagcauugguggacgggacagaguucacauuugaaggcagcugcauguuccccgacgggugcaacgcggucgacugcacauuuugccgcgaauuucuuaaaaauccccaauguuacccagcgaagaaauggcuauucauaauaauagucauacuccuaggauacgcaggccuaauguuacugacaaacgugcuaaaagcaaucggcguauggggcagcugggugauugcaccugucaaacuuauguucgcaauaaugaagaaacucaugcgaacagucagcugccuagucggaaaacuuauggaccgcggaagacaaguaauacacgaagaaauaggagaaaacggagaagggaaccaugacgacgugaggaucgaaauggcccgcccaagaagagucaggcacuggauguacagcccggugauccucacuauauuggccauaggccuagcagaaggcugcgacgaaaugguacacgcagacaguaagcucgucuccugccgacaaggcagcgggaacaugaaggaaugcguaaccacagggcgcgccuugcucccgucggugaacccaggacaagaagcaugcuugcacuuuaccgccccaggaagcccggauucaaagugccucaagaucaagguaaaacgaaucaaccuaaaauguaagaaauccucgaguuacuucgugccugacgcgaggaaccgaugcacaagcgugaggcgcugcagaugggcaggagauugccaaagcggcugcccgccccacuucacgagcaacagcuucuccgaugauugggcuggaaaaauggaccgcgccggccucggguucagcggaugcagcgacggaugcggcggggcagcgugcggaugcuucaaugcggcaccuagcugcaucuucuggaggaaauggguagaaaacucucacgggauaaucuggaaagucucaccaugcgcggcuuggguacccagcgccgucaucgagcugaccaugccaaguggugaagucagaacguuccacccaaugagcgggauaccaacacaaguauucaagggagugucggucacauaccuaggcucagacauggaaguauccggccuaacagaccugugcgaaaucgaggaacuaaaaucaaagaagcucgcccucgcgcccugcaaccaagccggaaugggcguagugggaaaagucggugaaauacaaugcuccucagaagaaagcgcacggacgaucaagaaagacggauguauauggaaugccgacuuggucggcaucgaacuacgaguugacgacgcggucuguuacucaaaaauaaccagcguagaagccguggccaacuacucugccauccccacgaccauaggagggcucagguucgagcgcucacaugacagccaagguaaaauaagcggcucaccacuagacauaaccgcgauacgaggcucauucucaguaaauuaccgaggacuccgccuaagccucuccgaaauaacagccacaugcacaggcgagguaacgaacgucagcggcugcuacagcugcaugacgggcgcgaaagucagcaucaagcuacacucaagcaaaaauucaacagcccaugugcguugcaaaggugacgagacagcauuuucgguacuggaagggguccacagcuacaccguaagucucagcuucgaccacgcggugguugacgaacagugccaacucaauugcggaggccacgaaagccaaguaacccugaaaggaaaccugaucuuucuggaugucccgaaauucguagacggaucauacaugcagacauaccacuccacagucccaacgggugcaaacauaccaagcccgaccgacuggcucaacgcgcuauucggaaacggacuaagccgcuggauacucgggguaaucggcguacucuuaggcggccuagcacuuuucuuccuaaucauguuccuauucaaacucggaacuaagcaagucuuccgauccagaacaaagcucgcguaa

SEQ ID NO: 16520 - RNA, 3222 nt, Artificial Sequence
  derived and/or modified CDS sequence (opt11) from SFTSV/FTLSV(2011YPQ11)__KF711926.1__GP
augaugaaggucaucugguucagcagccucguaugccuaguuauccagugcagcggagacucgggccccaucauaugugcuggcccuauacauaguaacaaguccgccgcaauaccccaccuacucggcuauucagagaaaaucugccaaaucgacagacuaauacacgugagcucuuggcucagaaaucacucacaauuucaaggauacgugggacagcgcgggggacgaucccaagugucauauuaccccgcggaaaacuccuacagccggugguccggccucuuaucccccugcgaugcagacuggcugggaaugcucguggucaaaaaggccaaggggucagacaugauaguucccgggccaagcuacaaaggaaaagucuucuucgaacgcccaaccuucgacggauacgucggcuggggcugcggcuccggcaaauccagaacggagucgggugaacuguguucuucggacaguggaacaucauccggguuacucccguccgaccgcgugcuguggaucggcgacgucgcgugccaaccaaugacacccaucccagaagaaacauuccuagaauuaaaaucauucucacaaagugaguucccugacauaugcaaaaucgacgguaucguauucaaucaaugcgaaggugaaagccuaccucagcccuucgacgucgccuggauggaugucggacacucccacaaaauuauuaugcgagaacacaaaaccaaguggguacaagaauccagcucaaaagacuucguaugcuacaaagaagggacaggcccaugcucggaauccgaagagaaagcgugcaaaaccagcggcagcugccgaggggacaugcaguucugcaagguggcuggcugcgaacacggagaggaagccagugaagccaaaugccguugcucccucguacacaaacccggagaagucgucgucuccuacggagggaugcgcguucgccccaaaugcuauggauuuagcagaaugauggcaaccauggaggucaauccacccgaacaaagaauaggccaaugcaccggaugccaccucgaaugcaucaacggaggcguccgccucaucacacucaccuccgaacuaaaaagcgcaaccgugugcgcaucgcacuucugcagcucagcuaccuccggaaagaaaaguacggaaauccacuuccauucuggcucacucgucggcaaaaccgcuauacacgucaaaggcgcucuaguagacggaaccgaguucaccuucgagggcagcugcauguuccccgacgggugcaaugcaguggacugcacauucugccgcgaguucuuaaagaacccccaaugcuacccagcgaagaaauggcuuuucaucauaaucguuauccuguuaggcuacgcugggcuaauguuacuaacaaacguacuaaaagcgaucgggguauggggaucaugggucaucgcaccuguaaaacucauguucgccauuaugaagaaacuuaugcgaaccgucuccugccuagucggaaaacugauggaccgggguagacaaguaauccacgaagaaaucggcgaaaacggcgaaggcaaccacgaugacguacgcaucgaaauggcccgaccgagaaggguaagacacuggauguacagcccuguaauacuaacaauucuggccaucggccucgccgaggguugugacgaaaugguacacgcagacucgaaacucguauccuguagacaaggguccgggaacaugaaagaaugcgugaccacgggacgagcgcuccuacccuccgucaacccgggacaggaagcaugccuacacuucacagcccccggauccccggacucgaaaugccugaaaaucaaagucaaacgaauaaaccucaaaugcaagaaaagcuccagcuacuucguccccgacgcccgcuaccguugcacaagcguaaggagaugcccuugggcgggagacugucaguccgggugcccgccacacuucacaaguaauagcuucucggacgacugggccgggaaaauggaccgugcgggacucggcuucagcgguugcagugacggcuguggaggagcggcauguggcugcuucaacgccgcaccaucuuguaucuucuggcguaaaugggucgaaaacucucacggaaucauauggaaagucucucccugcgccgccuggguaccaucagcgguaaucgaacuaacaaugccgagcggcgaaguccgcacauuccauccaaugagcggaaucccaacccaggucuucaaaggcguaagcgucaccuaccuaggcuccgacauggaggucucaggauuaaccgaccucugcgaaaucgaggaacucaaaucgaaaaagcuagcccuggcacccuguaaccaagcgggcaugggagucguaggcaaggugggcgaaauacagugcagcucagaagaaagcgcacgcacaaucaaaaaggacggauguauauggaacgccgaccuagucggcaucgagcucagggucgacgacgcgguaugcuacagcaaaaucaccucgguggaagccgucgccaacuacagcgcaauccccacuaccauuggcggacucagguucgaaagaucccacgacagccagggcaagauaucggggucgccacucgacauaacagcaauacgaggcuccuucucaguaaacuacaggggccuccgcuuaagccuaagcgagauaacugcaaccuguacgggggaaguaaccaacgugagcggaugcuacagcugcaugacaggcgccaaaguaagcauaaaacuccacagcagcaaaaacucgaccgcgcacgucagaugcaaaggcgacgaaaccgccuucucaguccucgaaggaguccacagcuacaccguaagccuguccuucgaucacgccgucguagaugaacaaugccagcugaacugcggaggccacgaaucccaggugacccuaaagggaaaccugaucuuccucgacgugcccaaguucgucgacgguuccuauaugcaaacauaucacucaaccgucccaaccggcgcaaauauccccagcccaaccgacuggcugaacgcacucuucgggaacggcaugucacgauggauacuagggguaauaggcguccugcucggagggcuagcacuauucuuccucauaauguuccuguucaaacuagggaccaaacaaguguuccgcuccagaacgaaacuggcauaa

SEQ ID NO: 16521 - RNA, 3222 nt, Artificial Sequence
  derived and/or modified CDS sequence (opt11) from SFTSV/FTLSV(2011YPQ12)__KF711930.1__GP
augaugaaagucauaugguuuagcucacucauaugcuucguuauucagugcagcggggauagcggcccgaucauaugcgcgggacccauccacucaaacaaguccgcugacauaccucaccuacucggauacucagagaaaaucugccaaauagacagacuaauacacguaucaagcuggcuacgcaaccacucacaguuccaaggauacguuggacaacgaggcggccgcagccagguaucauacuacccggcagaaaacagcuacagccguugguccggccuccugucccccugcgacgccgauuggcuggggaugcucguagucaaaaaggcuaaaggcucagacaugaucguacccgggccaaguuacaagggaaaggucuucuucgaaagaccaaccuucgacggauacgugggcuggggaugcggaagcggcaaaagccguacggaaagcggagaacucugcucguccgauagcgggaccucguccggacuucuacccagcaaccguguccucuggauaggcgacguagcgugccagcccaugaccccaauccccgaagaaacauuccucgaacuuaagaguuuuagccagagcgaguucccggacaucugcaagaucgacggaauagucuucaaccagugcgagggcgaaucacuaccccagccauucgacguagcauggauggacguaggacacucacacaaaaucauaaugagagaacacaaaacgaaauggguacaagaauccagcagcaaagacuucguuugcuauaaagagggaacgggcccaugcuccgaaagcgaggagaaaacaugcaaaacaucugggagcugcagaggcgacaugcaguuuugcaaaguagccggaugcgaacacggagaagaggccucggaagcaaaaugccgaugcucacucguacacaaaccuggcgaaguaguagucaguuacggagguaugcgaguacgcccgaaauguuacggauucucgcgcaugauggcgacacucgaaguaagccaacccgagcaacgaaucgggcaguguaccgggugccaccuagaaugcaucaacggaggcguccgacugauaacacuaacgagcgaacugaaguccgccaccguaugcgcgagccauuucuguagcuccgcgaccucggggaagaaaagcacggagauacaauuucacucaggaucccuaguugggaaaaccgccauccacgucaaaggcgcgcucgucgacggcacagaguucacuuucgaaggcucgugcauguuuccugauggcugcgacgcuguagacugcaccuucugccgagaauuucugaaaaacccacaaugcuaccccgccaagaaauggcuauucaucauaaucgucauacuccuuggauacgccggccugaugcugcugacaaacguacucaaagcaaucggcguauggggcaguugggucaucgcaccgguaaagcucguauucgcaaucaucaaaaagcuaaugagagcagugucaugccucaugggcaaacucauggaccgcgggcgacaagugauccacgaagaaauaggcgaaaacagggaagggaaccaagacgacgugcgcauagaaauggcgcgaccccgaaggguaagacacuggauguacagccccgugauauuaacuauccuagccaucggacuggcagagggcugcgacgagaugguccacgcagacucgaaacucgugagcugcagacagggcuccggcaacaugaaggaaugcguaacaacgggcagggcacuucucccagcagucaacccaggacaagaagcgugcuugcacuucacggcgcccgggagccccgacaguaagugccuuaaaauaaagguuaaaaggauaaaccugaaaugcaaaaagucaagcucauauuucguacccguggccagguaccgaugcacaagcgugcgccggugcagaugggcaggcgacugucaaagcggaugcccaccgcacuucacgagcaacagcuuuagcgacgacugggccggaaaaauggacagagccggacugggauucucaggaugcagcgacggcugcggcggggcagcgugcgggugcuucaacgccgcgccauccugcaucuucuggagaaaaugggucgaaaacccgcacgggauuauuuggaagguaucgccaugugccgcguggguaccaucggccgugaucgaacucacgaugccauccggagaaguacgcacauuccaccccaugagcggaauaccaacacaagucuucaaaggagucuccgucacauaccugggcucagacauggaagucagcggacuaacggaucucugcgagaucgaagaacuaaaaagcaagaaauuagcacucgcucccuguaaccaagccggcauggguguaguggggaaagucggagagauacagugcagcuccgaagaaagcgcacgaacaauuaaaaaggacggcugcaucuggaacgccgacuuagucggcaucgagcugagaguagaugacgcagucugcuacucgaaaaucacgucaguggaagccguggccaacuacucagccauacccacgaccauagggggucucagguuugaacgcucacacgacagucaaggaaaaauauccgggagcccacuagacaucaccgcaauccgcggcucguucuccgugaacuaccgcggccuacgguugagccugagcgaaauaacagcaacgugcacgggggaagugaccaacguaagcggcugcuacagcugcaugacgggugcuaaagugagcaucaaacugcacucguccaaaaacucgaccgcacacgugagaugcaaaggagacgagaccgcguucucaguacuagaagggguacauuccuauagcgucagccucagcuucgaccacgcaguuguagacgaacaaugccaacuaaacugcggcggucaugaaucacaagugacccuaagaggcaacuuaauauuccuugacgucccgaaauucguggacggaucauacaugcaaacauaccacucgacaguuccaacaggggcaaauauaccgagccccacagacuggcucaaugcgcuauucggcaacggacugagcagauggauacucggagucauagggguacuucuaggcggcuuagcccuguucuuccucaucaugucacuguuuaagcuaggcacuaaacagaucuucaggagcagaaccaagcuagcauga

SEQ ID NO: 16522 - RNA, 3222 nt, Artificial Sequence
  derived and/or modified CDS sequence (opt11) from SFTSV/FTLSV(2011YPQ17)__KF711923.1__GP
augaugaagguaauaugguuuagcucccuagugugccugguaauacaaugcaguggugacucaggcccgauaaucugugcaggcccgauccacaguaacaaaagugccgccaucccgcaccuccucggauacagcgagaaaauuugccaaaucgacagacucauacacguaagcucauggcuacgaaaccacucgcaauuucaaggauacgugggucagcggggaggcaggagccaagugucguacuaccccgcagaaaacucauacagccgauggucaggacuacuuucgcccugcgacgccgacuggcucggaaugcucguggucaagaaagccaaaggcucagacaugauagucccagggccaucauacaagggcaaagucuucuucgaacgccccaccuucgacggauacguaggauggggaugcggcucuggcaaaagccggaccgaaaguggagaacugugcucaagcgacucagggacuucauccggcuuacugcccucagacagaguucuguggauaggcgacguugcgugucaacccaugacaccaaucccagaagaaaccuuucuagaacugaaaucauucagccaaagcgaguucccagauauaugcaaaauagacggaauuguauucaaccaaugugagggcgagagccucccccagcccuucgacguggcguggauggacgucggacauagccacaagaucaucaugcgcgagcauaaaacgaaauggguacaagaaucaagcucuaaagacuucguaugcuauaaggaaggaacgggcccaugcuccgaaucggaagagaaggcguguaaaaccagugguucauguagaggagacaugcaguucuguaaagucgcugggugcgaacacggggaagaggccagcgaagccaaauguaggugcagccugguccacaaaccaggcgagguaguaguaucauaugggggcaugcgcguacgaccaaaaugcuacggauucucccgcaugauggcaaccauggaaguaaacccacccgagcaaaggauagggcaaugcacaggcugccaccuggagugcaucaacgguggaguccgccuaaucacgcugacaagcgagcugaaaagcgcaaccgugugcgcaucccacuucugcagcucggccacgagcgggaaaaagagcacggaaauucauuuucauucaggcucgcuaguaggaaaaaccgcaauccacguuaagggagcucuaguagacgggaccgaguucacguucgaagguagcugcauguucccggacggaugcaacgcauuagacugcacauucugccgagaguuccucaagaacccccacugcuaucccgcaaagaaauggcuauucaucauuaucgucauacuacucggcuaugcaggccuaaugcuacuuacaaacguacugaaagcgauaggcguauggggcagcuggguaauagcaccgguaaaacuaauguucgcgaucaugaagaaacucaugcgcacggucagcugccucguagggaaacuaauggaccggggccgccaagucauacacgaagagaucggggagaacggggaggguaaccacgaugacgucagaaucgagauggcacguccacgacgagucagacacuggauguacagccccguaauccuaacgauucuagccauaggguuagcggagggaugcgacgagaugguccacgcugacucaaaacugguaucgugccgacagggaagcggaaacaugaaagaaugcguaaccaccggacgagcccuccucccuuccguaaaccccggacaagaagccugccuccacuuuaccgcgccaggcucuccagacucaaaaugccucaagauaaaagucaagcgcauaaaucucaaauguaagaaaagcucaaguuacuuuguaccagacgccagaaacagaugcaccagcgugaggcgcugccgcugggcaggcgacugccaaagcgguugucccccacacuucacgagcaacucauucagcgacgacugggcgggaaaaauggacagagccggcuuaggauucaguggcugcagcgacggcugcggaggcgcugcgugcgggugcuuuaaugccgcgccaaguugcaucuuuuggagaaaauggguugagaacucgcacggaauaauauggaaaguaagccccugcgccgcguggguccccucggcagucauagaacucacgaugccauccggagaaguccgcacauuucacccaaugagcggaaucccgacucaggucuucaaaggggucucgguaacauaucugggcagcgacauggaagucucaggacugacggaccuuugcgagaucgaggagcugaaaagcaaaaagcucgcacucgcccccugcaaccaggccgguauggggguagucggaaaagucggcgaaauacaaugcagcagcgaagagucagcgcgcacaauaaagaaagauggcugcaucuggaacgcggaccuugucgggaucgagcucaggguagacgacgcagucugcuacucaaaaaucaccucaguggaggcgguagcaaacuacuccgccauucccacaaccauaggcgggcuccgauucgaacgcucacacgacagccagggcaagauaucgggaucgccauuggacauuacagcaauacgaggauccuucagcguaaacuauagaggguuacgccucagccucucugagaucacggcaacauguacgggcgaaguaacgaaugugagugggugcuacuccuguaugacgggcgcgaaaguaagcauaaagcugcacucgagcaaaaacucaaccgcccacguacgcugcaaaggcgacgagacagcauucucaguacuggaaggaguccacagcuacacaguaagucucucauucgaccacgcggugguugacgaacagugucaacuaaacugcgguggacaugaaagccaggucacccugaaagggaaccugaucuuccuagacguccccaaguucgucgacgguagcuacaugcaaacauaccacucgacgguucccacaggggcaaacauacccucucccaccgauuggcugaacgcccuuuucggcaacggccucagccgauggauccuaggcguaauaggcguccugcugggaggacucgcacuuuucuuccucauuauguuccuguucaaacucgguacaaaacaagucuuccggagcaggaccaaguuagcauaa

SEQ ID NO: 16523 - RNA, 3222 nt, Artificial Sequence
  derived and/or modified CDS sequence (opt11) from SFTSV/FTLSV(2011YSC22)__KF711927.1__GP
augaugaaaguaauaugguucaguagccuugugugccuagucauucaaugcucaggagacagcggaccgaucauaugcgcgggcccaauucauucaaacaaaucagccgccauaccacaccuccuaggauacucagagaaaaucugccagauagaccggcucauccacguaaguuccuggcugcgcaaccacucccaauuucaaggguacgucggacagcgcgggggaaggucacaagucucguacuaccccgcggaaaacagcuacucccgcuggagcgggcuacugucaccaugcgacgccgacuggcucggcaugcuuguagucaagaaagccaaaggaucggacaugauaguaccgggacccaguuacaaaggaaaaguguucuucgaacgccccaccuucgacggguacguaggaugggguugcggcucaggcaaauccagaaccgaaagcggagaacuaugcucaucagacuccggaacaagcagcggccuccuaccaagugacagaguccuauggauaggugacgucgcgugccagccaaugacccccauucccgaagaaaccuuccuugaacuaaagaguuucagccaaagcgaguuuccggacaucugcaagauagacggaauaguuuucaaccaaugcgaaggcgaaucacucccacaacccuucgacgucgcauggauggacgucgggcauagccacaagauuauaaugcgggaacacaaaaccaaauggguccaggaaucuucauccaaagacuucguaugcuacaaggaaggcacgggaccgugcuccgaaucagaggaaaaagcaugcaaaaccucagggucaugcaggggcgacaugcaguucugcaaaguggccgggugcgaacacggagaagaagccucagaagcaaaaugucgaugcagccuaguccacaagccaggcgagguaguaguaucauacggcgggaugcggguccgcccaaaaugcuacggguucucccgcaugauggcaaccauggaaguaaaucccccagagcagcguaucggccaaugcaccggcugccaccuagagugcauaaacggaggggugcgacucaucacauugacauccgagcucaaaagcgccaccgucugugccagccacuuuugcaguagcgccacgagcgguaaaaagagcacggaaauacacuuccauagcggcucccucgugggaaaaacagcaauccacgucaaaggcgcgcucguggacggaacagaguucacguucgaaggcucauguauguuuccggacggcugcaacgccgucgacugcacauucugcagggaguucuuaaagaacccccagugcuaccccgccaagaaauggcuguucaucauaauuguaauccuccuaggauacgccggccucaugcuccuaacaaacgugcuaaaggcgaucggcguaugggggagcugggucaucgcaccgguaaaacuuauguucgcaauaaugaagaaacuaaugcgcaccgugucauguuuggucgguaaacugauggacagagggcgccaagugauacacgaagaaauaggugagaacggggaaggcaaccacgacgacguaagaauagagauggcacgaccacgacgggucaggcacuggauguacagcccagugauacucacaauacuggcaaucgggcucgccgaaggcugcgacgaaaugguacacgcagacagcaaacucgucuccuguaggcaaggcagcggaaacaugaaagaaugcgugacaacaggccgggcccuccucccaagcgucaauccgggccaggaagcaugccuucauuucacggcgccaggcucgccggacaguaaaugccuaaagauaaaagucaagcgcaucaacgucaaaugcaagaaaucaucaagcuauuucgugcccgacgcccggaaccgaugcacauccguaagaagaugcagaugggcaggcgacugccaaagugggugcccgccccauuucaccuccaacagcuucucagacgacugggccggaaaaauggacagagccgggcuugguuuuuccggaugcagcgacggcugcggaggggccgcaugcggaugcuucaacgcggcgccuuccugcauauucuggagaaaauggguagaaaacucccauggaaucaucuggaaaguauccccgugcgccgcgugggucccauccgcggucaucgaacuaacuaugccuagcggcgaggugcggacguuccaucccauguccggaaucccaacccagguguucaaagggguuucggucaccuacuugggcucggacauggaagugagcggccugacggaccugugcgaaauagaagaacuuaaaagcaagaaacucgcauuagcaccuugcaaucaagcaggcaugggagucguagggaaaguaggcgaaauccagugcuccucagaagaauccgcgcgcacaaucaagaaagacgggugcaucuggaaugcggaccuagucggaaucgaacucagagucgacgacgccgucugcuacucgaaaauaacgucuguggaagcuguagccaacuacucagccauaccaacaaccauagggggacuacgcuucgaaagaucacacgacucccaaggcaaaauauccggaucgccgcuagacauaaccgcgaucagaggaucguucuccgucaacuaccgaggucugcgccucucccugagcgaaaucacagcgacauguacgggcgaggucaccaacgugagcggaugcuacagcuguaugacaggagccaaaguaucaauaaaacuccacuccagcaaaaacucaaccgcgcacguaagaugcaagggcgacgaaacagcauucucaguccuagaaggaguccacagcuauaccguguccuuaucguucgaccacgccgucguagacgaacagugccaacucaacugcgggggacacgaaucccaagucacacucaaaggcaaccuaauuuuccuggacguaccaaaauucgucgacggcagcuauaugcaaacauaccacucuacugugccgacaggggccaacaucccaagcccgacagacuggcuaaacgcgcuccucggcaacggcaugucuagguggauccuaggagucauaggaguccuauuaggaggacucgcccuguucuucuuaauuauguuccuauucaagcucggaaccaaacagguguucaggagucggacgaaacuugcauga

SEQ ID NO: 16524 - RNA, 3222 nt, Artificial Sequence
  derived and/or modified CDS sequence (opt11) from SFTSV/FTLSV(2011YSC60)__KF711945.1__GP
augaugaaggucaucugguucagcucacucauaugccuagucauacaguguggaggggacacaggccccauaauaugcgcgggcccgauacacagcaacaaaagcgcagacauaccacaccuacucgguuacagcgagaaaauaugccaaauugaccggcucauccacgucuccucauggcuacgaaaucacagccaauuccaaggcuacguaggacaacgaggcgggagaagccaagucucauacuacccugcggaaaacagcuauagcagaugguccggacugcuuagcccaugugacgcagacuggcuaggaaugcucguagucaagaaagcaaaaggaucugacaugaucgugcccggacccagcuacaaaggcaaagucuuuuucgaaagacccaccuucgauggauacguaggcugggguugcggcagcggcaagagcaggaccgaaagcggagaacuauguuccucagacagcgggaccuccagcggccuccuccccucggacagaguccuguggauaggggacguagcaugccagcccaugacccccaucccagaagagacauuccuagaacugaaauccuucagccagagcgaguucccggauauaugcaaaauagacgggauagucuucaaccagugcgaaggagaaagccuaccacaaccauucgacgucgccuggauggauguaggccacucgcacaaaauaaucaugagggaauacaaaacgaaauggguccaggaaucuagcucgaaagacuucgucugcuacaaagaagguacagggccgugcucagaauccgaagagaaaacgugcaaaaccagugguuccugcagaggagacaugcaauucugcaagguggcaggcugcgaacauggcgaagaagccucugaagcaaaaugucgaugcagccuaguacauaaaccgggcgaagucgucgucaguuacggaggcaugagaguacgcccaaagugcuacggauucucgcgaaugauggcgacacucgaaguaaaccaacccgagcaacggaucgggcaaugcacuggcugccaccucgaguguauaaaugggggcguccgcuugauaacccuuacaucagagcucaagagcgccacaguaugcgccagucacuucugcucaagcgccacgagcggaaagaaaagcacggaaauucaauuccacuccggaucacucgugggaaaaacagcaauccacgugaaaggcgcacuggucgacggcacagaguucaccuucgaagguucgugcauguucccagacggcugcgacgccguagacugcacauucugccgggaauuucucaaaaacccccaaugcuaccccgcaaagaaauggcucuuuauaauaaucguaauucuucucggcuacgcgggacuaaugcugcucacaaacgugcucaaagcuauuggcaucuggggaagcuggguaauagcgccagucaaacugauauucgccauuauaaagaaacucaugcgcacugucucgugccuaaugggcaaacucauggaccgaggccgacagguaauacaugaggaaauaggagaaaaccgggagggaaaccaagaugacguaagaauagaaauggcgcgaccaagaaggguacggcacuggauguacagcccggucauacuuaccauauuagcaauaggcuuagccgaaagcugcgacgaaauggugcacgcagacagcaaacucguguccugccgacaaggcagcggaaacaugaaagaaugcgugacaaccggcagggcccuccugccggcagucaacccaggccaagaggcaugccuacacuucaccgcccccggaucaccagacagcaaaugccuacggaucaaagucaaacggaucaaccucaagugcaagaaaucauccagcuacuucgugccggaugcccgcaacagaugcacaagcguuagacgcugucggugggccggcgauugccagagcggcugcccgccccacuucaccucuaacucguucagcgacgacugggccggaaaaauggacagggccggauuaggcuucaguggaugcagcgauggaugcggaggagcugcaugcggauguuucaacgcagcaccgagcugcauauucuggcgaaaauggguagaaaacccgcacggaauaauauggaaaguaucacccugcgcggcgugggucccgagcgcaguaaucgaacucacaaugccaagcggagaagugcguacauuccaccccaugagcggaauacccacccaagucuucaaagggguauccgucacuuaccucggguccgacauggaaguuagcgggcucacagaccuaugcgaaauagaagaacuaaaaucaaagaaacucgcacucgcaccgugcaaccaggcaggcauggggguaguaggaaaggucggcgaaauacaauguucaagcgaggaaagugcucguacaauaaagaaagauggcuguauauggaacgcggaucuaguagggauagagcuccgagucgacgacgcagucugcuacucaaaaauaaccuccguagaagccguagccaacuacagcgccauacccacaaccaucggaggucuacgauucgaacgaucucacgacagccaagggaaaauaagcggauccccgcuagacauaacagccaucaggggcucuuucucaguaaacuacagaggacugaggcucucguuaagcgaaaucacggcgaccugcacaggcgaagucacaaaugucagcggauguuauagcuguaugacaggagcuaaagugagcauaaaacuccauucaagcaaaaacuccacugcgcacgucagguguaaaggggacgagacagccuucucaguacuagaaggggugcacucguauacuguaagccuaaguuuugaccacgcagugguggaugaacaaugccaacuaaacugcggaggucacgaaagccaaguuacauuaaaagggaaccucauauuucuagacgucccaaaauuugucgacggaaguuacaugcaaacauaccacagcacgguaccgacaggggcaaacauccccuccccaacggacuggcuaaacgcacucuucggaaacggcuuaaguagauggguccuggggguaaugggcguacuacucggaggguuagcccucuucuucaugaucaugagccuguucaagcugggcacgaaacaaguauuccgcagcaggaccaaacuagccuaa

SEQ ID NO: 16525 - RNA, 3222 nt, Artificial Sequence
  derived and/or modified CDS sequence (opt11) from SFTSV/FTLSV(2011YSH45)__KF711947.1__GP
augaugaaaguaaucugguucagcagucucauaugcuucgucauacagugcuccggagacagcggccccaucauuugcgcgggaccaauacauucaaacaagucagcagauaucccacaccuccuuggcuacagcgaaaagaucugccaaauagacaggcucauccacguuagcagcuggcuccgcaaccacucccaauuccagggguauguaggccaacgcgggggcagaucccaagugucuuacuacccagccgaaaauuccuacagcagauggucaggccugcuaagcccaugcgacgccgacuggcuagggaugcuaguagugaagaaagcgaaaggaagcgacaugaucgugccaggaccgucauauaaagggaaagucuucuucgagcgacccacauucgacggcuacgugggcuggggcugcggaucagggaaaagcagaaccgagagcggagaacuaugcagcagcgacagcggaacaucgaguggucuacuaccuucggacaggguacuguggauuggcgacgucgccugccagccaaugacacccaucccagaagaaaccuucuuagagcuaaaaucuuucagccaaagcgaguucccagacauaugcaaaauugacggaaucguauucaaccaaugcgaaggugaaucacugccccaacccuuugacguagcauggauggacguaggacauucccacaaaaucauaaugcgagaacacaaaacaaaauggguccaagaaucuagcucaaaagacuucgucuguuacaaagaaggaacaggacccugcagcgaaucagaagagaaaaccugcaaaacaagcggcagcugccgcggagacaugcaauucuguaaaguugcggguugcgaacacggcgaggaagcaagcgaagcaaaguguaggugcucccuuguccacaagcccggagaaguaguaguauccuacggcggcaugcguguacggccaaaguguuauggauucucccggaugauggcgacccuggaaguaaaucagccagaacagagaauaggacaauguacgggcugccaccucgaauguaucaacggaggcguccgacucauaacccuaaccucagaguuaaagagcgcaacagugugcgcuagccacuuuugcagcucagccacaagcggcaagaaaagcacagaaauccaauuccacuccggcucacucguagguaaaacggcaauacacguaaaaggcgcgcuagucgacggcacggaguucaccuucgaaggauccugcauguucccagacggaugcgacgcagucgacugcacguucugcagagaguuccucaaaaacccccaaugcuaccccgcaaagaaauggcuauucaucauuaucguaauacugcucggcuacgcaggacuaaugcuucuaacuaacgugcucaaagccauaggcauauggggcucauggguaauagccccaguaaaacuaaucuuugccaucaucaaaaagcuaaugcguaccgucagcugccugaugggcaaacucauggacagagggagacaagucauccacgaagaaauaggagaaaaccgcgaagggaaccaagacgacguaagaaucgaaauggcccgcccacgccggguccggcacuggauguacuccccugugauucucacgauccuggccaucgggcuagccgaaagcugcgacgaaaugguacacgcagacuccaaacuggugucuugucgccaggggagcgggaacaugaaagaaugcgucacuaccggcagagcccugcuaccagcaguaaaucccggccaagaagcaugccuccacuucacggcgcccggaucacccgacucaaaaugccucaaaauaaaggugaagcgcauaaaccucgaaugcaaaaagagcagcuccuacuucgugccagacgcaaggaacagauguacaagcguaagacggugucgcugggcaggagacugccagucggguuguccaccccauuucacaagcaacuccuucagugacgacugggcaggcaaaauggaccgcgccggacuaggauucucgggaugcucagauggaugcgggggcgcagccuguggcugcuucaacgccgcccccagcugcauauucuggcgaaaaugggucgaaaacccucacggaaucauauggaaagugagccccugugccgccuggguccccagcgccgucaucgaacuaacuaugccaagcggagaaguccgaacguuccaccccauguccggcauccccacccaggucuucaaaggagucucaguaacauaccuaggcuccgauauggagguaagcggacuaaccgaucuuugcgagaucgaggaacucaagucaaagaaacucgcccuggcuccaugcaaccaagccggcaugggaguagucggcaaggucggcgagauccaaugcagcucagaagaguccgcccgaaccaucaagaaagacggcugcaucuggaacgcagaccucguaggaaucgagcugcgaguagacgacgccgucuguuacucaaaaaucacaucggucgaagcuguggccaacuacucagccauacccacaaccauaggcggucugcgauucgaaagaagccacgacagucaaggaaaaauaucaggaucgccacuagacauaaccgccauccgcggcucauucuccguaaacuaccgagggcugcgacuaagccuauccgaaaucacggccacgugcacaggagaagucaccaacgucagcggaugcuauagcugcaugacaggagccaaagugagcauuaaauugcacuccagcagaaacucgacugcacacgugcguugcaagggagacgaaaccgcguucucggucuuagaaggcguacacuccuauaccgucucacuauccuucgaucacgcaguagucgaugaacagugccaacucaauugcggcgggcaugaaucgcaagugacacugaaaggaaaccuaaucuuccuagauguucccaaauucgucgacgguucauacaugcaaacauaucauucaaccguccccaccggagcaaacauaccguccccaacggacuggcugaacgcgcuauucggaaacggacugagccgauggguccuaggagucaugggcgugcuacuaggagggcuagcacucuucuucaugauaaugucacucuucaaacucggcaccaagcaaguauuccguucaagaaccaaacuggccuga

SEQ ID NO: 16526 - RNA, 3222 nt, Artificial Sequence
  derived and/or modified CDS sequence (opt11) from SFTSV/FTLSV(2011YSH52)__KF711928.1__GP
augaugaaagucauaugguucaguagccucauaugucuggucauacaaugcggaggcgacacaggaccgauaaucugcgccggcccaauacacagcaacaaaucugccgacauaccacaccuacugggcuacagugaaaagauaugccagauagacaggcuaauccacgucucaagcuggcugcgcaaccacucucaguuccagggcuacgucggccaaagaggagggcgcucacaggucucguacuacccagccgagaacaguuacuccagguggagcggucugcuaagccccugcgacgcggacuggcucgggaugcuugucguaaagaaagcaaaaggcucagacaugauaguacccgggcccucauacaaaggaaaagucuucuuugaacgcccuacauucgaugguuacguaggauggggcugcggaagcggcaaaucacgcaccgaaaguggcgaacuuugcuccagcgacuccggaacauccucaggacuacuccccucagacaggguacucuggaucggagaugucgcaugccaacccaugacccccaucccagaagagacguuccuggagcucaagagcuucagccagucagaguuuccggauaucugcaagauagacgggauagucuucaaucaaugcgagggggagagcuugccacaacccuucgacgucgccuggauggauguugggcauucacauaagaucaucaugcgagaacacaaaaccaaguggguccaagaaagcucaucaaaagacuucgucugcuacaaagaaggcaccggaccaugcagcgagagugaagagaaaaccugcaaaaccucaggcucgugccgcggagacaugcaauucugcaaagucgcagguugugaacacggggaagaagcgagcgaagcgaaaugccgaugcagccugguacacaagcccggcgaaguugugguaagcuacggagggaugcgaguacgucccaaaugcuauggauucagcagaaugauggcaacacucgaaguaucccaacccgaacaacggaucggacaaugcacaggcugccaccuagaaugcauaaacggaggaguuagacugaucacccucaccagcgaacucaaaagcgcaacugugugcgcaucccauuucugcagcagcgccaccagcggcaaaaagagcaccgaaauacaauuccacucaggcucucucgucggaaagacagcaauucacgucaaaggcgcauuaguggacggaaccgaauuuacguucgaaggcuccugcauguuccccgacggaugcgacgcagucgacugcacauucugccgcgaguuccucaaaaacccccaaugcuacccagcaaagaaauggcucuuuaucaucauagucauccugcugggcuacgcaggauucaugcuacucacuaacgucuuaaaagcaaucggcguaugggggucaugggugauagcaccaguaaaacuggucuucgccauaauaaagaaacucaugagagccgucucaugccuaaugggcaaacucauggaccgcggacgccaggucauacacgaagaaaucggcgaaaacagagaagguaaccaggacgacguaaggaucgaaauggcacgcccacgacggguacggcacuggauguacaguccgguaauauugacuauacuagccauaggccuagccgaaggaugcgacgaaaugguacacgcagacucgaaauugguaaguugccgccaaggauccgggaacaugaaagaaugcguaacuaccggacgggcacuacugccagccgugaacccaggacaagaagcaugccuccacuucaccgcacccggaucgccggacagcaaaugccuaaaaauaaaagucaaaaggauaaacaagaaaugcaagaaaagcucgaguuacuucgugccggacgccagguaccggugcaccagcguacgacggugucgaugggccggagacugucaaucaggaugcccaccacacuucaccuccaacagcuucagcgacgacugggcgggaaaaauggaccgcgcaggacucggguuuagcggcugcuccgacggaugcggcggagcagccugcggguguuucaaugcagcucccagcugcaucuucuggcgaaaauggguagaaaacccacacggaaucaucuggaaagucucgcccugcgccgccugggucccauccgccgucaucgaacuaacgaugcccucuggagaaguaaggacguuccacccaauguccgggauuccuacgcaggucuucaaaggcgucagcguaacauaccugggcagcgacauggaagucagcggucuguccgaccuaugcgaaaucgaagaacuaaacagcaagaaacucgcacuagcccccugcaaccaagccggaaugggagucguagggaaagugggcgaaauccaaugcagcagcgaggaauccgcacgcacaauaaagaaagacggcugcauaaggaacgcagaccucgucggcaucgaggugcgagucgacgaugcaguauucuacuucaaaauaacuagcgucgaagccguagcaaacuacagcgcgauucccacgaccauaggcggauuacgguuugaacgaucacacgacagccaaggcaaaauuuccggaucaccccuagacauaacagccauacgaggcagcuucagcguuaacuaccgcggacuucgacucuccuuguccgagaucacagcgaccugcaccggagaagucacaaauguaagcgggugcuacaguugcaugacuggggcgaaaguauccaucaaacuucacagcagcaagaacagcacagcacacguaagaugcaaaggggacgagacagcauuuagcgugcucgaggggguacacagcuacuccguaucccuaucguucgaccacgccguaguagacgaacaaugccaacuaaacugcggagggcacgaaucgcaagugacccuacgaggaaaucuaaucuuccuggacgugccaaaauucgucgacggcucauacaugcagacauaccacagcaccguaccgacaggggccaacauacccagcccaacagacuggcugaacgcacucuucgggaacggccuaucacgguggauccuuggagucaucggcguccuccuuggcgggcucgcccucuucuuccucauacuaucccuauucaaacucggaacaaagcagaucuucaggucacggacaaagcuagcguga

SEQ ID NO: 16527 - RNA, 3222 nt, Artificial Sequence
  derived and/or modified CDS sequence (opt11) from SFTSV/FTLSV(2011YXX9)__KF711924.1__GP
augaugaaagugaucugguucagcucacuggugugccuagucauucagugcuccggagacagcgguccgaucaucugcgccggaccgauacacagcaacaaaucagcagcaauaccucacuugcuaggcuacagcgagaaaaucugccaaauagaucgacuuauacacgugagcucauggcuccgcaaccacucacaauuccagggcuaugucggacagcgcggaggcagaagccaggucagcuacuaccccgccgaaaauaguuauagcagauggucaggacuacuauccccaugcgacgccgacuggcuagguaugcuaguggugaagaaagccaaaggcuccgacaugaucguacccggccccagcuacaagggcaagguauuuuucgaaagaccgacuuucgacggguacgugggcuggggaugcggcuccggaaaaagcagaaccgaaagcggcgaacucugcagcagcgauucaggaaccuccagugggcuacugcccucggaucgcgugcucuggaucggcgacgucgcgugccaacccaugacuccaaucccggaagagaccuuccucgaacuaaagagcuucagccaaagcgaguucccggacauaugcaaaaucgauggcauagucuucaaccaaugggaaggcgaaagucugccccaaccauucgacguagccuggauggacgucggacacucacacaaaaucauaaugagggaacauaaaacaaaauggguacaggaaucgucgucgaaagacuucgugugcuacaaagagggaaccggcccaugcucggagucugaagagaaggcguguaaaacaucaggcucgugcaggggugacaugcaauucugcaaaguagccggaugcgaacacggggaggaggcuucagaagcaaaaugccgcugcagucucguacauaagccgggcgaaguuguaguaucuuauggaggaaugcgcguacgaccaaagugcuacggcuucagcaggaugauggcaacaauggaaguuaaucccccugaacaaagaaucgggcaaugcaccggaugucaucucgagugcauaaacggcggcguccggcuaaucacccucaccagcgaacugaaaagcgcaacugugugcgcaagccacuucuguuccucagcaaccuccggcaagaaaagcaccgaaauacacuuucacucagggucccuagucggaaagacagcaauacacgucaaaggagcacucguggacggaaccgaguucacauucgaagggucuugcauguucccagacgggugcaacgcuguagacugcacguucugcagagaguuccucaaaaacccucagugcuacccagcgaagaaauggcuauucaucauaauagucaucuuacucggauacgccggccuuaugcuacucaccaacguccugaaggcgaucggaguauggggaagcuggguuauagccccagucaaacucauguucgcaaucaugaaaaagcugaugaggacaguaagcugccuugucggaaaacugauggaucgggggcggcaaguaauacacgaagaaauaggcgaaaacggagaagggaaccacgaugacguccgaauugaaauggcgcgcccacggcgugucaggcauuggauguauagcccagucauacugacaauacuggccaucggacucgccgaagguugcgacgaaaugguccaugcagacucgaaacucgucucaugcagacagggaagcgguaacaugaaagaaugcguaaccacaggaagggcacuacuaccuagcgugaaccccggccaagaagcgugccuacacuuuacagcaccaggaagcccggacagcaaaugccuuaaaaucaaagucaagcgaaucaaccugaaauguaaaaagaguucguccuacuuugugccagacgcucgaaacagaugcacuuccgucagaaggugccgaugggccggagacugccagucaggauguccgccccacuucaccagcaauagcuucagcgacgauugggccggcaaaauggacagggccggacuaggguucucaggcuguuccgacggcugcggcggggccgccugcggcugcuuuaacgcagcccccagcugcaucuucuggaggaaauggguagaaaauucgcacgggauuauauggaaagucaguccaugcgccgcaugggugccaucugcgguuauagaacucacaaugccaagcggagaaguccguacguuccacccaaugagcggcauaccaacacaggucuucaaaggaguaagcgugacauaccuagguagcgacauggaggucuccgggcuaaccgacuugugcgaaauugaagaacuaaaaagcaaaaagcuagcccucgcgccgugcaaccaagccggaaugggcgucguaggcaagguaggcgagauccaaugcucaucggaagaaucggcacgcaccauaaagaaagacggcugcaucuggaacgcggaccucguuggcaucgaacuccgaguagaugacgcaguuugcuacucaaaaauaacguccguugaagccguagcgaacuacucagcaauacccacuacaauaggagggcugagguucgagcgaagccacgacagccaaggcaaaaucucaggaagcccgcucgacaucaccgcgauacgggggagcuucucaguaaacuaccgggggcugcgucugagccuaagcgaaauaacagcaaccugcacaggagaaguaaccaacguaucugguugcuacagcugcaugacaggcgcgaaagugucgaucaagcugcacagcagcaaaaacagcaccgcacacguccgaugcaaaggugaugaaaccgcguucucgguacuagaagggguacacuccuauaccgucagccugagcuuugaccacgcaguuguagacgaacagugccaacuaaacugcggaggacacgaaagccagguaacacuaaaaggcaaccucauuuuccucgacgucccaaaauucguagacggcagcuauaugcaaacauaucauagcaccguaccgacaggagccaacauccccagucccaccgauuggcucaacgcgcuauucggcaacggccuaucacgguggauccuaggcgugaucgggguauugcuuggagggcuggcacucuuuuuccugaucauguuccuguucaagcuagggaccaaacaaguauuccggagccgaacgaagcucgcauga

SEQ ID NO: 16528 - RNA, 3222 nt, Artificial Sequence
  derived and/or modified CDS sequence (opt11) from SFTSV/FTLSV(2012YGS10)__KF711937.1__GP
augaugaaaguaaucugguucucaucgcuuauaugcuucguaauccaaugcuccggcgauucaggcccgauaauuugcgcaggcccaauacacagcaacaaaagcgccgacauaccgcaccuucugggauacagcgagaaaaucugccagauagaccgacugauccacgucagcucauggcucagaaaucacagccaauuccaaggguacgugggccagcgcgguggacggucccaaguuuccuacuaccccgcagaaaacucauacagucgauggucaggacugcuaucccccugcgacgcggacuggcucggcaugcuagucgucaaaaaggccaagggcagcgacaugauaguacccggcccgagcuacaaaggaaaagucuucuucgaacguccgacauucgauggauacguaggauggggaugcgggucaggcaaaucaagaacagaaucaggagaacucugcuccagcgacagcggaaccucgagcggacuacuacccuccgaccggguacucuggaucggagacguagccugccaacccaugacacccauaccagaagaaaccuuuuuggaacuaaaaaguuucagccaaagcgaguucccggacauaugcaaaaucgacggaauaguauucaaccaaugcgaaggcgaaucacuuccacagccauucgacgucgccuggauggacguaggucacucgcacaaaaucaucaugcgcgaacauaaaaccaaguggguccaggaaucauccagcaaagacuucguaugcuacaaagaagguacaggaccgugcagugaaucggaagaaaagacauguaaaacaucaggaucgugcagaggggauaugcaauucugcaagguggccggaugcgagcacggagaagaagcgagcgaagcaaaaugccggugcagcuugguccacaaacccggcgaagucguggucucuuacgguggcaugcggguccggcccaaguguuacggauucucacgcaugauggcgacccuggaagucaaccagccagaacagcggaucgggcaauguaccggaugccaccuugagugcaucaacggaggagucagacucaucacgcucacaagcgaacuaaagagcgcuaccgugugcgcaagccacuucugcucaucagcaaccagcggcaaaaagagcaccgaaauacaauuccacucaggaucgcucgucggcaaaacagcaauccacguaaagggcgcacucgucgacggaaccgaguucacguucgaagggucaugcauguucccagacggcugcgacgccguagauugcacguuuugucgggaguuccucaaaaacccacaaugcuacccagcaaagaaguggcuauucaucaucauaguaauccuccuaggcuaugccggauugaugcuacugaccaacguacucaaagcaauagguauauggggcaguugggugauagccccaguaaagcucaucuucgccaucauuaagaaacucaugcgcacaguaagcuguuugauggguaaacuaauggaccgcgggcgucaggucauacacgaagaaauaggagaaaacagagaaggcaaucaggacgacgucagaauugagauggcacgcccccggcgcguccgacacuggauguacagcccaguaauacucaccgugcuagcaaucggccuagccgaauccugcgacgaaaugguucaugccgacuccaaacucgugagcugccgccaaggcagcggcaacaugaaagaaugcguaacaaccgggagagcccuacucccggccgucaacccaggacaagaggcgugcuuacacuucaccgcgccuggaucaccagacucaaaaugucuaaaaauaaaagucaaacgaauaaaucuaaaaugcaagaaaucaagcagcuacuucguaccggacgcaaggagccgcugcaccuccguacgcagaugcagaugggccggcgacugccaguccggaugucccccgcacuucacguccaacagcuucuccgaugauugggccggaaaaauggaccgagcaggccuaggauucucaggaugcagcgacggcugcgggggagcagcuugcggaugcuucaacgccgccccgaguugcauauucuggagaaaaugggucgaaaacccgcacggaauaauuuggaaaguaagcccaugcgcugcuugggugccauccgccgucauagaacuaacaaugccaagcggggaaguccgcacauuccaccccaugagcggaauacccacccaaguauucaaaggcguaagcgugacguaccugggaagcgacauggaaguuagcggacuaaccgacuuaugcgagaucgaagaacucaaaagcaagaaacucgcgcucgcacccuguaaccaggcgggaauggggguagucggcaaaguuggugaaauacaaugcaguucggaggaauccgcucgaaccaucaagaaagacgguugcauauggaacgccgaccucguagguaucgaacugagagucgacgacgccgugugcuacagcaaaaucacauccguagaagcaguugccaacuacagcgccaucccgacgaccauaggcggacuucgauucgaaagaagccacgauucacaaggcaaaauauccggcagcccccuagacauuaccgcgauaagaggcagcuucucaguaaacuacagaggucuacgccucagccucuccgagaucacagccacaugcacaggcgaaguaaccaacguaucgggcugcuacagcuguaugacuggcgcgaaagucagcauaaaacugcacagcucgaaaaacuccaccgcccacgugcgaugcaaaggcgacgagacggcguucucagugcuagagggagugcacuccuauacggugucccuguccuuugaccacgccguagucgaugaacaaugccaacucaacugcgggggacaugaaucgcaagucacccuaaaaggaaaccugauauuccucgacguccccaaauucguggacggcucguacaugcaaacauaccacagcacaguacccacaggcgcgaacauaccaaguccuaccgacuggcucaacgcccuguuuggaaacggccucagccgcuggauccugggagucauaggcguccuccuagguggauuagcacucuucuucaugauaaugucacuguucaaacucggaacaaaacaggucuuccgcucccgcaccaaacuagcguga

SEQ ID NO: 16529 - RNA, 3222 nt, Artificial Sequence
  derived and/or modified CDS sequence (opt11) from SFTSV/FTLSV(2012YGS4)__KF711933.1__GP
augaugaaagugaucugguucagcagccucauaugcuucgucauacaaugcagcggggauucgggcccaauaaucugcgcaggaccaauacacuccaauaaaagcgcagacaucccgcauuuacucggauacuccgaaaagaucugucaaauagaccgccucauacacguaagcuccugguuaagaaaccacucgcaauuucaaggauacgucggccagcgaggagggcgaagccaggucaguuacuacccagccgagaacagcuacucaagguggagcggcuuacuaagccccugugacgccgacuggcucgguaugcugguggucaagaaggcgaaaggcagcgacaugauaguacccggccccagcuacaaaggaaaaguguuuuucgaacgcccaacauucgacggcuacguaggauggggaugcggcucaggcaagagcaggaccgaaaguggagaacugugcucaucagacagcggcaccagcucaggucuccuacccucggacaggguccucuggaucggcgacgucgcgugccagcccaugacgccgaucccagaggagacauuccuggaacuaaaaucauucagccagucagaguuccccgacauaugcaaaaucgauggcaucguguuuaaccagugcgaaggagaaucacuaccacaaccauucgacguagcguggauggacguaggccacucgcacaaaaucauaaugcgcgaacacaaaaccaaauggguccaggaaaguagcagcaaagacuuuguaugcuacaaggaagggacaggccccugcagugaaagcgaagagaagacauguaaaacguccggaucaugcaggggcgauaugcaauuuuguaaaguggcaggaugcgaacacggagaggaggccagcgaagccaaauguagguguagccuaguacauaagccaggcgaaguaguggucagcuacggaggaaugcgcgugcgacccaaguguuacggauucucccgaaugauggccacguuggaagucaaccagccagaacagcgaauaggacaaugcaccggaugccaccucgaaugcauaaacggcggcguacggcuaauaacccugacgagcgaacuaaagucggccacuguaugcgccagucacuucugcuccagcgcaacguccgggaagaaaagcacagaaauacaauuccauagcggcagccuaguaggaaaaaccgcaauacacguaaaaggagcgcucguagacggaacggaauuuaccuuugagggaagcugcauguucccagacgggugcgacgcaguagacugcaccuucuguagagaguuccuuaaaaacccccagugcuaccccgccaagaaauggcuguucaucauaaucguuauccuacuaggcuacgcggggcuaaugcuccugacaaacguacuaaaggccauaggaauauggggaagcugggucauagcgccgguaaagcuaauuuucgcaauuauaaagaaacuuaugcguacagugucgugcuugaugggaaaacugauggacaggggacggcagguaauacacgaagaaaucggcgaaaaccgugaaggcaaccaggaugacgucagaaucgagauggcccggccaagaagagugcgccacuggauguacagccccgucauccucaccauucuagcaauaggacuagcagaaagcugcgacgaaaugguccacgcagacagcaaauuaguaucgugccgccagggauccgggaacaugaaagagugcguaacgacagggagagcucuacucccagccgugaaccccggacaagaagcgugucugcacuucacagcgccaggcagcccagacagcaagugccuaaaaauaaaagugaaacguauaaaccucaaaugcaagaaaucauccucauacuucgucccagacgcaagaagucguugcaccagcguccgacgaugccgaugggccggggacugccaaagcggaugucccccgcauuuuacgagcaauaguuucagcgacgacugggccggaaaaauggaccgagcaggacucggauucucuggaugcucagacgggugcggcggggcagcaugcggaugcuuuaacgccgccccuuccugcauauucuggcgcaaauggguggaaaacccccacggcaucauauggaaagugucgccgugcgcagcauggguaccaucggccguaauagaacugaccaugccaucaggcgagguacgcaccuuccaccccaugaguggaauaccgacacagguauuuaaaggcgucagugugaccuaccucgguuccgacauggaggugagcggacucacagaccucugcgaaauagaagaacucaaauccaagaaacucgcauuagcacccugcaaccaagcaggaaugggcguagucggcaaagucggagaaauccaaugcagcucugaagagagcgcucgaacgaucaagaaagacggcugcauauggaacgcggaccucgucggcaucgagcugcgaguagacgacgcagugugcuacucaaaaauaacauccgucgaggcaguagcaaacuacagcgcaaucccuaccacaaucggcggacucagguucgagcgcagccacgacagccaaggaaaaauauccggcauuccacuugauaucaccgcgaucagaggaucguucuccguaaacuaucgaggcuugcgccugagccuauccgaaauaacagcaacaugcacaggcgagguaaccaacguaaguggcugcuacagcugcaugacaggugcgaaaguaagcaucaagcugcacucaagcaaaaacaguacagcccacguacgcuguaaaggcgacgagacagcguucucgguacucgaaggggugcauagcuacaccgugucccugagcuucgaccacgccgugguggacgaacagugccaacuaaauugcggaggccacgaaucccaagucacacuaaaagguaaccuaauauuccucgacguuccgaaauucgucgauggauccuacaugcaaacauaccauagcaccguaccgaccggggcgaacaucccaagccccacggacuggcugaacgcacuguucggaaacggcuugucaagguggauccugggcgucauuggaguccuccugggcggccuagcacuguucuucaugaucaugagccucuucaaacuaggaacaaaacagguuuuccgcagcaggacaaaacuggcguaa

SEQ ID NO: 16530 - RNA, 3222 nt, Artificial Sequence
  derived and/or modified CDS sequence (opt11) from SFTSV/FTLSV(2012YSC6)__KF711931.1__GP
augaugaaaguaaucugguucuccucgcucauaugcuucgucauacaauguuccgggggcucgggccccauaaucugcgcgggccccauccacaguaacaaaagugcggacaucccccaucugcuaggauacuccgagaaaauaugccagauagacaggcucauacacguaagcucgugguuacgcaaccacagucaauuucaaggauacgucggccaacgcggaggcagaagucaggucaguuacuacccagccgaaaacucauacagccgauggucaggccuacuaucaccaugcgacgcagacuggcucggaaugcugguagugaaaaaggcaaagggaucagacaugaucgucccaggacccuccuacaaagggaaggucuucuucgaacgacccacauucgauggauacgugggaugggggugcggcucaggaaaaagucggacagaguccggcgaacuaugcucaucggacagcgggaccucgagcggacuccuucccucggaccgcguccucuggaucggcgacgucgcgugccagcccaugacgccgaucccagaggagacauuccuagaacucaaguccuucagucaaagugaguuuccagacauaugcaaaauagacggcauagucuucaaccaaugcgagggagagagccuaccccagccuauagacguugccuggauggaugucgggcacucacauaaaauaauaaugcgcgagcacaaaacgaaauggguccaagaaucgagcagcaaagacuucgugugcuacaaagaaggaacaggcccaugcucagaaagugaggagaaaacgugcaaaacaagcgguucgugcaggggagacaugcaauucugcaaaguggcaggaugcgaacacggggaagaagccucagaagccaagugccgaugcagccuggugcacaaacccggggaaguagugguaagcuaugggggcaugcgaguacgaccaaaaugcuacggauucaguagaaugauggcaacccucgaagugaaccagcccgaacaacgaauaggacaguguacagggugccacuuagaaugcauuaacggaggcguaagguugauaacgcugaccagcgaauuaaagucagcaaccguaugcgcaagccauuucugcagcucagccacguccgggaaaaagagcacagaaauacaauuccauucuggcagccuagucggaaagacggccauccacgugaaaggcgcacucguagauggcacugaguucacguucgaaggcucaugcauguucccggacgggugcgacgcuguggacuguacauucugcagagaguuccucaagaacccgcagugcuauccagccaagaaaugguuguucauaauuauagugauccuccuagguuacgccggacucauguugcucacgaauguauuaaaagcaaucggcauaugggggagcugggucauagcccccgucaaacuaauauucgcuauaaucaagaaacucaugaggacgguaucauguuuaaugggaaaacucauggacagggggcgccaaguuauccacgaagaaaucggcgaaaaccgagaaggaaaccaggacgaugucagaauagaaauggcacgcccacgaagaguacgccacuggauguacaguccggucauacuuacaauccucgccaucggacuagccgaaagcugcgacgagaugguccacgcggacuccaagcuaguaucgugucgacaggguagcgggaacaugaaagaaugcguuacaacagggagggcucugcuacccgccgugaacccaggccaagaagcgugccuccauuuuaccgcgccaggcagucccgacuccaaaugccuaaaaaucaaagucaaacgcauaaaccugaaaugcaagaaauccucaucauacuuugugccggacgccaggagucggugcacgagcguacgcagauguaggugggcaggcgauugccaguccgguugcccaccacacuucacaucuaauagcuucagcgacgacugggccggcaaaauggacagagccggacucggauucucgggcugcucagauggcuguggaggagccgccugcgggugcuuuaacgcggccccaagcugcaucuucuggcgaaaauggguugagaacccacacggcauaaucuggaaagucucgcccugcgccgcguggguccccucagcaguaaucgaauuaacaaugcccaguggagaaguacgcacauuccacccaaugagcggcauaccaacucaggucuucaaaggagucaguguuacauacuuaggcagcgacauggaagugagcgggcucacagaccucugcgagaucgaggaacucaaauccaaaaagcuggcacuggcaccuuguaaccaggccggaaugggggucgucggcaaggucggcgaaauacaaugcagcucugaagagagcgcccguacgaucaagaaagauggauguaucuggaaugcggacuuagugggaaucgaacuccggguagacgacgcgguaugcuacucgaaaauaaccucagucgaagcaguagccaauuacagcgcaauuccaacgaccauaggcggccucagguucgaacgaucgcacgacagccaaggcaagaucucggguagcccccuagacauuaccgcgaucaggggcucguucagcgucaacuaccgcggccugcgccugagccucuccgagauaacggcgacgugcacgggggaagucacuaacgucagcgggugcuacagcugcaugacaggcgcaaaaguauccauaaaacuacauagcagcaagaacagcaccgcacauguacgauguaaaggcgaugaaacagccuucaguguacuagaggggguccauagcuacaccgucagcuugagcuucgaccacgcaguagucgacgaacagugccagcuaaacugcggcggccaugagucacagguaacgcugaaaggaaaccugaucuuccucgacguaccaaaguuuguagauggaucguacaugcaaacguaccauucaaccgucccaaccggagccaacauccccagcccgacagacuggcucaacgcgcuguucggaaacgggcugaguagguggauccuaggggucauaggcgugcuucucggaggacucgcacuguuuuucaugaucaugagccucuucaaacuaggcaccaaacaaguauucaggagccgaaccaagcuggcauaa

SEQ ID NO: 16531 - RNA, 3222 nt, Artificial Sequence
  derived and/or modified CDS sequence (opt11) from SFTSV/FTLSV(2012YSH10)__KF711940.1__GP
augaugaagguaauaugguucagcagcuuaaucugcuucgucauccaaugcagcggggacagcggcccaaucauaugcgccgguccgauccacuccaacaagagcgccgacaucccccaccuccucggauacagcgaaaagauaugccaaaucgaucgacucauucauguuucguccuggcuccgcaaccacucccaauuccagggcuacguagggcaacgaggaggaagaagccaaguuucauacuaccccgcagaaaacuccuacucccgcuggagcggacugcuaucccccugcgacgcagacuggcucggaauguuaguaguuaagaaagcaaaaggcucagacaugauaguacccggaccaucauacaagggcaaaguguucuuugaaagaccgacauuugacggguacguuggcuggggcugcggcucaggaaaaagcagaaccgaaaguggcgaacuguguucuucagauagcgggaccagcagcggacuccuuccaucaaaccgaguccuauggauaggagauguagccugucaacccaugacaccaauuccggaagaaacauuccucgagcuuaagagcuucucacaaagugaguucccagacaucugcaaaauugacggcaucgucuucaaccaaugcgaaggugaaaguuugccucagcccuucgacguagcauggauggacguaggacacucacauaaaauuauuaugcgggaacacaaaacaaaauggguacaagaaucauccuccaaggacuucguaugcuacaaagaaggcacaggcccaugcucagaaucggaagaaaagaccugcaaaacaucaggcucaugcagaggcgacaugcaauucugcaaaguggcaggcugcgaacacggggaagaagccagcgaagcgaaaugccgaugcucacuuguccacaaacccggagaagucguaguaucauacggcggcaugcgcguccgccccaaaugcuacggguuuucacguaugauggcaacgcucgaaguaaaccaaccagaacaaagaauaggacaaugcacaggcugccaccuagaauguauuaacggcggaguacgccugauuacccuaacaagugaacuaaaaagcgcaaccguaugcgccagucacuuuugcagcagcgccauguccgggaagaaaagcacagaaauacaauuccauucaggaucccucgucgggaaaaccgcaauccacguaaaaggagcgcucguagacggaacagaguucacguucgaaggcucgugcauguuccccgauggcugcgaugcaguagacugcaccuucugcagagaauuucucaaaaacccacaaugcuacccagcaaagaaaugguuguucaucaucaucgucauucuccuaggcuacgccgggcugaugcugcucacaaacguacugaaagcgauaggcauaugggggagcuggguaaucgccccagucaaacuuaucuucgcgaucauaaagaaacucaugcguaccgucucaugucuaaugggaaaacuaauggaccgcggccgacaagugauacacgaagaaauaggcgaaaaccgagaagggaaccaagaugacguccggauagaaauggcccgcccgcguagaguaaggcacuggauguacagccccguuauauugacaauucuggccaucggacuggccgagagcugcgacgagaugguccacgcagacuccaaacugguaucaugucggcaaggaagugggaacaugaaagaaugcgucaccacaggcagagcccuacugccagccgucaacccgggacaggaagcaugccuacauuucacggcaccgggguccccagacucgaaaugccucaggauaaaaguaaaacgcaucaacuugaaaugcaagaaauccucaucuuacuucgucccugacgccagaucgaggugcaccagcguccggcgaugccgcugggccggagacugccagagcggaugcccaccccacuuuacaaguaacuccuucuccgaugacugggcaggaaaaauggacagggccggacucggcuucucagguugcagcgacggcugcggcggggccgcgugcggaugcuucaacgccgcacccaguugcaucuucuggcggaaaugggucgaaaacccccacgggauaaucuggaaagucagcccaugugccgcguggguacccagugccgugaucgaauuaacaaugccauccggggaaguacgcacauuccaccccaugagcggcaucccgacccaagucuucaaaggugucucaguaacauaccuggguucugauauggaagucuccgggcucaccgaucuuugcgaaaucgaagaacugaaaagcaagaaacuggcucucgcaccaugcaaucaggccgggaugggggucgucggaaaagucggggagauacaauguuccucagaggaauccgcgaggacaauaaagaaagauggcugcauuuggaacgcagaccuggucggcauagaacuccgcgucgacgacgcagucugcuacucaaaaaucacgucagucgaagccguagccaacuacucggccauccccacuacaaucggaggacucagauuugaacguagccacgacagccaaggaaaaaucucaggaucaccccuggacaucacugcgauccgcggaucauucucggucaauuaccgcggauuacgucuaagccucuccgaaauaaccgcaaccugcacaggagagguaacaaacgucuccggcugcuacagcugcaugaccggcgccaaggucagcauaaaauuacacuccuccaaaaacagcacagcucacgugcgcuguaagggggacgaaaccgcguucucgguccucgaaggaguccacucguacacuguaagucuuuccuucgaccacgccguaguggaugaacagugccagcuuaacugcggaggucacgagagccaagucacccuaaaaggaaaccuaaucuuucucgacguccccaaauucguugacggcucauacaugcaaaccuaccacuccacaguacccaccggcgcgaacaucccuagccccaccgacuggcucaacgcacucuucgguaacggccuaagccggugggugcucggggugaugggaguacuccugggaggacucgccuuauucuucaugaucaugucacuauucaaacugggaacaaagcaaguguuccgaucacgaaccaagcucgcauga

SEQ ID NO: 16532 - RNA, 3222 nt, Artificial Sequence
  derived and/or modified CDS sequence (opt11) from SFTSV/FTLSV(2012YSH104)__KF711943.1__GP
augaugaaaguaauaugguucuccucgcuaaucugcuuuguaauccagugcuccggagacucaggcccaauaauaugcgcaggcccgauccacagcaacaagagcgcagacaucccacauuugcuaggauacuccgagaaaauuugccaaaucgaucggcucauacacguaagcucauggcuuagaaaccauucucaauuccaaggauacguagggcaaagagggggaagaucacagguauccuacuacccagcagaaaacucuuacucaagguggagcgggcuacucagccccugcgacgcagacuggcucggaaugcuggucgugaaaaaggcaaaggggucggacaugauaguacccggcccgagcuacaaaggcaagguauucuucgaaaggccgaccuucgacggcuacguaggguggggcugcggcagcggcaagagcagaacggaaagcggagagcucugcucaagcgacuccgggacaagcagcgggcuccuaccuagcaacaggguccuauggauaggagacgucgcaugccagccaaugacaccaaucccagaagaaaccuuccucgaacuaaaaucauucucacagucagaguucccggacaucugcaaaauagauggaaucguauucaaccaaugcgaaggugaaucucuaccacagccauucgacguagccuggauggacgucggacauagccacaaaaucauaaugagggaacacaaaacgaaguggguccaagagucguccucgaaagauuucgucugcuacaaagaaggcaccggccccugcuccgaaagcgaagaaaagacaugcaaaacaagcggcucaugccgcggcgacaugcaauucugcaaaguagccggcugcgaacacggcgaagaagcaagugaggcgaaaugccgaugcagccucguccacaaaccuggcgaaguagucgucaguuacggggguaugcgcguacgaccaaaaugcuacggauucucccgaaugauggcgacccucgaagugaaccagccggaacaacgcauaggccaaugcaccggcugccaccucgaaugcaucaacgggggaguccgacugaucacguuaaccagcgagcucaaguccgcaacaguaugcgccucccacuucugcagcagcgcaacaagcggcaagaaaagcacagaaauacaguuccacucggguucgcuaguaggaaaaaccgcuauccacgucaaaggagcauuaguagacggaacugaauuuacguucgagggcucaugcauguucccagacggaugcgacgccguagacugcacauuuugcaggaaauuucucaagaacccacaaugcuauccagcaaagaaauggcuauucauaaucaucguaauacuccuaggauacgcgggacucaugcuacuaaccaacgugcucaaagccaucggcaucuggggauccuggguaauagccccaguaaaacugauauuugccaucauaaagaaacucacaagaaccgucagcugucugaugggcaaacuuauggauagaggaagacaggugauacacgaagagauaggcgaaaacagggaaggaaaucaagaugacgucagaauugaaauggcacgcccccggcgagucaggcacuggauguacagccccgucauccucacaauucucgcaauaggacuggcugagagcugcgacgaaauggugcacgcagacagcaaacucgucuccugccggcaagggagcgggaacaugaaagaaugcgucaccacgggacgcgcccugcucccagcaguuaacccgggccaagaagccugccuacacuuuaccgcaccagggagccccgacucaaaaugucugagaaucaaagucaaaagaauaaaccuaaaauguaaaaagucaagcucauacuucguccccgacgcacgauaccgaugcacaagcguccgccgcugccgaugggcaggcgacugccagucaggaugcccgccccacuuuacaagcaacagcuucuccgaugacugggccggaaaaauggaccgcgcaggacuaggauucagcggcugcagcgacggaugcgggggagcagcgugcgggugcuucaacgccgcacccucguguauauucuggcgaaaauggguagaaaacccccacggcauaauauggaagguaagcccaugcgcagcauggguaccaagcgcaguaauagaacucacaaugccgagcggagaggugcgcacauuccacccaauguccgggauccccacacaagucuucaaaggggucuccguuacguaucucggcagcgacauggaagucagcggccucacggaucuaugugagauagaggaacugaaaaguaaaaagcuagcacuggcaccaugcaaccaggcggggaugggagucguaggcaaagugggagaaauacaaugcucaagugaagaaagcgcccgcacaaucaaaaaggacggcugcauauggaacgccgaccuggucggaaucgaacuaagaguagacgacgcaguaugcuacagcaaaauaacaagcgucgaagccgucgcaaacuacagcgccauacccacgacgaucggcggacuucgguucgaacgcucccacgacagccaaggcaaaauaucggguucgccacucgacauaacggcaauccgaggaucauucucgguaaacuauagaggacuccgccucagccuaagcgagaucacagccacuuguacaggcgaaguaacgaacgucuccggcuguuacaguugcaugaccggggccaaagucaguauaaagcuccacagcucaaagaacagcaccgcgcacguccggugcaagggagaugaaacagcauucucaguccuagaaggaguccauagcuacacagucagccucuccuucgaccacgccgucguagacgaacaaugccagcuaaacugcggaggccacgaaucacaaguaacccugaaaggaaaccuaauauuucucgacguaccgaaauucguggaugggucauacaugcaaacauaccauagcaccguaccaacaggagccaacauccccagccccaccgacuggcucaacgcacuguuuggaaacgggcugucgagguggguacuaggcgugaugggggugcugcucggagggcucgcacuauucuuuaugauaaugagccuauucaagcuagggacaaaacaaguauucagaaguagaacaaaacuagcguaa

SEQ ID NO: 16533 - RNA, 3222 nt, Artificial Sequence
  derived and/or modified CDS sequence (opt11) from SFTSV/FTLSV(2012YSH105)__KF711944.1__GP
augaugaaagucauaugguuuagcucccucauaugcuucguaauccaaugcagcggagacagcggaccuaucauaugcgcgggcccaauacacuccaacaaaucugcagacaucccacaccuccuaggguacagugagaaaaucugccaaauugaccgacucauacacguaagcuccuggcuacgaaaccacagccaauuccaaggcuacgucggacagagaggcggcaggucacaagucucauacuaucccgccgagaacagcuacucaagaugguccggauuacuauccccaugcgacgccgacuggcucgggaugcuaguagucaaaaaggcaaaaggcagcgacaugauaguacccggccccuccuacaaggggaaaguauucuucgaacgcccaaccuucgacggauacguaggauggggcugcggcuccgguaagagccgaacugagagcggcgaacucugcuccuccgauuccgggacaagcagcggccuccugcccucaaaccgcgugcuauggauaggcgacguagcaugccagccuaugaccccgauaccagaagaaacguuccucgagcucaagaguuucagccaaagcgaguuccccgacaucuguaagaucgaugggauagucuucaaccaaugcgaaggcgaaagccucccccaaccauucgacguagccuggauggacgucgggcacagucacaagauaauaaugagagaacacaaaacaaaaugggugcaagaaucgaguuccaaggacuuugucugcuacaaagaaggaacagggccgugcagcgaaucagaagagaaaacaugcaagaccuccggaucgugcaggggcgauaugcaguucugcaagguggccgggugcgaacacggagaggaagcaucggaagccaaaugccgcugcagucuaguccacaagcccggcgagguugucguauccuacggagggaugcgcguacgaccgaaaugcuacggcuucucacgaaugauggcaacccuagaagucaaccaaccggagcaaagaaucggacaauguacuggaugccaccucgagugcaucaauggcggaguucgacucaucacccugaccagcgaacucaaguccgcaacaguaugugcgagccacuucugcucauccgcgacaagcgggaagaaauccacggagauacaauuucacucgggaucccuugucggaaaaaccgcaauccacguaaaaggcgcucucguggacgggaccgaguucacauucgaagggagcugcauguuuccugacggcugcgacgccgucgacuguacauucugccgcgaguuccuaaagaacccucaaugcuacccugccaagaaauggcuauucaucauuauaguuauacuccucggcuaugccggccuuaugcuacuaaccaacguucucaaggcgaucggcauauggggcagcuggguuaucgccccagucaaacucaucuucgcaaucauaaagaaacugaugcgcacagugaguugccucauggguaaacuaauggaccggggacgccaaguaauccaugaagaaauaggugaaaaccgcgaaggaaaccaggacgacguccgcauagaaauggcgcgaccacgccggguacgacacuggauguacuccccaguaauucuaaccauauuggcaauaggccucgccgaaagcugcgaugaaaugguacacgcggacucaaaacucguaucgugccgacaaggaagcggaaacaugaaagagugcguaacuacagggagagcccuacuccccgccgucaacccgggucaagaagcgugccuccacuucacggccccggggagcccggacucaaaaugccuucguaucaaagucaaaagaaucaaccuaaaaugcaaaaagagcagcuccuacuucgugccggacgcccgcagucgaugcacaagcgugcggagaugccggugggccggcgacugccaaagcggaugcccgccccacuucacuucaaacaguuucagcggcgacugggcggggaaaauggacagagccggccucggguuuagcgguugcucagacggaugcggcggggcagccugcggcuguuucaacgcagccccaagcuguaucuucuggagaaaaugggucgaaaacccacacgggaucauauggaaggucagcccaugcgcggccugggucccgucagcagucaucgaacuaacaaugccgagcggagaaguacgaacauuccacccaaugucaggaaucccaacccaagucuucaaaggcgugagcguaacguaccuggguucagacauggaagucagcggccugaccgaucuaugcgagauagaagaacuaaaaucuaagaaacuagcacuagcaccauguaaccaagcugggaugggggucguaggaaaagucggagaaauacaaugcagcucagaagagagcgcacgcaccaucaagaaagacggcuguaucuggaacgcagaccuggugggcaucgagcuaagggucgaugacgcggucugcuacuccaaaauaacaucagucgaagcagucgcuaauuacagugcaauccccacaaccauaggcgggcucagauucgaaagaucccacgacucacaaggcaaaauauccggaucaccccuagacauaacagcgauaagagguucauucagcgucaacuaccgcgggcuaagacugucacuaagcgaaaucacagcaaccugcacgggcgaagucacuaacguaaguggcugcuacagcugcaugacgggcgcaaaaguaagcauaaaauuacacagcuccaaaaacucaacggcgcacguacgaugcaaaggcgacgagacugcauucuccguccuggaaggcgugcauucguacaccguaagccuguccuuugaccacgcaguagucgacgaacaaugccagcuaaacugcggaggacacgaaucgcaagugacucucaaggggaaccuaaucuuccuagauguaccaaaguucguagacggcucauacaugcagaccuaccacaguaccgucccaacaggagccaacaucccgagcccgacggacugguuaaacgcccucuucgggaacggucuaagccgauggauucugggagucaugggagugcuucugggcgggcuagcgcuauuuuucaugauaaugucacuauucaaauuaggcacgaagcaaguuuucaggucucgcaccaaacuagccuga

SEQ ID NO: 16534 - RNA, 3222 nt, Artificial Sequence
  derived and/or modified CDS sequence (opt11) from SFTSV/FTLSV(2012YSH107)__KF711942.1__GP
augaugaaggucauaugguucagcucccucauaugcuucguaauucaaugcagcggagacuccggucccauaauuugcgcagggccaauacacagcaauaaaagcgccgacauaccgcaccuccuaggauacagcgagaaaaucugccaaauagaccggcucauacacguaucgagcuggcuacgcaaccacagucaauuccaaggauacgucggccaaagagggggccggucgcaaguauccuacuaucccgccgaaaauuccuacucccgguggucaggccuacuaagcccaugcgacgcggacuggcucgggaugcucgucguaaagaaggcaaaaggcucagauaugauaguacccgggcccucguauaagggcaaaguguucuucgaacgaccaacuuucgauggauacgugggcuggggguguggauccggcaaaagcagaacagaaagcggcgaacucugcagcucggacagcggaacguccagcgggcuacuccccucgaaccgaguacuauggauaggagauguagcaugccaaccaaugaccccgauaccagaggaaaccuuccuggaacucaaguccuuuagccaaagcgaguuccccgauaucugcaaaaucgacggaauaguguucaaccaaugcgaaggcgaaagccuaccacaaccguucgauguagcauggauggacgugggacacagccacaaaaucaucaugagagaacacaaaaccaaauggguccaggaaaguagcuccaaagacuucguaugcuauaaagaaggcacaggaccaugcucggaauccgaagagaaaacagggaagaccucaggcucaugccguggugauaugcaauucugcaaaguugcagguugcgaacacggcgaagaagcaucagaagcgaaaugucgcugcagccuaguccauaaacccggggaaguagugguaucguacggagggaugcgcguccggcccaaaugcuacggauucucccgaaugauggcaaccuuagaaguaaaccagccugaacaaaggauaggacaaugcaccgguugccaucucgagugcaucaacggcggcguacgccuaaucacacuaacgucugaacuaaaaagcgccacagucugcgcaagccauuucugcuccagcgccaccagcggcaagaaaagcacagagauacaauuccacucaggaucccucguuggcaaaacagcgauacacgucaaaggggcacucgucgacggaaccgaauuuacguuugaaggcuccugcauguuuccugacggcugugacgccguagacuguaccuucugccgcgaguuccuaaagaacccccaaugcuacccggccaagaaauggcuguucaucauuaucguaauacuccuuggguacgcaggccugaugcuccucacaaacguacuaaaggccauaggcauuuggggaagcugggugaucgccccagucaagcucauauucgcaauaauaaagaaacuuaugcgaacggucuccugucuaaugggaaaacuaauggaccgcggccggcaagugauacacgaagaaauaggggaaaaccgagaaggaaaccaagacgacguccgaauugaaauggcaagaccgcggagaguccgucacuggauguacucuccagucauacuaaccauccucgccauaggccuggcagaauccugcgacgaaauggugcaugccgacuccaaacucguaucuugcaggcaaggaagcgguaacaugaaagaaugcguaacaaccgguagagcccugcuacccgccguaaaccccggucaggaagcgugccuccacuucacagcuccgggcagcccagacucgaaaugccuccgcaucaaagugaaaaggaucaaccucaaaugcaagaaaagcucgagcuacuucguucccgacgccagauaccgaugcaccucagugcgccgcugccgcugggcgggcgacugccaaagcggcuguccaccgcacuucacgucaaacuccuucagugacgacugggcgggaaagauggaccgggcaggacugggauucucgggaugcuccgacgggugcggcggggcagccugcgguugcuucaacgcagccccgagcugcauauucuggcgcaaauggguagaaaauccgcacggcauaauauggaaggucagccccugcgcagcaugggugcccagcgcagucaucgagcuaaccaugccgucaggagaggugcgcacauuccaccccaugucaggaauccccacccaagucuucaaaggggugucagugacauacuuaggaagugacauggaagugagcggccucacggaccucugcgagaucgaagaacuaaagucgaagaaacuugcccuugcuccaugcaaccaggccggcaugggaguagugggaaaaguuggagagauccaauguagcucagaagagagcgcgagaacaaucaagaaagacggcugcauauggaacgcagaccuaguaggaauagaacucagaguagacgacgccgucugcuacuccaaaauaacuucgguggaggccgucgcaaacuacucggcaauccccacaaccauuggcggacuaagauucgagaggagccacgacagccaaggcaaaauaucagggucaccgcucgacauaaccgcgauaaggggcagcuucagcgugaacuacagaggacuccgacuaagccucagcgagauaacggcaacaugcacaggcgagguaacaaacgucucaggcugcuacagcugcaugaccggagcaaaaguaagcauaaaacuucauucauccaaaaauuccacagcgcacguccguuguaagggagacgagacagcauuuagcguccuagaaggcguacacaguuacacaguuagcuugucauucgaccacgccguagucgacgagcaaugccaacucaauuguggcggacacgagucccaaguaacccuaaagggaaaccucaucuuccucgaugugccaaaauucgucgacggcucguacaugcaaacauaccacaguaccguuccaacaggagccaacauuccgagccccaccgacuggcucaacgcacuauucggcaacggccuuagccgaugggugcuaggaguaaugggcguccuccuaggcggccucgcccucuucuucaugauaaugagccuauucaaacuaggcacaaaacagguauuccgauccagaacaaaacuagccuaa

SEQ ID NO: 16535 - RNA, 3222 nt, Artificial Sequence
  derived and/or modified CDS sequence (opt11) from SFTSV/FTLSV(2012YSH14)__KF711938.1__GP
augaugaaaguaaucugguuuagcucacucauuugcuucgucauccaaugcuccggggacucgggaccgauaauuugcgccggaccaauacacagcaacaaaucagccgacaucccccaccuacuaggauauagugaaaagauaugucaaaucgaccggcugauccacguaaguagcuggcugcgcaaccacagucaguuccaaggcuacguaggucaacgugggggccggagccaaguguccuacuacccagcagagaacagcuacucacgauggucaggccuccuaucacccugcgacgccgacuggcuagggaugcuaguagucaagaaagcaaaaggcagcgacaugaucguaccaggaccuucguauaagggcaaagucuucuucgagcgccccacauucgauggauacguaggcuggggcugcgggucaggaaagagcagaacugagagcggggagcucuguuccuccgauagcggaacgucgucaggacuauuaccaucggacaggguacuauggaucggcgacguagcaugccaaccuaugacacccauacccgaagagaccuuucuagagcuaaaauccuucagccaaagugaguucccggacauuugcaaaaucgacggcaucgucuuuaaccaaugcgaaggagaaagccuaccccagccuuucgacguggccuggauggacguggggcacucacacaagaucauaaugagagaacacaagacaaaauggguccaagaaucgagcucaaaggacuucgugugcuacaaggaaggcacugggccguguucagaaagcgaagagaaaaccugcaaaacaagcggcagcugcagaggagacaugcaauucugcaaaguggccggaugcgagcacggagaagaagccuccgaagcaaaaugccggugcagucugguccacaaaccaggagaagucguggucucauacggaggcaugcgggucaggccaaaaugcuacgguuucucgaggaugauggcgacgcuggaagugaaccaaccugaacagaggaucggacaaugcacaggaugccaucuugaaugcauaaucggaggcguacggcucauaacacugacaagugagcucaagagcgcgacaguaugcgcaucccacuucugcagcucggcaacgagugguaagaaguccacggagauacaguuccauagcggaucucucgucgggaaaacugcgauccacgucaagggcgcccucgucgacggcacagaguucacauucgaaggaucgugcauguucccggacggcugcgacgcaguagacugcacauucugccgagaguuccucaagaacccccaaugcuacccagccaagaaauggcuguucaucauaauaguuauccuacucggauacgcagggcucaugcuacuaacaaacguucugaaagccauaggcauauggggaagcuggguuaucgccccgguaaaacucauauucgccaucauaaagaaacuaaugaggacggucucaugccucauggggaaacugauggauagaggacgccaagucauccacgaagaaaucggggaaaaccgagaagggaaucaagaugaugucagaaucgaaauggcccgcccacgccgggucaggcacuggauguauuccccaguuauacugaccauccuagccaucgggcuagcagaaucgugcgaugaaaugguccacgcugacucaaaauuggucagcugccgacaagggagcgggaacaugaaagaaugcguaacaaccggccgggcucuacucccagccguaaacccaggccaggaagcaugccugcacuucacugccccugguucuccggacagcaaaugcuugaaaauaaaagucaaacggauaaaccuuaaaugcaagaaaagcagcagcuacuucgucccggacgccagaagccggugcaccagcgugcguagguguaggugggcgggcgacugccaaagcgggugcccaccccacuucacgucgaacagcuucagcgacgacugggcgggcaaaauggaccgggcaggacucggauucucggguugcagugacggaugcggcggggccgcaugugggugcuuuaacgcagccccuagcugcauauucuggcggaaaugggucgaaaacccgcacgguauaauauggaaagucucaccuugugccgcauggguacccagcgccgugaucgagcuaacaaugccgagcggcgaagucaggacauuccacccaaugagcggaauccccacacaggucuucaaaggagucuccguaacguaccuaggguccgauauggaaguaucggggcuaaccgaccuuugcgaaauagaagaacuaaaaaguaagaaacuagcacucgcgccaugcaaccaagcaggaaugggcgucguaggcaaagucggagaaauccaguguuccagugaagagagcgcgagaacaauaaagaaggacggcugcauauggaacgcagaccuaguaggaaucgagcuaagggucgacgacgccguaugcuacuccaaaauuacaucggucgaagcaguggccaacuacucagcaauccccacaaccauaggcgggcucagauuugaaagaucacacgacagccagggcaaaaucagcggaagcccacuggacauaacggcaauacgaggcucauuuucggucaacuacaggggauuaagacuaagccuaagcgaaaucacagccacaugcacaggcgagguaacaaacguaagcggguguuacucaugcaugaccggagccaaaguaagcaucaaacuacacagcagcaagaacucuacugcacacguaagauguaaaggagacgagacagcguucagcguacucgaaggcguccacagcuauaccgugucccucagcuucgaccaugcagugguugacgaacaaugccaacuaaacugcggcggacacgaaucacaggucacgcugaaagggaaccuaauauuccuagacgucccaaaauucgucgacggcucauacaugcaaaccuaucauagcacagucccgaccggggccaacaucccgucacccacagacuggcucaacgcgcuguucggaaacggacugucucgauggauacucggagucaucggcguacugcugggcgggcucgcacuauuuuucaugauaaugagucuuuucaagcuagggacaaagcaaguauucagaagccgaaccaagcucgcguaa

SEQ ID NO: 16536 - RNA, 3222 nt, Artificial Sequence
  derived and/or modified CDS sequence (opt11) from SFTSV/FTLSV(2012YSH16)__KF711934.1__GP
augaugaaagucaucugguucagcucgcucaucugcuucguaauacaauguuccggagacagcggcccaaucaucugcgccggacccauucacagcaacaaauccgccgacaucccgcaccuacuaggguacucagagaaaaucugccaaauagacaggcucauacacguaagcucauggcucagaaaccacucccaauuccagggcuaugugggccagaggggaggacgcucacaaguuagcuacuacccagccgaaaauucauacucacgcuggagcggacuacucagccccugcgacgcagacuggcuagguauguuaguaguaaagaaagcgaaaggaagcgacaugauugucccaggcccuagcuauaaaggaaaaguauuuuucgaacgaccaaccuucgacggcuacgugggcuggggcugcggaucaggcaaaagccgaaccgaaagcggcgaacucugcucauccgacuccggcacaucgucaggccucuugccaucagauaggguacuauggaucggagacguagccugccaaccaaugacgcccauucccgaagaaaccuuucuagaauuaaaauccuucucccaauccgaguuccccgacaucugcaaaaucgacgguaucguauuuaaccaaugcgaaggcgaaagccucccucagccguucgaugucgcauggauggacgucggccacagccacaaaaucaucaugcgagaacacaaaacaaaaugggugcaggaguccucaucgaaagacuucgucugcuauaaagaaggaacgggacccugcagugaaucagaagagaaaaccugcaaaacgucagggagcugccgcggcgacaugcaguucugcaaaguggcggguugcgaacacggagaagaagccucagaagccaaaugccggugcucccugguccacaaaccgggagaagucgucgucagcuacggcgggaugcgcgugcgccccaaauguuacggauuuagccguaugauggcgacacuggaagugaaccaacccgaacaacgcaucggacaguguacuggcugccaccucgaaugcaucaacgggggcguccgacucaucacccucacaagcgaacucaaauccgccacagucugcgcaagucacuucugcucaucugcaacgaguggcaagaaauccacagaaauacaauuccacuccgggagccucgucggcaaaacagccauccacgucaaaggggcauugguagauggaacugaguucacauucgaaggaucuugcauguucccagacggaugcgacgcagucgacugcacguucugccgagaguuccucaaaaacccccaaugcuacccagcaaagaaauggcuauucauaauaaucguuauacuacucggcuacgcaggccucaugcugcucaccaacguacucaaagcaaucggcaucuggggcuccugggucaucgcccccgugaaacucauauucgccaucaucaagaaacucaugcguacagucagcugucuaaugggaaaacuaauggaccgcggccgucaagucauccacgaagaaaucggagaaaaccgcgaaggaaaccaggacgacguacggauagaaauggcaagacccagacgaguccggcauuggauguacagucccgucauccuaaccauccuagcuauaggcuuagccgaaagcugcgacgaaaugguucacgcagacagcaaacuuguuuccugccgccaaggaagcggaaacaugaaagaaugcgugacaaccggaagggcccuacuaccugcagucaaccccgggcaagaagccugccuacacuucacagcacccgggaguccagacagcaaaugccugaaaauaaaggucaagcgaaucaaccucaaauguaagaaaucgucguccuacuucguaccggacgcacgauaccgaugcacaagcguccgccgcugccgaugggccggugacugucaaagcggaugucccccacacuucacauccaacagcuucucagacgacugggcaggcaaaauggaccgcgcaggacucggguucuccggcugcagugauggaugcgggggugcagcaugcggaugcuucaacgccgcacccagcugcaucuucuggcgcaaaugggucgaaaacccucacggcauuaucuggaaagucuccccaugcgcggcaugggugcccagcgccguaaucgaacucacaaugcccucgggcgagguccgaacauuccaccccaugagcggaaucccaacccaaguauucaaaggcgucucaguaaccuacuuaggcagcgacauggagguuagcggacuaaccgaccucugcgaaaucgaggaacuaaaguccaagaaacucgcccuugcacccugcaaccaggcgggcaugggggugguuggcaaagugggagaaauacaaugcucaagcgaagaaucagcccgcacaaucaagaaagacgguugcaucuggaacgcggaccuaguaggaaucgagcuccgcguagacgacgcagugugcuacucuaaaaucaccagugucgaagccguagcaaacuacuccgcaauccccaccacaauaggcgggcuacgauucgagcgaucacacgacagccaagggaagaucucaggaucaccgcucgacauaaccgcaaucagaggaucauucagcguaaacuaccgaggcuuacgacuaagccuaucagagauaacggcaaccugcaccggcgagguaaccaacguauccggaugcuacuccugcaugacuggggcgaaaguaagcaucaaacuccacuccucgaagaacucgacggcgcacguacgaugcaaaggagacgaaaccgcauucuccgucuuagagggcguccacagcuacaccgucucccucucuuucgaccacgcaguuguagacgaacaaugccaacucaacugcggaggccaugaaucccagguaacacuaaaaggcaaccugauauuccucgacguaccaaaauucgucgacgggagcuacaugcaaaccuaccacucgaccguaccaaccggagcaaacauccccagccccaccgacuggcugaacgcacuuuucggaaacggacucaguagguggauacuaggaguaaucggcguccucuuaggagggcuagcccucuucuuuaugauaaugagccuauucaaacugggaacaaaacaggucuuuagaagcagaaccaaacucgccuaa

SEQ ID NO: 16537 - RNA, 3222 nt, Artificial Sequence
  derived and/or modified CDS sequence (opt11) from SFTSV/FTLSV(2012YSH6)__KF711921.1__GP
augaugaaagugaucugguucagcucgcuaaucugcuuggucauacaauguagcggagacagcggacccaucaucugcgccggaccaauccacagcaacaaaucagcaggcaucccccaucugcuaggauacucugagaagauaugccaaauagaccgacucauacacgucucaagcuggcuccguaaccacucgcaauuccagggguacguaggccagagaggaggccgcagccagguauccuacuaccccgccgaaaacagcuacucaagauggaacggacuacuuucaccaugugacgccgacuggcuaggaaugcuggucgucaagaaagcaaaagaaucggauaugauagugccaggacccagcuacaaaggcaagguauuuuucgaacgccccacuuucgacggcuacgucggcuggggcugcggcucgggcaagagcagaacagaaagcggagaacugugcucgagcgacagcggaaccucguccggauuacuucccucagaucgaguccuguggauaggcgacgucgcgugccagccaaugaccccaauaccagaagagaccuuccucgaacucaagagcuucagccagagugaguucccagacaucugcaaaauagacggaauuguguucaaccagugcgaaggggaaucacucccccagcccuucgacguggcauggauggacgucggacacucccacaaaauaaucaugcgcgaacacaaaaccaaauggguccaagagucaagcagcaaagacuucgucugcuacaaagagggaacaggccccuguuccgaaagcgaagaaaaagccugcaaaacaucaggcuccugccgcggagacaugcaauucuguaaaguagcaggcugcgaacacggcgaagaggcaucagaagcaaaguguaggugcucacugguacacaaacccggcgaggucgucgucucuuacggcggaaugcgcgugcgccccaaaugcuacggcuucucccgcaugauggcgacccuggaaguaaacccaccagagcagcguaucggacaauguacaggaugucaccuagaaugcauuaacggcggaguaaggcucauaacgcucacaucugaacugcgaucggcgacagucugcgccucacauuucugcagcuccgccacgaguggaaagaaaaguacagaaauacacuuccacucaggcucacuugugggcaaaacagcuauacacguaaagggcgcucuaguagauggcaccgaguucaccuucgaaggcuccugcauguucccggacggaugcgacgcagucgacugcaccuucugcagagaguuccucaaaaacccacagugcuacccagcaaagaaaugguuauucaucaucauuguaauccuguuaggcuacgcagggcuaaugcucgucaccaacguacuuaaagcuauuggagugugggguuccugggucauagccccaguaaaacuaauguucgcgauaauaaagaaacucaugcgaaccguaucaugccuagucggcaaacuaauggaccgcggacgccaagucauccacgaagaaaucggcgaaaacggagaaggaaaucaggacgacguccgcauugaaauggcaaggccccgccgcguacgccauuggauguacagcccgguaauccuaacgauccuugccauaggauuagccgaaggcugcgaugagaugguacacgccgacagcaaacucgugagcugccgccaagggucaggcaacaugaaagaaugcauaacaaccggacgagcccugcuaccugcgguaaaucccggccaagaggcaugucuacacuucacagcgccggggucgccagacucuaaaugucucaaaauaaaagugaagcggaucaaccucaagugcaaaaagaguucauccuacuucguacccgacgccagguccaggugcacaagcguacgacgcugccgcugggcaggagacugccaaagcggaugcccuccccacuucaccaguaacuccuuuucagaugacugggccgguaaaauggaccgugccggccucggauucagugguugcucagacggcugcggaggagcagcgugcgguuguuucaaugccgcgcccagcugcaucuuuuggaggaaaugggucgagaacccgcacggaaucauauggaaggucagcccaugcgcagccugggucccguccgccgucauagagcucaccaugcccaguggagaaguacgcacauuccaccccauguccggcauaccaacccaaguauucaaaggagugucaguaacguaccucggcuccgacauggaaguauccggucucacagaccuaugcgaaauagaagaacucaaaaguaaaaagcuagcacuagccccaugcaaccaagccgggaugggagucgucggcaaaguaggagaaauccaaugcuccuccgaagaaagcgcaagaacaauaaagaaagacggaugcauauggaacgcggaccuaguagguauagaacuacguguggacgacgcagucugcuacucaaaaaucacuuccgucgaagccgucgccaacuacuccgcgaucccaaccacuaucgguggccuacgcuucgaacgcagccacgacucgcaaggcaaaaucucaggaagcccacucgacauaaccgcaauccgcggauccuucucaguaaacuaccgaggccugcgcuuaagccucucagagaucaccgcgacuugcacaggcgaagucaccaacgucucagguugcuacagcugcaugacaggcgcaaaaguaagcauaaaacuacacuccucuaaaaacucgacagcccacguacgcugcaaaggcgacgagaccgcguucagcguccuggagggaguacacagcuacauagucagccucagcuucgaccacgcggucgucgacgaacagugucaacuaaacugcggcggccacgaaucccaagucaccuuaaaaggaaaccucauauuucuagacgugccaaaauucguggauggcagcuauaugcaaacauaucacagcacagugccaaccggcgcaaacauaccaucuccaacagacuggcugaacgcacucuucggaaacggacucagucgcuggauacuagggguaaucggaguacugcuaggcggacuggcacuauucuuccuaauaauguuccuccucaaacucggaaccaaacaaguauucagguccagaacaaagcuagcauaa

SEQ ID NO: 16538 - RNA, 3222 nt, Artificial Sequence
  derived and/or modified CDS sequence (opt11) from SFTSV/FTLSV(2012YSH86)__KF711939.1__GP
augaugaaagucauaugguucagcucacucauuugcuucguuauacaaugcucgggcgacucgggccccaucauaugcgccggaccgauccacagcaacaaguccgccgacaucccacaccuuuuaggcuacucggagaagaucugccaaaucgacagacuaauacacguaucaucguggcucagaaaucacagccaauuccaaggcuacgucgggcaaagaggcggucgaagucaggucagcuacuacccagccgagaacucauacaguagauggucgggucuccucagcccaugcgacgccgauuggcuaggaaugcuagucgugaaaaaggccaaaggcucggacaugaucguccccggaccaucguacaaagggaaggucuucuucgaacgucccacuuucgauggauacgugggauggggcuguggcuccggcaaaagccgaacagaaagcggagaacucugcagcucagacuccggcaccagcuccggacuacucccauccgaccgaguucuguggaucggagauguggcaugccaacccaugaccccgaucccugaagaaaccuuucuagaacuaaagagcuucucgcaaagcgaguuuccggacauaugcaaaaucgacggcaucguauucaaccagugugagggcgaaucacucccccaacccuucgauguagccuggauggacgucggccacucccauaagauaauuaugagagaacacaaaacgaaaugggugcaggagucaagcuccaaagacuucgugugcuacaaagaaggaaccggcccaugcucggaaucugaggagaaaacaugcaagacgucaggaucgugcagaggggacaugcaguucugcaaggucgcaggcugcgagcauggagaagaggcauccgaagcaaaaugccggugcagccucguccacaaaccgggugaagucguggucaguuauggaggaaugcgaguacgacccaagugucacggcuucucaagaaugauggccacccucgaagucaaccaaccagagcaacggauaggacagugcacgggaugccaucuagaaugcauaaauggaggcguacgucucaucacacucaccagcgaacucaaguccgcuaccgucugcgccagccauuucugcucgagcgcaacaagcgggaagaaaagcaccgagauccaauuccacagcggaucgcuaguaggaaaaaccgccauccacgucaaaggggcgcuuguagacgggacggaguucacguucgaaggcuccugcauguucccagacggaugugacgcugucgacugcacuuucugccgggaguuccucaaaaacccccaaugcuacccagccaagaaauggcuauucaucauaauaguaauacuccucggcuacgcaggccuaaugcuccugaccaauguccucaaagccauaggcauauggggcagcuggguaauagcgccuguuaaauuaauguucgcgaucauaaagaaacucaugcggacaguuuccugccuaaugggaaaacucauggaccgaggacgccaagugauacaugaagaaauuggcgaaaacagagaaggcaaucaagacgacguccgaauagaaauggcacgaccccgccgcgugcgucacuggauguacaguccagucauccuaacaauccucgccauaggccuggcagagagcugcgacgaaaugguacaugcggacaguaagcuagugucaugcagacaaggcagcggcaacaugaaagaaugugugacgacugggagagcucuccucccugcagugaauccaggacaagaggcgugccugcacuucaccgcgcccggcaguccggacucaaaaugccuaaaaaucaaaguaaaacgcaucaaccucaaaugcaagaaaagcuccaguuacuucguccccgacgcaagaucccgaugcacauccguacgccgaugccgaugggcgggagacugucagagcggaugcccaccccacuucacaagcaacagcuucuccgacgacugggcgggcaaaauggaccgagcagggcucgguuucaguggcugcucagacggcuguggcggagcugcgugcggauguuucaacgccgccccgucaugcauauucuggcgaaaauggguagaaaacccccacgggauaauauggaaagucucaccaugcgcggccugggucccaucggccgucauagaacuaaccaugccaagcggggagguacgcacguuccacccaaugagcggaaucccaacccaaguuuuuaaaggcgucaguguaacauaccucggcuccgacauggaaguaagcggccuaaccgaccucugcgaaauagaagaacuaaaauccaagaaauuagcucuagcaccaugcaaccaggcaggaaugggggucguaggcaaagucggcgagauucaaugcucgucggaagaauccgcccgcaccaucaagaaagauggcugcaucuggaacgccgaucuagucggcaucgaacuccgagucgaugaugcagucugcuacuccaaaauaacaagcguagaagccguagcaaacuauucagccauacccacaaccauaggaggacuccgauucgaacguucacacgacagccagggcaaaauuuccgggagcccacucgacaucacagcuauaagaggauccuucagcguaaacuaccgcggccugcgacucagccugagcgagaucaccgcaacgugcacaggagaagucacgaacgugagcggcugcuacagcugcaugacgggggccaagguaagcauaaagcugcacaguagcaagaacucaacagcgcaugugcgauguaaaggagacgagaccgccuucagcguacuggaaggaguccacagcuacacaguaucacugagcuucgaccaugcaguagucgaugaacaaugccaacucaacugcggaggacacgaaucccaagugacccucaaagggaaucucauauuccucgacguacccaaauucguagacggcucauacaugcaaacauaccauagcacuguaccaaccggcgcgaacauacccucccccaccgauuggcucaacgcccuauucggcaacggccuaagucgcuggauacuugggguaaucggcguccuacuuggaggacuagccuuauucuucaugauaaugucacuauucaaacuaggaaccaagcagguucucagaagcagaaccaaacucgccuaa

SEQ ID NO: 16539 - RNA, 3222 nt, Artificial Sequence
  derived and/or modified CDS sequence (opt11) from SFTSV/FTLSV(2012YSH89)__KF711935.1__GP
augaugaagguaauaugguucucaucacuaauaugcuucgucauucagugcagcggugacucaggucccauaauaugcgcagggcccauacacucgaacaagagcgcagacaucccucaccuccuaggguacuccgagaaaaucugccaaauagacaggcucauucacgucagcucuuggcuacgcaaccauucgcaauuccaaggauacguaggccaacgaggcggcagaagucaaguauccuauuaccccgcagaaaacaguuacuccagguggucgggacuacucucaccuugcgacgcugacuggcuaggcaugcuaguagucaagaaagcaaaaggcucggacaugaucguccccggacccucauauaaaggaaaagucuucuucgaacgcccgacauucgacggcuacgucggaugggggugcggcagcggaaagucaagaaccgaaucgggagaacuguguagcuccgacuccggaacuucgagcggucuacuaccaagugaccgaguacucuggaucggcgacgucgcaugucaacccaugacacccaucccagaagaaacauuccuagaacucaagucauuuagccagagcgaguuccccgacaucuguaaaaucgacggaauaguguucaaccagugugaaggggaaagccuaccccagccauucgacguugccuggauggacgucggccacagccacaaaauaaucaugcgagaacacaagacaaaauggguccaagaaucaagcuccaaagacuucguaugcuauaaggaagggaccggcccaugcucagaguccgaggagaaaacaugcaaaacaagcgguuccugcagaggcgacaugcaauucuguaaaguagccggaugcgaacacggagaagaggcaucggaagccaaaugccgaugcucccugguacacaaaccaggagaggucguagucucauacgguggaaugcgcguccgaccgaaaugcuacggauucucaaggaugauggcaacacuggaagugaaccagcccgaacaacgcaucgggcagugcacgggaugccacuuagaaugcaucaacgggggagucagauugaucacccuaacaucagaacuaaaaagugcaaccgucugcgcaagccauuucuguagcagcgcaaccuccggcaagaagaguacagaaauccaauuccacaguggcucccuagugggcaaaaccgccauccacgucaaaggcgcgcucgucgacgggacagaguucacguucgaaggcucaugcauguucccagacggcugcgaugcaguggacuguacuuucugccgcgaauuucuaaagaacccgcaaugcuacccagcaaagaaauggcucuuuauaauaauaguuauccuccuaggguaugccgggcuaaugcuccucacaaacgugcucaaagccaucggcauauggggcuccugggucauagcccccguaaagcugauauucgcaaucauaaagaaacucaugagaacgguuucgugucugaugggaaaacucauggaccgcgggcgacaggucauacacgaagaaaucggcgaaaauagggaaggaaaccaagacgacguacguauugaaauggcacgcccacgacgcguacggcacuggauguacucgccggucauucuaaccauccuagccauaggccuagccgagagcugugacgagaugguccacgcagacucaaaacugguaagcugcaggcaagggagcggaaauaugaaggaaugcguuaccacgggacgcgcucugcucccagccguaaauccgggccaagaagcaugccugcacuucaccgcacccggcagcccagacucaaaaugccuaaaaauaaaaguaaaacgcauaaaucuuaaaugcaagaaaagcuccaguuacuucguaccagaugcgagaagccgcugcacuagcguacgcagaugcagaugggcaggagacugccaaagcggaugcccaccccacuucacauccaacagcuucucggacgacugggccgguaaaauggacagggcaggacucggcuucucaggaugcuccgacggaugcgguggcgcggcaugcggcugcuucaacgccgcacccagcugcaucuucuggcgcaaaugggucgaaaauccacacggcauuauauggaaaguaagccccugcgcggccuggguccccucggcuguaaucgaacuuacaaugcccucaggagaaguaagaacauuccaccccaugagcgguauacccacccaaguauucaaaggcguaucagucacauaucucggauccgacauggaaguguccggccuaacagaccugugcgaaauagaagaacuuaaaagcaagaaacuggccuuagcacccugcaaccaagcuggaaugggggucguggguaaaguaggcgagauccaguguucuucugaagaaucagcccgcacaaucaagaaagacgggugcauauggaacgcagaccucgucgggaucgaacuccgggucgacgacgcgguaugcuacucuaaaauaacauccguagaagccguagccaacuacucggccauaccaacaaccauaggcggucuccgauucgagagaucacacgauucacaagggaaaaucucuggcagcccccuugacaucaccgcgauaagaggcucguucagcguuaacuaccgggggcuccgacucucccucagcgaaauaaccgccacguguacgggcgaggugacaaacgucucaggaugcuacuccuguaugaccggugcaaaaguaagcauaaaacuacacagcagcaagaacucaacugcgcacguacgaugcaaaggugacgaggcggccuuuuccguacuagaaggaguccacucauauaccgucucacugucauucgaccacgccgugguggacgaacaaugucagcuaaacuguggcggccacgaaagucaaguaacacuaaaaggcaaccuaauauuccucgacgucccgaaauucgucgacggcagcuacaugcaaaccuaccacagcacaguuccaaccggcgcaaacauacccuccccaaccgacugguugaacgcacucuucggcaacggccucagccgcuggauacucggagucauaggcguccuccucggcggccuagcauuguuuuucaugaucaugagccuauucaaguuagggaccaaacaaguuuucaggagccggacaaaacuugcauaa

SEQ ID NO: 16540 - RNA, 3222 nt, Artificial Sequence
  derived and/or modified CDS sequence (opt11) from SFTSV/FTLSV(2012YSH9)__KF711919.1__GP
augaugaaaguaauuugguucucgucacuaauaugccucgucauacagugcagcggcgacagcggaccgauaaucugcgcaggccccauccacagcaacaaaagcgcaggcaucccacaccuccucggguacagcgagaaaaucugccagaucgaccggcugauacacgucucuagcuggcuacgaaaccacagccaauuucaaggauacguaggccaacgagguggccgcagccggguaaguuacuacccagccgaaaauaguuacagucgcuggagcggucugcugaguccgugcgaugccgacuggcucggcaugcucguagugaaaaaggccaaagaaucagacaugaucgugcccggccccagcuauaaaggcaaagucuucuucgaacgacccaccuucgacggcuacguaggguggggaugugguucgggcaaaucgcgaacagagucgggagaacuguguucuucugacaguggaacgagcuccggccuacuccccagugaccgaguacuauggauaggcgacguagcgugccaacccaugacccccaucccagaagaaaccuuccucgaacuaaaaucauucagccaaagcgaguucccagacaucugcaagaucgacggaaucguauucaaccaaugcgaaggcgaaagccuuccccaaccauuugacguagcauggauggacguaggccauucacacaaaauaaucaugcgagaacacaaaacaaaauggguccaagagucaucaagcaaagacuuuguuugcuacaaagaaggcaccggaccaugcagcgaguccgaagaaaaggccugcaaaaccucgggguccugcaggggcgacaugcaauucugcaaaguggcugggugcgagcacggcgaggaagcaagcgaggccaagugccguugcagccugguccacaaaccuggcgaagucgucgucucguacggaggaaugagaguucgcccgaaaugcuacggguucagccgaaugauggccacccucgaagucaaucgaccagagcaacgcauagggcaaugcacagggugccaccucgaguguauaaacggaggcguaaggcucauuacccucacgagcgaacuaagaucagcaaccguaugcgcaagccacuucugcuccuccgcaaccucagggaagaagaacacagagauacacuuccacuccgguucacugguuggcaaaacagcgauccacgucaaaggagcgcuagucgacgggaccgaauuuacauucgaaggcaguugcauguucccagacggcugcgacgcagucgauuguaccuucugccgcgaguuucugaaaaacccccaaugcuauccagcaaagaaauggcuauucauaaucauuguaauccuccucggauacgccggguuaaugcuccuuacaaacguccuaaaggccaucggaguauggggaagcugggucauagcaccgguaaaacuaauguucgccauaauuaagaaacucaugaggacaguauccugucugguaggaaaacugauggaccgaggccggcaagucauccacgaagagauuggcgagaacggggaaggcaaccaggacgacguccgcaucgaaauggcacgaccgcgacgaguacgccacuggauguacaguccggucauacucacgauacucgcaauagggcuggccgagggcugcgacgaaaugguccaugcagacagcaaacuggucucaugccgacaaggaagcggaaauaugaaagaaugcauuaccaccggcagagcccugcugccagcagucaacccaggacaagaggcaugccugcacuucacggcaccaggcagccccgacucaaaaugccuaaaaauaaaaguaaaaagaauaaaccucaaaugcaagaaaucaagcuccuacuucgugcccgacgccaggagccgcugcaccagcguccggagguguaggugggcaggagacugccaauccggcugucccccgcacuucacaaguaacagcuucucggacgacugggcgggaaaaauggaccgagccggccucggauucucgggcugcagugacggcugcggcggcgcggcaugcggaugcuucaacgccgcaccgucaugcaucuucuggagaaaaugggucgaaaacccucacggaauaaucuggaaaguauccccaugcgccgcaugggucccuuccgccguaauagagcuaacgaugccaucaggagaagugcgaaccuuccaccccaugucuggcauaccaacacaaguauucaaaggcgucagcgucaccuaccuggggagcgacauggagguaagcggacuaaccgaccuuugcgagauagaggaacuaaaaaguaagaaacucgcacuagcuccuugcaaccaagcaggcaugggaguaguagggaaaguuggagaaauacaaugcucaagugaagaaagcgcgcgcacaauuaagaaagauggaugcauauggaacgccgaucucgucggaauagaguugcgagucgacgacgcgguaugcuacuccaaaauuaccagcguagaagcaguagccaacuauagcgcgauacccacaacaaucggcggacugcgcuucgaaaggucacacgacucacagggaaaaaucagcggcucaccccuagacauaacagcaauccggggguccuucagcguaaacuacagaggacucaggcucagccugucagaaauaacagccacuugcaccggcgaagugacgaacgucagcggguguuacucgugcaugaccggcgcgaaaguaucaauaaaacuacacagcagcaaaaacucaacagcacacguacgcugcaaaggggacgaaacagcauucuccgucuuagaaggcguccauagcuacaucgucucacucucguuugaucacgccguggucgacgaacaaugccaacucaacugugggggacaugagucgcaagucacccucaaaggcaaccugaucuuccuggacguuccgaaauucguagauggaagcuacaugcaaaccuaccacucaacaguaccaacaggugcuaacaucccuuccccaacggacuggcucaacgcacuauucgguaauggacucucacgauggauacuuggggucaucggagucuuacucggcggccuggcccucuuuuuccugauaauguuccuucuaaaacuaggaacaaaacagguguuuagaagccgcaccaaacuggcguga

SEQ ID NO: 16541 - RNA, 3222 nt, Artificial Sequence
  derived and/or modified CDS sequence (opt11) from SFTSV/FTLSV(2012YSH91)__KF711920.1__GP
augaugaaaguaauaugguucagcucacucauuugccuugucauccaaugcuccggugacucaggaccaaucauuugugcaggccccauucacucgaacaaaagcgcaggcauaccgcaccuccuagguuacucggagaaaauaugccaaaucgacaggcugauccacguauccuccuggcugaggaaccacucccaauuucaaggcuacguaggccagcgaggcggacgcucacaagucagcuacuaccccgcagaaaauagcuauucgcgcuggaguggccuccucuccccaugcgacgcagacuggcuaggcaugcucguaguaaagaaagcgaaagaaucagacaugauaguaccaggacccagcuacaaaggcaaaguauucuucgaacgacccaccuucgacggauaugucggcuggggaugcggcagcggaaaaagucgaacggaaagcggagaacucuguagcuccgacagcgguaccaguagcggauuacugcccagcgaccgagucuuguggauaggcgacguagccugccaacccaugacuccgauccacgaagagaccuuucuagaacuaaagagcuucucgcaaagcgaguucccagauaucugcaaaauagauggcauaguauucaaccaaugcgaaggcgaauccuugccccagccauucgacguagccuggauggacguuggacacucccauaaaaucauaaugagggaacacaaaaccaaauggguccaagaauccucgucaaaagauuucgucugcuacaaagaaggcacgggccccugcuccgaaagcgaggaaaaagcgugcaaaacaagcgguagcugcagaggggacaugcaguucugcaagguugcaggcugcgagcacggagagaaggcgagcgaaaccaaaugcagauguagucucguccauaagccgggcgaaguugucgugagcuacggaggaaugagaguaagaccaaaaugcuacggaaucucacgaaugauggccacccuagagguaaacccgccagaacaacgaaucgggcaaugcacagggugccaccucgaguguaucaacggcgggguucgacucaucacacugacgucagaacugagguccgccacagucugcgccagucauuucugcuccagcgcaucaagcggcaaaaagucaacggaaauacacuuccacucaggaagucuaguaggcaaaacggccauccacgugaaaggcgcccucgucgacgggaccgaguucacguuugagggaagcugcauguucccagacggaugcgaugccgucgacuguaccuucugccgcgaguuccucaagaacccucaaugcuacccagccaagaaauggcuauucaucaucaucguaauucuccuaggauacgcgggccuaaugcuccuaacaaauguacugaaagcgaucggaguauggggauccuggguaaucgcacccgucaagcuaauguucgcaauaauaaagaaacucaugaggacaguaucaugccuagucggcaaacucauggaccgaggacggcaggucauacacgaagagauaggcgaaaacggcgaaggaaaccaagacgauguaaggaucgagauggcaagaccacguaggguacgccacuggauguacagcccagucauacuaacuauccuugccauaggccucgcagaaggcugcgacgagaugguacacgcagacuccaaacucguaucaugccggcaaggaucagggaacaugaaagaaugcauaaccacaggacgcgcccuccuacccgccguaaaccccggccaagaagcaugucuccacuuuacagcgccgggauccccagacucgaaaugccuaaagauaaaaguuaaacgaauaaacauuaaaugcaagaaaagcucuagcuacuucguacgagacgcccgcucacgcugcacgagcguacgacgaugccgaugggccggagauugccaaagcggcuguccaccccauuucacauccaacagcuucagcgacgacugggccggcaaaauggaccgcgcggggcuaggauuuaguggaugcagcgacgggugcggaggagcagccugcgggugcuucaacgcagcccccagcuguauauucuggagaaagugggucgagaacccccacggcaucaucuggaaagucucgcccugcgcagcauggguacccuccgcggucaucgaauugaccaugccaucaggcgaagugcgcacauuccacccgaugucaggaauaccgacacaagucuucaaaggcgucucaguaaccuaucuaggaucggacauggaggucucuggacucacugaccucugcgaaauagaggaacuaaaaagcaagaaacucgcccuagcaccuugcaaccaagcaggaaugggaguagucggaaaggucggagaaaaacaaugcagcagcgaagaauccgcaagaacaauuaagaaagacggcugcauauggaacgcagaccuggucggaauagaacuaagagucgacgacgcagugugcuacagcaaaauaacaagcguagaggcaguagccaauuacucggccauuccgacgaccauaggcggguugagauucgagcgaucacacgacagccagggaaagaucucgggcucgccccuggacauaaccgcaaucagagguucauucuccgucaacuacaggggucugcggcugagucuaagcgagaucacagcgaccuguaccggcgaagucacaaacgucagcggcuguuacucgugcaugacgggugcuaagguauccaucaaacuucacagcagcaaaaacagcacagcacacguaagauguaaaggagacgagacagcguucagcguguuagaggggguccacuccuacauagucagccuaucauuugaccacgcagucguggacgagcagugccaacuaaacugcggcggacacgaaagccaagugacccuaaaaggcaaccuaauauucuuggacguuccgaaauucguggauggcucauacaugcaaacguaccacagcacaguaccgaccggugccaacaucccaagcccaaccgacuggcugaacgcacuauuuggaaacggacuaagccgauggauacuaggagucaucgggguucuacuagggggccuagcgcuguuuuuccuaaucauguuccuccugaaacucggaacaaaacaagucuuuagaagcaggaccaagcucgcauaa

SEQ ID NO: 16542 - RNA, 3222 nt, Artificial Sequence
  derived and/or modified CDS sequence (opt11) from SFTSV/FTLSV(2012YSH92)__KF711941.1__GP
augaugaaggucauaugguucuccucacuaauuugcuucguuauacaaugcagcggugacagcggaccaaucauaugcgcgggaccaauccacuccaacaaaucagcggacauaccacaccuauugggguacucagaaaagauaugccagauagacagacucauacacguauccucguggcuacgcaaccauagccaauuccaaggauacguuggccaaagaggaggacggagucaagucagcuacuacccagcagaaaacucgcacagcagauggucaggacuccuaagcccaugugacgcagacuggcucggcaugcuggucgucaagaaagccaaaggcagcgacaugauaguaccaggccccucauacaaaggaaagguauucuucgagcgcccgaccuucgacgguuaugucggcuggggaugcggcuccggaaaaucccgcaccgaauccggcgaacugugcucaagugacuccgggacgagcuccgggcuacugcccagcaaucgaguacucuggauaggagacguggcgugccaacccaugaccccgauaccagaagagaccuuccuggaacucaagagcuuuagccaauccgaguucccggacauaugcaagaucgacggaauaguuuucaaccaaugcgaaggggagagcuuaccacagccauucgacgucgccuggauggaugucggccacucccacaaaauaaucaugcgagaacacaaaaccaaauggguccaggaaagcagcagcaaagacuucguguguuacaaggaaggaacaggcccguguucagaauccgaagaaaagacaugcaaaaccagugguucgugccgaggagacaugcaauucugcaagguagcaggcugcgaacacggggaagaagccucagaagccaaaugcagaugcagccugguacacaaacccggcgaaguaguagucagcuacggcggaaugcggguucguccaaaaugcuacggcuucucuaggaugauggcaaccuuggaaguaaaccaaccagagcagagaauaggacaaugcaccggaugccaucuagagugcaucaacggggguguuagacucaucacucucaccucagaacuaaaaagcgcaaccguaugcgcgucccacuuuugcuccuccgcgacaagcggcaagaaaaguacagaaauacaauuccacuccggcucgcuuguaggaaaaaccgccauccacgucaaaggcgcgcucguggacggcacagaauuuacauucgaaggcucaugcauguuuccggauggaugcgacgcagucgacugcacauuuugcagagaguuccucaaaaauccgcaaugcuacccagcgaagaaauggcuauucauaauaauagucauccugcucggcuaugcgggccuaaugcuccugacaaacguacuaaaagcaaucggcaucuggggaucguggguaaucgcaccgguaaaacucauauucgcgauaaucaagaaacucaugagaacagugagcugccuaaugggcaaacucauggaccgcggaagacaagucauacacgaagaaauaggcgaaaauagagaagggaaccaggacgacgucagaauagagauggcaagaccccgaagagucagacacuggauguacucaccggucauauuaacaaucuuagccaucggccuagcggaaaguugcgacgaaaugguacacgccgauuccaagcuagucagcugcaggcaaggcagcgguaacaugaaagagugcgucacuacggggcgggccuuacuccccgccgugaauccaggacaagaagcgugccuacacuucacagcacccggcaguccagacaguaaaugccugcgcauaaaagucaaacgcaucaaccuaaagugcaagaaaagcucaagcuauuucgugccagacgccagaucccgaugcacaagcgugcgaagaugcagaugggcaggcgacugccagucugggugcccaccccacuucacaagcaacuccuucucagacgacugggccgggaaaauggaccgggcaggacucgguuucagcggcugcuccgauggcugcggcggagcagcgugcgggugcuucaacgcugcaccaagcugcauauucuggcgaaaauggguagaaaacccucacgggauaaucuggaaagucagccccugugcagcuuggguccccagugccguaauagagcuaacgaugccauccggggaaguccgaacauuccacccaauguccgggauccccacacaggucuucaaaggaguaagcgucaccuaccucggcagcgacauggaagucuccggacuuacagaucuaugcgaaauagaagaacuaaaauccaaaaagcucgcccucgcgccaugcaaucaggccgggaugggggucguggggaagguuggcgaaauacaaugcagcagcgaagaaagcgcccgaacgauaaagaaagacggaugcauauggaacgccgaccucgucggcaucgagcuaagaguagacgacgcggucugcuacucgaaaaucacaagcguggaagccgucgccaauuacucggcaaucccaacgaccauaggcggccucagauucgaacgaucacacgacucacagggaaaaaucuccggcucccccuuagauaucacagccauaaggggcuccuucucaguaaacuacagaggacugcgacucucccuaagcgaaauaaccgccacaugcaccggagaagucacaaacgucucaggaugcuacucuugcaugacaggugccaagguaagcauaaaacugcacagcuccaaaaacucgaccgcacacguaagauguaaaggcgacgaaacagccuucucaguccucgagggcguccauagcuacaccguaagccugagcuuugaccacgccguagucgacgaacaaugccaacucaauugcggaggccacgaaucccaagucacccugaagggcaaccuaaucuuuuuagauguacccaaauucgucgacggguccuacaugcaaacauaccacagcacggugcccacgggagcaaacaucccaaguccaaccgacuggcuuaacgcccucuucggcaacggacuuucccgcuggguucugggagucaugggugugcucuuaggugggcucgcacucuucuucaugaucaugagccuguuuaaacucggaaccaagcaaguauucagaagcagaacaaagcucgcguaa

SEQ ID NO: 16543 - RNA, 3222 nt, Artificial Sequence
  derived and/or modified CDS sequence (opt11) from SFTSV/FTLSV(2012YSH93)__KF711946.1__GP
augaugaaagugaucugguucucaucacucauaugcuucgucauccaauguucgggagacucuggaccuaucauaugcgcgggaccuauucacuccaacaaaucagccgacaucccacacuugcucgguuacuccgaaaaaauaugccaaauagauaggcuaauacacguaagcucguggcuaagaaaccacagccaguuccaggguuacguuggccaacgcgggggacgaagucagguaucauacuauccagcagaaaacuccuacagccgauggaguggccuauuaucacccugugacgccgacuggcuugguaugcugguggucaaaaaggccaagggcagugacaugauaguaccaggcccaagcuacaagggaaaggucuucuucgagcgcccaacauucgacggguauguaggcuggggaugcggaagcggcaaaagccgaaccgaaagcggcgagcuaugcuccagugacagcgggaccagcucaggauugcuaccaucaaacaggguccuauggauuggugacguggcaugccaaccaaugacgccaauccccgaggaaaccuuucucgaacuaaaauccuucucccaaucagaguuccccgacauaugcaagaucgacggcauaguauucaaccaaugcgaaggcgagucccugccucagccauucgaugucgccuggauggacguaggacacucacacaagaucauaaugagagaacacaaaacaaaauggguacaagaguccagcucuaaagacuuugucugcuacaaggaaggaaccggaccaugcuccgagagcgaagaaaaaacaugcaaaacgucaggaucgugcagaggagacaugcaauucugcaaaguagcaggaugcgaacacggcgaagaagcaucggaagcaaaaugcagguguucacuaguacacaaaccuggagagguaguaguaucauacgggggcaugcgcguacgcccgaaaugcuacggcuucucccgcaugauggccacgcuagaagucaaccagcccgaacaaagaaucggacaaugcaccggaugccaucucgaaugcaucaacggcggcgugcgcuugaucacccucaccagcgaacuuaaaagcgcgaccguaugcgcaagucauuucugcaguuccgcgacaucagggaaaaaaagcacagaaauacaauuccacucaggcucgcucgucggaaagacggcaauacacguuaaaggagcccucgucgacgggacagaauucacauucgagggcagcugcauguucccagacggaugcgacgcugucgacugcacguucugcagggaauuuuuaaaaaacccgcaaugcuacccggcaaagaaauggcuauucauaauaaucguaauccuacuaggcuacgcaggccucaugcuacuaacuaacgugcuuaaggcaaucggcaucuggggaagcuggguaauagccccagucaagcuaaucuucgcaauaauuaaaaaacuaacacgcacagucucaugcuugaugggcaaacuaauggaucgcggacgccaagucauccacgaggaaaucggagagaaccgggaagggaaccaggacgacguccgaauagagauggcacgcccaagacgagucaggcacuggauguacagccccguaauucuuacaauccuagccauaggucucgccgaauccugcgaugaaauggugcacgcagacuccaagcuaguguccugccggcaaggaagcgggaauaugaaagagugcgugacaacggggagggcacuacugccagcuguuaauccaggccaggaagcgugcuuacacuucaccgcacccggaagucccgacucaaaaugccucaaaaucaaagucaagcgaaucaaccugaaaugcaaaaaaucgucgagcuacuucgucccagacgcaagguacagaugcacaagcguccgaagaugccgcugggcaggcgacugccaaagcgggugcccaccccauuucacaagcaauaguuucagcgacgacugggcuggaaagauggaccgcgccggccugggauucucuggcugcagcgacggcugcggaggcgcagcgugcgguugcuucaacgcagcgccaagcugcauauuuuggagaaaaugggucgaaaacccacacgggaucauauggaaagucaguccaugcgcagcauggguaccuuccgcgguaauagagcucaccaugccauccggcgaagugcgcacauuucacccaauguccggaauccccacacaagucuucaaaggaguaucaguaacauaccuaggaucggacauggagguaucggggcuuaccgaccucugcgagaucgaggaauuaaaguccaaaaaacuagcccuagcacccugcaaccaggcgggcaugggagucgugggaaaaguaggggaaauacagugcagcucagaagaauccgcacgcacaauaaaaaaagacggcugcaucuggaacgcggaccuuguagggauugaacucaggguagacgaugcaguaugcuacucaaaaauaaccagcgucgaggcaguggcaaacuacuccgccauacccacuaccaucggcggauuacgauuugagcggagccacgacucccaggggaagaucagcggaucgccacuggacauaaccgcgaucaggggaucauucuccgucaacuaccgaggacuucgccugucccucagcgaaauaacagccacuuguaccggcgaggugacaaacgucagcggcugcuacucaugcaugacaggagccaaagucagcaucaaacuccacucaagcaaaaacucaacagcgcacguccgcugcaaaggggacgagaccgcguucuccguccuggaagguguccacagcuauacggucagccucuccuucgaccacgcuguuguggacgaacaaugccagcuaaacugcggcggacacgagagccaggugacacugaagggaaaucuaaucuuucucgacguacccaaguucguagacggcagcuacaugcaaacauaccacagcacaguacccaccggggccaacauaccauccccaaccgacuggcucaacgcacuuuucgggaacggccuaucacgcuggguccucgggguaauggggguacuucugggagggcucgcacuauucuucaugaucaugagccucuucaaacucggaacaaagcaagucuuccggucacgaaccaagcucgcauaa

SEQ ID NO: 16544 - RNA, 3222 nt, Artificial Sequence
  derived and/or modified CDS sequence (opt11) from SFTSV/FTLSV(YGS1)__KF356537.1__GP
augaugaaaguaauaugguucagcucgcuuguuugcuuagucauacaaugcaguggggacucaggaccaaucauaugugcaggcccaauccacagcaauaaauccgcagcuauaccucaccuacucggauacucagaaaagaucugccaaauagauaggcuaauacacguguccucguggcuacgcaaccacagucaauuccaaggguacguaggacaacgcggaggccgaagccaagucucguacuacccagcagaaaacagcuacagcagauggucaggccuguuaucacccugugacgcagacuggcucggcaugcucgucgucaagaaagccaaaggcucggacaugaucguccccgggcccucguacaagggcaaaguauucuucgaacgccccacuuucgacgguuacgucggguggggaugcggaagcggaaaaucacggacagaauccggugaacugugcuccagcgacagcggaacguccagcggacuccugcccuccgauagggugcuauggauaggagacgucgcgugccagccaaugacccccauccccgaagaaacauuccucgagcucaaaucauucagccaaagcgaguucccagacaucugcaaaauagacggaauaguguucaaccaaugcgaaggggagagccuaccccaaccauucgacgucgccuggauggacgucggccauagccacaagauaauaaugagagaacacaaaacgaaauggguacaggaaaguuccuccaaggacuuuguauguuacaaggagggaacaggcccaugcuccgagucggaagagaaggcuugcaaaacaagcggcucaugccggggagauaugcaguucugcaaagucgcaggaugugagcacggagaggaagccucggaggcaaaaugccgcugcucccucguccacaaaccuggcgaggucgucgucagcuacggaggaaugcgcguuagaccgaaaugcuacggauucuccagaaugauggccaccauggaaguaaacccacccgagcaaagaaucgggcaaugcaccggaugccaucucgaaugcauaaacggaggcgugcgccuaaucacccucacaagcgaacucaaaagcgcgacagucugcgcaucacacuuuugcagcucagcaacaagcgggaaaaagucuacggaaauccacuuccacuccgguucccuagucggaaaaaccgcgauacacguaaaaggcgcacucguagacggaaccgaguucacauucgaaggcagcugcauguucccagacggcugcaacgcagucgauugcaccuuuugcagagaguuccucaaaaacccgcaaugcuauccagccaagaaauggcuauucauuauuaucgugauacuacucggauacgccggccuaaugcuccucaccaacguccuaaaagcaauaggagucuggggcagcuggguaauagccccgguaaaacugauguucgccauaaugaaaaagcuaaugagaacagucagcugccuaguaggaaaacuaauggauagagggcgccaggucauacaugaagaaauaggggaaaacggugaaggaaaucacgaugacgugcgcauagaaauggcacguccccgcaggguccgucacuggauguacucccccguaauccuuacaauacuagccauaggacuagcagaggggugcgacgaaaugguacacgccgacucaaaacuggucagcuguagacaaggaagcgggaacaugaaagagugcgucaccaccggccgagcccugcucccauccguaaaccccgggcaagaagcaugccuacauuucacagcgccgggaagcccagacagcaaaugccuaaaaaucaaagugaaacgcaucaaccucaaauguaagaagaguagcagcuacuucgucccagaugccagaagccggugcacgagcgugcgaagaugccgcugggcgggggacugccaguccggcugcccgccccacuucacgagcaacagcuucagcgacgacugggccggaaagauggaccgagcagggcucggauucucgggcuguagcgauggcugcggaggagccgcaugcgggugcuucaacgccgccccaucaugcauauucuggcgcaagugggucgagaacucacacggaaucauauggaaaguguccccgugugccgcgugggugccgucggccgugaucgagcucacaaugccgagcggcgagguacgcacguuccaccccaugagcggcauucccacgcaagucuucaaaggggucucagucaccuacuuagggucagacauggaaguaagugggcucacagaccuaugcgaaaucgaggaacugaaaagcaaaaagcuagcacucgcccccuguaaucaggcaggcaugggagucguagguaaaguaggugaaauucaaugcuccuccgaagagagcgcacgcacaauaaagaaagacggguguauauggaacgcagaccuggucgguauugaacuccgcguagacgacgcggucuguuacucgaaaauaacaagcguagaagccguagccaauuacucugcuaucccuaccacaaucggcggacucagguucgagcgcagucacgacagccagggcaaaaucucgggaucgccacuggauaucaccgcaauccggggcucuuucuccgucaacuacagaggauugcgacugagccuaagcgagauuacggccacaugcaccggagagguaacgaacguaagcgggugcuacagcugcaugacaggugcaaaagucagcaucaaauuacacagcucgaaaaacuccaccgcccacgugagaugcaaaggagacgagaccgcauucucaguccuugaaggaguucacagcuacacagugagccucagcuuugaccacgcugugguggaugaacaaugccaacucaacugcggaggacacgaaucccaaguaacgcuaaaaggaaaccuaauauuccucgacgucccgaaauucgucgauggaagcuacaugcaaacguaccacuccaccguaccaacaggggcaaauaucccaagcccaacggacuggcugaaugcacuguuuggcaacggacuaucgagauggauccuaggggucauaggcgugcugcuaggaggucuagcauuauucuuccucaucauguuccucuuuaaacuaggaacgaagcaagucuucagaucacgaaccaaacuggcguaa

SEQ ID NO: 16545 - RNA, 3222 nt, Artificial Sequence
  derived and/or modified CDS sequence (opt11) from SFTSV/FTLSV(YNY1)__KF356538.1__GP
augaugaaagugauaugguucagcagccuuauaugcuucguaauacaaugcagcggcgacagcggcccaaucaucugugcgggccccauccauagcaacaaaucggcagacaucccgcaccuguuaggcuacucagagaaaaucugccaaauagaccgccucauucaugucuccaguuggcuccgaaaucacucgcaauuccaaggguacgucgggcagcgagguggacgaucucagguaucguacuaucccgcggaaaacuccuacagcagauggagcggccuacugucacccugcgacgcggacuggcuaggaaugcuggucgucaaaaaggccaaaggcucggacaugaucguacccgggccaagcuacaaaggaaaaguauucuucgaacgaccgaccuucgacggauacgucggcuggggcugcggcucaggcaaaagcaggacagaaucgggcgaacucugcucaagcgacagcggcacuuccaguggacuacuacccucggacagaguccuauggauaggggauguagcaugccaaccaaugacuccgauacccgaagaaaccuucuuggaacucaagagcuucagccaaagcgaguucccggacaucuguaaaaucgacggcauagucuucaaccagugcgaaggugaaagccucccccaaccuuucgacguggccuggauggacgugggccacucgcacaaaaucaucaugcgagaacacaagacaaaaugggugcaggaaagcagcucgaaggacuucgugugcuacaaggaagguacgggacccugcucagaaagcgaagagaaaacaugcaaaaccucgggcagcugccggggcgacaugcaauuuuguaaaguggcaggcugcgagcauggagaagaggcaucggaagcaaagugccggugcagccucgugcacaaaccaggcgaggugguggucucauacggcgggaugcgaguacgcccaaaaugcuacgguuucucacgcaugauggcgacccuagaagugaaccagcccgagcagagaaucggccaaugcacagggugccaccuggaguguaucaacggaggaguccgccuaauaacacuaacaagcgagcucaaauccgcgaccguaugcgcaagccacuucuguagcagcgccacaagugggaagaaaagcaccgaaauacaauuccauucgggaagccuaguagggaaaaccgcgauacacguaaaaggcgcgcucgucgaugggacugaguucacguuugagggaucaugcauguucccagacggaugcgacgcagucgacugcaccuuuugccgagaauuucucaaaaacccgcaaugcuacccugccaaaaaguggcuauucauaauaauaguaauacuguucggcuacgcaggacuaauguuacuaacaaauguccugaaagccauaggcauauggggaagcugggucauagccccggucaaacucaucuucgccauaaucaaaaagcuaaugcggaccgucagcugccuaaugggaaaacuaauggaccgagggcgccaggucauacacgaagagauaggcgagaacagggaaggaaaccaggacgacguacgaauagagauggcaaggccccgcagagucagacacuggauguacaguccagucauacugacgaucuuagcaauuggacuagcagaaagcugcgacgaaaugguccaugcagacagcaaacuggugagcugccggcaaggaucagggaacaugaaagaaugcgucaccacagggagagcccuacuccccgcagugaacccagggcaagaagcgugccuacauuucaccgcgcccgggagccccgacucgaaaugucucaaaaucaaggucaaacgaauuaaccucaaaugcaaaaagucaucaagcuauuuuguacccgacgcacggagccggugcacaaguguucgaagguguaggugggcgggcgacugccagagcggcugcccgccacacuucacaagcaacagcuucucagaugacugggccggcaaaauggaccgggccgggcugggguuuaguggcugcagcgauggcugcggaggggcagcaugcggaugcuucaacgccgccccgagcugcaucuuuuggagaaaaugggucgaaaacccucaugggaucauauggaagguaagcccaugcgcugcgugggugcccucagccgugaucgaacucacgaugccgagcggcgaagugagaacauuccaccccaugucagguauccccacacaaguguucaaaggggucagcgucacauaccuuggauccgacauggagguaagcggguuaaccgaccugugcgaaaucgaggaacuaaaaucaaagaaacuagcacucgcccccuguaaccaagcgggcaugggcgucguaggcaaagucggggaaauucaaugcucauccgaagaauccgcccgaacgaucaagaaggacggaugcauauggaaugccgaccuaguaggaauagaauuaagggucgacgacgcggucuguuacagcaaaauaaccucaguagaggcgguagccaacuacagcgccauccccaccaccaucggaggccugagguucgaacgcucacacgacagccaagguaaaauaucagggucgccccucgacaucacugcaauacguggcagcuuuagcgugaacuacagaggacuaaggcuaagccugucagagaucaccgcaaccugcacaggagaagugacaaacgugagcgguugcuacaguugcaugacgggcgccaaaguaagcauaaaauugcacagcagcaaaaauucaacagcccauguacgcugcaaaggggacgagacagccuucagcgucuuggaaggaguacacagcuacacugucagccucagcuucgaccacgccguggucgacgaacaaugucaacucaauugcgggggccacgaaucgcaaguaacacuaaaaggaaaccuaaucuuccuagacgucccgaaauucguggauggcucguacaugcaaacguaccacagcacgguaccgacgggagcuaacaucccguccccaaccgacugguuaaacgcacucuuuggcaacggacuaagccgcuggauacuagggguaaugggcgugcuccuaggcggacucgcccucuuuuucaugauaaugucccuguucaaacucggaaccaaacaaguauucaggagucgaaccaaacucgcauaa

SEQ ID NO: 16546 - RNA, 3222 nt, Artificial Sequence
  derived and/or modified CDS sequence (opt11) from SFTSV/FTLSV(YPQ133)__KF356530.1__GP
augaugaaaguaaucugguucuccucacugauaugcuucguaauacagugcagcggcgacuccagccccaucaucugcgcggggccaauccacagcaacaagucugccgacauaccccaccuauuaggguacagcgaaaagaucugccaaauagaccgacucauucacguaucauccuggcuacguaaucacucgcaauuccaaggcuacguaggccaaagagggggacgcagccaagucuccuacuauccggccgaaaacagcuacagccgaugguccggacuccucuccccuugugacgccgacugguuaggcaugcugguggucaaaaaggccaaaggcuccgacaugauaguaccaggaccaagcuacaaaggaaaaguauucuucgaaagacccaccuucgacggauacguaggcuggggcugcggaaguggaaaaagccgaacagaaucaggggaacugugcagcagcgacucaggaaccuccagcggccucuuacccagcgaccgaguccuauggauaggagacgucgccugucaacccaugaccccaauaccggaagagacauuucucgagcuaaaaucauucagccaaagcgaguuccccgacauaugcaaaaucgauggcaucguauucaaccaaugcgaaggagaaagccuuccccagcccuucgacgucgccuggauggacguuggacauagccaaaagauaauaaugcgagaacacaagacgaaguggguccaagaauccagcucaaaggacuuugucugcuacaaagaaggcaccggaccaugcucggaaagugaggagaaaaccugcaaaacaucgggaucaugcagaggagacaugcaguucugcaaaguggccggcugcgagcacggggaggaagccagcgaagcaaaaugcagaugcagccucguacacaagcccggugaagucgugguuagcuacggaggaaugcgcguccggccaaaguguuacggcuucucacgcaugauggccacccucgaggucaaucaaccagaacaaagaauaggccaaugcaccggaugccaccucgaaugcaucaacggaggggugagacucauaacccugacuagcgaacucaaauccgcaaccgucugcgcaagccacuucugcagcucagcaacauccgggaaaaagagcacggaaauucaauuccacagcggaagccuaguaggaaagacagccauccacgucaagggagcccuagucgacggaacggaauuuacauucgaaggcucgugcauguucccagacggcugcgacgcggucgauugcacauuuugcagagaguuccucaaaaacccacaaugcuacccggcaaagaaguggcuuuucauaauaauagugauccuacucggauacgccggcuuaaugcuacucaccaacguccucaaagccaucgggauauggggaagcuggguaaucgcaccagugaaacucauauucgcaauaauaaagaaacugaugagaaccguuagcugucuaaugggcaaacucauggaccgcggaaggcaagucauacacgaagagaucggcgaaaaccgagagggcaaccaggacgacgugcggauagaaauggcacgaccucggagaguucgacauuggauguacaguccgguaauacucacaauucuggccauaggccucgcagaaagcugcgacgaaaugguccacgcugauucaaagcuagugucaugcagacagggcaguggaaacaugaaagaauguguuaccacaggccgagcauugcuaccagcuguaaacccgggccaagaagcgugcuugcacuucacagcacccggcucaccggacagcaaaugccuaaaaauaaaggucaaacgaaucaaccucaaaugcaagaaaaguagcaguuacuucguacccgacgccaggagccggugcacguccguaagaagauguaggugggcaggggacugccaaucaggaugcccaccccacuuuaccagcaacaguuuuuccgacgacugggccggaaaaauggaccgcgccggccucggauucuccggcugcucggacggcugcggcggcgcggcaugcgggugcuucaacgcggcccccagcugcauauucuggagaaaaugggucgagaacccacacgggguaauauggaaagucagccccugcgcagcauggguacccucagccguaauagagcucaccaugcccagcggugaaguccgcacauuucacccgaugagcggaaucccgacacaaguguuuaaagggguuaguguaaccuaccuaggcuccgauauggaaguauccggccuuacagaucuaugugagauagaggaacugaaauccaaaaagcucgcgcucgcacccugcaaccaggcaggaaugggggucguagggaaggugggagaaauacaauguucaucggaagaaucggcccgaaccauaaagaaagacggcugcaucuggaacgcagaccuagucggaaucgagcuaagaguagacgacgccgucuguuacuccaaaauaaccucaguagaagcaguggccaacuacucagcaaucccaaccacaaucggcggacuacgauucgaacgcagccacgacucucagggaaaaaucucaggaagcccccuagacauaaccgccauaaggggcuccuuuucaguaaacuacagaggccuccgacuuucccuuagugaaauaacagcaaccugcacgggcgaaguaaccaacguuucaggguguuauucaugcaugaccggcgccaaagucagcaucaagcugcacuccagcaaaaacuccacagcgcacgugagguguaaaggcgaugaaaccgcauucuccguccucgaagguguccauuccuacacaguuagccucuccuucgaccacgccguugucgacgaacagugccaacucaauuguggaggccacgaaucgcaggucacccucaaaggcaaccugaucuuccuagacguuccaaaauucgucgacggaucauacaugcagacauaccacuccaccguacccaccggggcaaacaucccaagcccaaccgacuggcucaaugcccuuuucggcaacggacuuagccguuggauacucggcgucaugggcgugcugcuaggaggacuagcacucuucuucaugauaaugucccuauucaagcugggaaccaaacaagucuucagguccagaacuaaacuggcguaa

SEQ ID NO: 16547 - RNA, 3222 nt, Artificial Sequence
  derived and/or modified CDS sequence (opt11) from SFTSV/FTLSV(YPQ2)__KF356531.1__GP
augaugaaagucaucugguucagcagucuaauaugcuuugugauacaaugcucaggagauagcggcccaaucauaugcgcgggacccauccacaguaacaaaucagcggauauaccccaucuccucggauacucagagaaaaucugccaaauagacaggcuuauacacgugagcagcugguugcggaaucacagccaauuccaaggauacguaggacaacgcgggggcaggucccagguaucauacuaccccgcagaaaacagcuacagccgauggagcggacugcuaucgccaugcgacgcugacuggcugggaaugcuugucguuaaaaaggcaaaaggcucagacaugauaguaccaggaccaucauacaagggaaagguauucuucgaacggccgacauucgacggcuacgugggauggggcugcggcagcggcaaguccagaacagaaagcggcgaauugugcucaagcgacagcggcaccucgagcggccuucuccccucagaucgcguacuguggaucggcgacguagcuugccaacccaugaccccuaucccagaggaaaccuuucuggagcucaagagcuucagccaaagcgaguucccggacauaugcaaaaucgauggaauagucuucaaucaaugcgaaggagaaagccuuccccaacccuucgacguagcguggauggacgugggacacagccacaagauuaucaugagagagcacaaaacgaaauggguccaggaaucaagcaguaaggacuucgucuguuacaaagagggcacaggacccugcucagagucggaggagaaaacaugcaagaccucgggcucaugccggggcgacaugcaauucugcaagguggcaggaugugaacacggagaagaagcauccgaagcgaagugucgcugcucccuggugcauaaaccgggagaagucguggucagcuauggcggcaugagagugcgcccaaaaugcuacggauucagccgaaugauggccacccucgaagucaaccaaccagaacaacggaucggacaaugcacagggugccaccuagagugcauaaacgguggagugcgccuaauaacacugacuuccgagcucaaaucagcaaccguaugcgcaucacacuuuuguagcucagcuacaagcgggaagaaaagcacagaaauacaauuccacucggggagccucguuggcaaaauagcaauacacguaaaaggagcgcucgucgacgggaccgaguucaccuucgagggaucuugcauguuucccgacggcugcgacgcaguggacugcacguucugcagagaguuccucaaaaacccccaaugcuauccggcaaagaaauggcuauucaucauaaucgucauccuccucggcuacgcgggccugaugcuccucaccaacgugcuaaaggcgaucgggaucugggggagcugggucauugcacccguaaaacugaucuuugcaauaaucaaaaagcucaugcgaacugucagcugcuuaauggggaaacuaauggaccgaggccgccaggucauacacgaagaaauaggagaaaaccgagaaggaaaccaagacgacgucaggauagagauggcucgcccgcgacgaguacgccacuggauguacucaccagugauacuaacaauacuagccaucggacucgcagaguccugcgacgaaaugguccaugcagacucaaaauuggucuccugccgacaggggucgggcaacaugaaagaaugcguaaccacgggacgagcccugcugccugcaguaaacccaggacaagaggcaugccuccacuuuacggcuccgggcagcccagacuccaaaugccucaagaucaagguaaaacggauaaaccucaaaugcaaaaagagcagcagcuacuucgugccaauggcaagauucagaugcacgagcgucaggcggugccgaugggcgggcgacugccagagcggaugcccaccacacuucacguccaacagcuucucagacgacugggcagggaaaauggacagagcaggccucggguucucgggaugcagugaugguugcggcggggcggcaugcgggugcuucaacgcagcgccaaguugcaucuucuggagaaaaugggucgagaacccacacggaaucauauggaaggucagcccuugcgcagcgugggucccaucggcaguaauugaacuuacgaugcccagcggggaaguaagaacauuccacccuaugagcgggaucccaacacaagucuucaaaggggucagcgucacauaccucggcucagacauggaaguaagcggacucacggaccugugcgagauagaagaauugaaaucaaagaaacuugcacuagcaccaugcaaccaagccggaaugggggucguggggaaagucggcgaaauccaaugcagcucggaggaaagcgccaggaccauuaagaaagacggcugcaucuggaacgcagaccuaguaggcaucgaacuuagggucgacgacgcgguaugcuacaguaaaaucacgucgguagaagccguggcuaacuacucagccauucccacaaccaucggcgggcuacgauuugagcgcucgcacgacucgcagguuaaaauaucaggaucaccccuggacauaacugcaaugaggggcucauucagcguaaacuauagaggccucagacuaagccucucagaaauaacagcgacaugcaccggcgaggucacaaacguaagcggcugcuacaguuguaugaccggagcaaaagugagcaucaaacugcacucaagcaaaaauagcacggcucauguaagaugcaagggagacgagaccgcguucagcguacucgaagggguccauagcuauacggugagccugaguuucgaccacgcaguaguagacgaacaaugccagcuaaacugcggcggccacgaaagucaagugacacugaaaggaaaccucaucuuucuagauguucccaaauucguagacgguucguacaugcaaacguaccacagcacgguaccgaccggugccaauaucccuaguccaaccgauuggcucaacgcacuauuuggaaacggauuaucaagguggauccucggcgugaugggaguccuccucggcggccuagcgcucuuuuucaugauaaugagccuguucaagcucggcacuaagcaagucuuccgaagcagaaccaagcucgcguga

SEQ ID NO: 16548 - RNA, 3222 nt, Artificial Sequence
  derived and/or modified CDS sequence (opt11) from SFTSV/FTLSV(YPQ5)__KF356532.1__GP
augaugaaaguuauuugguucucaagccucauaugcuucguaauucaauguagcggugacagcggaccaauaaucugcgccggccccauccauagcaauaagagcgcagacauaccgcaccuacuaggcuacucagagaaaauaugccaaaucgacaggcucauacacguaagcagcuggcuccgcaaccacucgcaauuccaaggauacgugggccagcgcggagggcgcucacgagucucauacuaccccgccgaaaacagcuacagcagauggucgggacuccucagcccgugcgacgcagacuggcucggcaugcucguagugaaaaaggccaagggaagugauaugauaguacccggcccaucauacaaaggaaaggucuucuucgaacggccaaccuucgacggauacgucggcuggggcugcggcagcggcaagagccgaacggaaagcggugaacucugcucauccgacagcggaaccagcagcggacuccuaccgucagaccgggugcucuggauaggagacguagcgugccaacccaugacgccaauaccagaagaaacguuucucgaacucaagagcuuuagccagucagaguucccugacaucuguaaaauagacggcaucguauucaaccagugcgaaggcgaaucacugccccagcccuuugauguagccuggauggacguagggcacucccacaaaaucaucaugagagaacacaaaacaaaauggguccaagagucauccucaaaagacuucgucugcuacaaagagggcaccggccccugcagcgaaagcgaagagaaaacaugcaaaaccucaggcuccugcagaggcgacaugcaauucuguaaaguugcaggaugcgaacacggggaagaggcaucggaagcgaaaugccgcugcagccuagugcacaaaccaggggaggucguagucucguacggcgggaugcgcguacgaccaaaaugcuacggguucucccgcaugauggcaacgcucgaaguaaaccaaccugaacagagaaucggacaaugcaccggaugucaccucgaaugcauaaacggaggaguacggcuaaucacacucacgagugaacucaagagcgcuacagugugcgccagucauuucugcagcagcgccacaucaggcaagaaaagcaccgaaauccaauuccacagcggcucccuaguaggaaaaaccgcaauacacgugaaaggcgcccuuguggacggaacagaguucacauucgaaggcucaugcauguuccccgaugggugcgacgcagucgauugcacauuuugccgagaguuccucaaaaacccccaaugcuaccccgccaaaaaguggcuguucaucaucauaguaauacuccugggcuacgcagggcuuaugcuguuaacaaauguacuaaaagcaauaggcauauggggauccuggguaauugcaccagucaaacucaucuucgccauaaucaaaaagcuaaugcgcacggucuccugccuaaugggaaaacugauggacagagggcgacaaguaauacacgaagaaaucggggaaaaucgcgaaggcaaccaagacgacguccgcauagaaauggcgcgcccgcgucgggugagacacuggauguauucaccggugauccuaacaauacucgcaaucgggcuagccgagaguugcgacgaaaugguccacgcagauuccaagcuagucucauguagacaagguaguggaaacaugaaagagugcgucaccacagggagagcacuacuaccagcagucaaccccggccaggaagccugucuacacuucacggcaccagggagcccagacucgaaaugccugaaaauaaaaguuaagcgcaucaaccuaaagugcaaaaaguccagcagcuacuucguacccguagcccgauaccgcugcacgagcguuaggcgaugcagaugggcgggagacugccagucaggaugcccaccccacuucacaagcaacagcuucucgaacgauugggcaggcaaaauggaccgggccgggcuaggauucagcggaugcagcgacgggugcggcggugcggcuugcggaugcuuuaacgccgccccaaguuguaucuuuuggagaaagugggucgaaaacccccacggcauaauauggaagguaagccccugugcagccugggucccgucagcagugauugagcugaccaugccauccggcgaaguacgcacauuccaccccauguccgggaucccaacacaggucuucaagggcgucagcguaacauaccucggcuccuacauggagguaagcggccugacagaccucugcgaaauagaggagcuacggagcaagaaacucgcgcucgcgcccugcaaccaggcgggaaugggagucguaggaaaaguaggugaaauccaaugcagcagcgaggaaagcgcccgcacgauuaagaaagacgggugcauauggaacgcugaccuagucggaauagagcuccgcgucgacgacgcggucugcuacucaaaaaucaccucaguagaggcagucgcuaacuauagcgcgauccccacaacaauaggcggacugagauucgaacgaucccacgauagccaggggaaaaucuccgguagcccccucgacaucacugcgauucgcggaucguucucagugaacuacagaggccugcgacucagccuaucagaaauaacagcaacgugcacuggcgaagucaccaacguaagcgggugcuacagcugcaugaccggagccaaagucuccauuaaacuacacucaucaaagaacagcaccgcacacguccgaugcaagggcgacgagacagcguucagcguauuggaagguguccacucauacacggugucacucucauuugaccacgcuguaguagacgaacagugccaacugaauugcggcggacaugagucucagguaacccugaagggcaacuuaaucuuccuagacgucccgaaauucguugacggaucauauaugcaaacauaccacagcaccguacccacaggggcaaacaucccgagucccaccgacuggcucaacgcccuauucggcaacggccugagcagauggauacucggggucaugggaguucuccugggcggacucgcccucuucuucaugauaaugucucuauucaagcuaggcaccaaacaaguguuccgaaguagaacgaaacucgccuga

SEQ ID NO: 16549 - RNA, 3222 nt, Artificial Sequence
  derived and/or modified CDS sequence (opt11) from SFTSV/FTLSV(YSC19)__KF356536.1__GP
augaugaagguaaucugguuuagcuccuuagucugccugguuauacaaugcagcggggacucgggacccaucaucugcgcaggaccaauccacagcaauaaauccgccgccaucccucacuuacugggguacagcgaaaagauaugucaaauagacaggcuaauacacguauccuccuggcuacgaaaccauucacaauuccaaggcuacgugggccaacgcgggggccggagccaaguauccuacuaccccgccgaaaacuccuacucaagguggagcggucugcuaucgcccugcgacgcagacuggcugggaaugcuggucgugaaaaaggcaaaaggcagcgacaugauaguaccagggcccucguacaaaggcaaaguauucuucgagcgacccaccuucgacggauacguaggguggggaugcggguccggaaagucccgaaccgaaucgggagaacugugcucaagcgacagcggaacaucaaguggccuacucccaucagacaggguccuauggauuggggacguagcaugccaacccaugaccccgauaccugaagaaacauuccuagaacucaagagcuucagccaaagcgaguucccugacaucugcaagauagauggaauagucuucaaccaaugcgaaggcgaaucacucccccagcccuucgacguggcuuggauggacguaggacacucacacaaaauaauaaugagggaacacaagacaaagugggugcaggaaucuucuucaaaagacuucgucuguuacaaagaaggcaccggaccgugcagcgaaucggaagaaaaagccugcaagaccuccgguuccugcagaggagacaugcaguucuguaaaguagcuggcugcgaacacggagaagaggcaucagaagcaaaaugccgcugcucccuaguccacaaaccaggagaagucguggucagcuacgggggaaugcgugugcgaccaaagugcuacggguuuucccgcaugauggcaaccauggaagucaacccacccgagcagaggauugggcaaugcaccgggugccaccuagaaugcauaaacggaggcgugcgcuuaaucacacucaccagcgaacucaaauccgcaacuguuugcgcgucacacuucuguuccuccgcaacaagcggaaagaaaaguaccgaaauacacuuccacucgggcucacugguaggcaagaccgccauccaugugaaaggagcacugguggacggcacagaauuuacauucgaaggcagcuguauguuccccgacggguguaacgcaguagacugcacuuuuugcagggaguuccucaaaaacccgcaaugcuacccagccaagaaauggcucuuuaucauaauagucauacuacucggauacgcgggccuuaugcuucugacuaauguguugaaagccauaggagucuggggaagcugggucauagcaccagucaaacuuauguucgcaauaaugaagaaacucaugcgaacgguaucaugccucguagggaaacuaauggacagaggccgacaagucauacacgaagaaauaggcgagaacggugaagguaaucaugacgaugugcgaaucgagauggcaagaccacgcagagucaggcacuggauguauagcccagugauacucaccauccuggcgauagggcuggccgaaggcugcgacgagaugguacacgcggauuccaagcuagucucgugcagacaaggauccggaaacaugaaagaaugcgugaccaccggaagggccuuacuaccgagcgugaaccccggacaagaagcaugccuccacuucaccgcgccaggaucaccugacagcaaaugccuuaaaauaaaagucaagagaaucaaccugaaguguaaaaagucgagcuccuauuucguacccauagcacgcaaccgaugcacaagcguacgccgaugcagaugggcaggcgacugccagagcggcugcccaccucacuucaccuccaacagcuuuagcgacgacugggcggggaaaauggaccgagcaggccugggcuucucuggaugcucagauggcuguggaggagccgcaugugggugcuucaacgcagcccccuccugcaucuucuggagaaaaugggucgaaaacucgcacggcaucaucuggaaagucagcccaugcgccgcauggguacccucagccgucaucgaacucacgaugccauccggagaaguacgaacauuccaucccauguccggcauaccaacccaaguuuucaaaggcgucucgguaaccuaccugggcucagacauggaaguuucaggacuaacugaccuaugcgaaaucgaggaacugaaaucgaaaaaguuggcccuagcccccugcaaccaggccggaauggggguggucgguaagguaggagaaauacaaugcagcuccgaagaaagcgcaaggacgaucaaaaaggacggauguauauggaacgccgaccuuguagggauagaacucagagucgacgaugcagucugcuacucgaagaucacgucagucgaagcaguggcaaacuacuccgcuaucccuacaaccauaggaggccuaagauucgaacgcucacaugacagccaaggaaaaaucucgggcucgccccucgacaucaccgcgauccguggaucauucagcgucaacuaccgcggccuacggcuaagucuaagcgaaaucacggcaaccugcaccggcgaagucacgaacgucaguggaugcuacagcugcaugaccggcgccaaggugucaauaaaacuacacuccagcaaaaauucuaccgcccacguacgcugcaaaggagaugaaaccgcguucucaguccuggaaggaguccacagcuacacaguaucucugucauucgaccacgccgucguggacgaacaaugucaguuaaacugcgggggccacgaaucccaaguuacacuaaaaggcaaccuaauauuccuagauguacccaaauucgucgacggcucguacaugcaaacauaccacagcacaguucccaccggagcaaacauacccagccccacagauuggcuaaaugcacuuuucggaaacggccugagcagauggauacucggaguaauagggguacuucugggaggccucgcccucuucuuuuuaaucauguuccuauucaaacuggguacuaaacagguauuccgcucccgcacgaaacuagcauga

SEQ ID NO: 16550 - RNA, 3222 nt, Artificial Sequence
  derived and/or modified CDS sequence (opt11) from SFTSV/FTLSV(YSC3)__KF356535.1__GP
augaugaaagucauaugguucucaucgcucguaugccuagucauccagugcaguggagacucgggacccaucauaugcgcgggacccauccacucaaacaaauccgcagcgauaccgcacuuacuaggguauuccgaaaagaucugccagauagaccggcucauucacgucucauccuggcuacgcaaccauucgcaauuccaaggcuacgugggacagcgaggcggccgcagccaagucuccuacuaccccgcagaaaacagcuacucaagguggaguggcuuacucucaccuugcgacgcagauuggcuagggaugcuagucguaaagaaagcaaaagggagcgacaugaucguccccggcccauccuacaagggaaaggucuucuucgaacggccaacguucgacggauacguaggcuggggaugcggcagcggcaaaagcagaacagaaagcggggagcuaugcucuagcgacagcggaacuuccagcggacuccugccaucggacagaguacuguggauaggcgauguugcaugccaaccgaugacaccgaucccggaggaaaccuuucuggagcucaagagcuucagccaaagcgaguucccagauauaugcaaaauagacgggaucgucuucaaccagugcgaaggcgaaucccuuccacaaccauucgacguggccuggauggacgucggacacagccacaaaauaaucaugcgggaacacaaaacaaaauggguccaggaaucaagcucaaaagauuucguaugcuacaaagagggcaccggcccaugcucagaaucggaggagaaaacgugcaaaacaucaggaagcugccggggagacaugcaauucugcaaaguagccggaugugaacacggagaagaagcgucagaagcgaaauguagauguagucucguccacaaaccgggugaagucgucguauccuaugggggcaugcgagugcguccaaaaugcuacggguucagcaggaugauggcgacccuagaaguaaaccagcccgagcaaaggaucgggcaaugcaccggaugccaccuagaguguaucaacggaggcguccgcuugauaacacucacaagcgaacuuaaaagcgcgaccguaugcgcaagccacuucuguagcuccgcaacauccgggaaaaagagcacagaaauacaauuccacagcggcagccuagucggcaagacagcaauccaugucaaaggugcgcuaguagacggcacagaauuuacguucgaaggcucguguauguucccagacgggugcgacgccguggacugcaccuucugcagagaguuccucaagaacccgcagugcuaccccgcgaagaaauggcuauucaucaucaucgucauacuccucggcuacgccggucuaaugcuguuaacgaacguccugaaagcaauaggcaucuggggaagcuggguuauagccccgguaaaacuaauauucgcaaucaucaagaagcuaaugcgaacagucucgugccucaugggaaagcucauggaucgaggucgccaggucauccacgaggagauaggcgaaaacagagaagggaaccaagacgacguucgaauagagauggcaaggccacgcaggauacggcacuggauguacagccccguaauauugacgauacucgccaucggccuagcggaaucgugcgacgagaugguacacgcggacagcaaguuggugucgugcagacaaggaaguggaaacaugaaggagugugugaccacaggcagggcauuacugccagcagucaacccgggucaagaagcaugccugcacuuuacugccccaggcucaccagacagcaaaugccuaaagauaaaagucaaacgaauuaaccucaaaugcaagaaaaguucauccuacuucgugcccgacgcccggagccgaugcaccagcgugcgccggugcagaugggcuggcgacugccaaucagggugucccccacacuucacaagcaacuccuucuccgacgacugggccggaaaaauggaccgagcaggccuuggauucucagggugcagcgacggaugcggaggagccgcaugcggaugcuucaacgcagccccaucaugcaucuucuggcggaaaugggucgaaaacccccacgguauaauauggaaaguaagccccugcgccgcauggguaccaucagcgguaaucgaacucacaaugccaagcggagaaguacgaacauuccaccccaugagcggaauccccacccagguauucaaaggaguauccguuaccuaccuugggucagacauggaagucaguggccucacagaccuaugcgaaauagaagaacugaaauccaagaaauuagcauuagcgcccugcaaccaagcaggcaugggaguagucggcaaagugggugaaauacaaugcaguuccgaagaaucagcgcgaaccaucaagaaagacggaugcauuuggaacgcggaccucgucgggaucgagcucagaguagaugacgcgguaugcuacagcaaaauaacaagcguagaagccgucgccaacuacucggccauccccacgacaaucggcggcuugagauucgagaggucguaugacagccaaggcaaaaucucagggagcccgcuugacaucacagcgaucagaggcuccuuuuccgucaacuacagaggucugcgacugagcuuaucagagauaacagccacaugcacaggcgaagucacaaauguaagcgggugcuacagcugcaugaccggagcaaaaguaagcauuaaacugcacucaaguaagaacucaaccgcgcacguccgaugcaagggagacgaaaccgcauucagcguccuggaaggaguacacaguuacaccguaucacucagcuucgaccacgcgguagucgacgaacaaugccaacucaauuguggagggcacgaaucgcaagugacauuaaaggggaaccuuaucuucuuggacguaccaaaauucguugacggaucguacaugcaaacauaucacagcacgguuccaacaggcgccaauaucccgucaccaacagacuggcuaaacgcacucuucggaaauggccuaagccgauggauccugggagucauaggcgugcuccugggaggccuagcccucuucuuuaugauaaugucauuauucaaacuagggaccaaacaggucuucaggagcaggaccaagcuggcauga

SEQ ID NO: 16551 - RNA, 3222 nt, Artificial Sequence
  derived and/or modified CDS sequence (opt11) from SFTSV/FTLSV(YSH39)__KF356529.1__GP
augaugaaagucauuugguuuagcagcuuaauaugcuucgucauccaaugcagcggcgacaguggucccaucaucugcgcaggcccaauccacagcaacaaaagcgcagacaucccacaucuccucggguacucagagaaaaucugccagaucgaccgucuaauccacguguccucaugguuaagaaaccauucgcaauuccaaggcuacgucggacaaagaggcgggcgaagccaggucagcuacuaccccgccgaaaacuccuacucaagauggucgggccuccuaagucccugcgacgcggacuggcugggcaugcuaguuguaaagaaagcgaagggauccgacaugauuguaccaggacccuccuacaaaggcaagguauucuucgaacgaccaacguucgauggauacgucggauggggauguggcuccgguaaaucccgaacggaaagcggagaacuauguucaagcgacagcggcacgagcucaggccuccuacccagcgacagaguacuuuggauuggagacgucgcuugccaacccaugacgcccaucccagaggagaccuucauggaacucaagaguuucagccagagcgaguuccccgacaucugcaaaaucgacggcaucgucuucaaccaaugcgaaggggagagccuaccccaacccuucgaugucgccuggauggacgucggucacucccacaaaaucauaaugcgagaacacaaaacaaaauggguacaagagucaagcucaaaagacuucgugugcuauaaagaagguacagggcccuguucagaaagcgaagaaaagaccugcaagaccaguggaucaugccgaggcgacaugcaguucugcaaagucgcaggcugcgaacacggagaagaagccucagaagcaaaaugccgcuguucccuuguccacaaaccaggagaaguagucguuagcuacggaggcaugcgaauacguccuaaaugcuauggcuucucuagaaugauggccacucuagaaguaaaccaaccagaacagcgaaucggacagugcacagguugucaccuagaaugcaucaauggcggcguucgguugauaacccucaccuccgaauuaaaaagcgcgaccgucugcgcuagccacuucugcuccuccgccacaucaggcaagaaaucaacagaaauccaauuccacucgggaucccucguggguaaaaccgccauccacguaaaaggcgcccuuguagacggaaccgaguucacauucgaaggauccugcauguucccggacggcugcgacgcagucgacugcacauucugcagagaauuucuuaaaaacccccaaugcuaccccgccaagaaauggcuauucaucaucaucgugauccuacucggccacgcaggauuaaugcuccucaccaacgucuuaaaagcgaucggaaucuggggcagcugggucaucgcccccgucaaacuaauauucgcaauaauaaagaaacucaugcgcaccgucucaugccucaugggaaaacuaauggaccgcggccgacaagugauccacgaggaaaucggcgaaaaucgggaaggaaaccaggacgacgucagaaucgaaauggccaggccaagacgaguccgccacuggauguacucucccgugauacucacaauccuagcaauaggacucgcagaaaguugcgacgaaaugguccacgcggacuccaaacuggucucauguagacaaggcucuggaaacaugaaagaaugcgugaccaccggaagggcccuacucccggccgucaacccaggacaggaagccugccuccauuuuacugcccccggaaguccagacucgaaaugccuaaaaauuaaaguaaaaagaaucaaccugaaaugcaaaaagagcuccuccuacuucguacccgacgcccgaaguagaugcacgagcgucaggcgcugccggugggcaggagacugucaaucaggcugucccccacacuucacauccaacuccuucucagacgacugggccggaaaaauggauagagcagggcucggauuuucaggcugcagcgacggcugcggaggcgcagccugcggaugcuucaacgcagccccauccugcaucuuuuggcgaaaauggguagaaaacccgcacgggauuauauggaaaguaucaccaugcgccgcgugggugccaucagcggugauugaacucacaaugcccucuggugaaguacgcacauuccacccaaugagcggcauacccacccaagucuucaaaggcguauccguaacauaccucgggucggauauggaaguaagcggccuuaccgaccuuugcgaaauagaagaacuaaaaagcaaaaagcuagcccucgcaccaugcaaccaagccgggaugggagucguaggcaaagucggggaaauucaauguucuucagaggaauccgcacgaaccaucaagaaagacgguugcaucuggaacgccgaccucgucggcauagaacuccgagucgacgacgccguaugcuacuccaaaauaacauccgucgaggccgucgcgaacuauucggcuaucccgacaacgaucggcgggcuccgcuucgaacgaucccacgacucccagggaaaaaucagcggcagcccgcuagacauaaccgcaauccgcggcuccuucucagucaauuaucgaggacugcgccuaagccuaagcgaaauaacagcgaccugcaccggcgaaguuacaaacguguccggcugcuacagcuguaugacaggcgccaaaguaucgauaaaacuacacuccaguaaaaacaguacagcccacgucagaugcaaaggagacgaaacggccuucucaguccuagaagguguccacagcuacaccguaucccuguccuucgaccacgccgucguugacgaacaaugucagcuaaacugcgggggacaugaaagccaggucacguuaaaagguaaccucauauuccucgaugucccgaaauucguagacggcagcuacaugcaaacauaccacuccacaguaccaaccggcgcgaauauccccagcccaaccgauuggcucaacgcccuauuuggcaacggccuauccagauggauacucggcgucaucggcguacuccuuggaggucucgcccucuucuucaugauaaugucccuuuucaaacucggcaccaaacagguguuucgaucacgaaccaagcuagcguaa

SEQ ID NO: 16552 - RNA, 3222 nt, Artificial Sequence
  derived and/or modified CDS sequence (opt11) from SFTSV/FTLSV(YSHX002)__KF356540.1__GP
augaugaaaguaaucugguucagcucacuaaucugcuuagucauucaaugcucaggcgacucagggccgauuaucugcgcgggaccaauccacaguaacaaguccgcaggcaucccccacuugcuaggguacagcgagaaaaucugucaaaucgacagacuaauccacguguccucguggcucagaaaccacucacaauuccagggauacguaggacaacgaggaggccgcucgcagguaucguacuacccagcggaaaacagcuacagucgauggaacggccugcucagcccaugcgacgccgacuggcugggaaugcuggucguaaagaaagcgaaagaauccgacaugaucgucccuggccccagcuacaaaggaaaagucuucuucgaaaggccaacauucgacggauacgugggguggggcugcggcagcggaaaaagcagaaccgaaucaggcgaacugugcuccagugacagcgguaccagcuccggucuacuccccagugacaggguacucuggauaggcgacguggcgugucaaccaaugaccccgauccccgaagagacauuccuggaacucaaauccuucucccaaagcgaguucccugacaucugcaaaauagacggcaucguauucaaccaaugcgaaggcgaaucacuaccacagcccuuugacguggccuggauggacgucggccacucacacaaaauaaucaugcgcgaacacaaaacaaaauggguacaggaaucaagcuccaaagacuucgucugcuacaaagaaggaaccggaccaugcagcgaaucggaagaaaaggccuguaaaaccuccggcucauguagaggagacaugcaauucugcaaagucgccggcugugagcacggcgaagaggccagcgaagcaaaaugccgaugcucgcuaguacacaaaccgggggaaguagugguaucauauggcgggaugcgaguacgcccuaaaugcuacggguucucccgcaugauggcgacccucgaagugaauccacccgaacaaagaauaggacaaugcaccggaugccaccucgaaugcaucaacgggggaguaagacugauaacacucacaagcgagcuacggagcgcgacaguuugcgcaucccacuucugcuccucagcaacaagcggaaagaaaagcacagagauacacuuccauuccggaucgcucgugggaaaaacugccauccacgucaaaggcgcacucguagacggcacagaauuuacauucgaaggcuccugcauguucccagacggcugugaugcaguggauuguacguucugccgagaguuccugaaaaacccgcagugcuacccggccaagaaauggcuauucauaaucauagucauccugcugggauaugcaggauuaaugcuggucacgaacgugcucaaggcaauuggcguaugggguagcuggguaaucgccccggucaaacucauguucgccauuaucaagaaacuaaugcgcacgguaaguugccuagucggcaaacucauggaccgaggccgccaagucauacacgaagagaucggcgaaaauggagaaggaaaucaggaugacguaaggaucgagauggcacggccacgccgagucagacacuggauguacucgccugucauacucacaauacuagcaauagggcuagccgaaggaugcgacgagaugguacacgccgacucgaaacuugucagcugccgccagggcuccgguaacaugaaagaauguaucaccacaggacgcgcccucuuacccgcagucaacccaggacaagaagccugccuacacuucacagcccccggcagcccagacagcaaaugccuaaagauuaagguaaagcgaaucaaccucaagugcaaaaagagcaguagcuacuuuguccccgacgcgagaagccgaugcacguccguacgaagauguaggugggcaggagacugccaaagcggcugcccgccacacuucacgaguaacagcuucagcgacgacugggcgggcaaaauggaccgagccggacucggauucucaggcugcagcgacggaugcggcggugccgccugcggaugcuucaacgcagccccguccuguaucuucuggcggaagugggucgaaaacccgcacgguaucauauggaaaguaagccccugcgcggcaugggucccuuccgccgugauagaacucaccaugcccuccggagaaguacgcacauuucacccaaugagcggcauucccacccaaguauucaagggagucagcguaacauaccucgggucagacauggaaguguccggacuaacagaccuaugcgaaauugaagaacucaaaucgaagaaacucgcccuagccccaugcaaccaagcagggaugggggucgugggaaaggucggcgaaaaacaauguagcagcgaagagagcgcacggacaaucaaaaaggacggaugcauauggaacgcagaccuaguugggaucgaacugagaguggacgacgcgguaugcuacuccaagauaacaucaguugaagcaguggcaaacuauucagccaucccaacaacaaucggaggacucagauucgagcgaucccacgacagccaaggcaagaucagcgggagcccauuagacaucaccgccauccgaggcucauucuccgucaauuaccgaggccuacgccucagucucuccgagaucacagcaaccugcaccggagaggucacgaacgucagcggcuguuacagcugcaugacgggcgccaaaguaagcaucaaguuacacucgagcaaaaacucaacagcccacguaagaugcaagggcgaugagaccgccuucuccguacuagaaggaguccacagcuacauagugucccucagcuuugaccacgcuguagucgacgaacaaugccaacuaaacugcgggggccacgaaagccaaguaacacuaaaaggaaaccuaauuuuucuagauguccccaaguucguagacgguucauauaugcaaacauaccacuccacggucccgacuggagcgaauaucccguccccaacggacuggcuaaacgcccuauucggcaauggccuguccagguggauacugggugucauaggcguccuccugggagggcucgcacucuucuuccucaucauguuccugcucaaacuaggcaccaaacaagucuuccgcucacgcacaaaacuggcauga

SEQ ID NO: 16553 - RNA, 3222 nt, Artificial Sequence
  derived and/or modified CDS sequence (opt11) from SFTSV/FTLSV(YXX2)__KF356534.1__GP
augaugaaagucaucugguucagcucccuaaucuguuuaguaauacaaugcggaggcgacacaggcccaauaaucugcgcggggccaauacacagcaacaaaagugccgacaucccccacuugcuaggauauucggagaaaauaugucaaauagacaggcucauccacguaagcucaugguuaagaaaucacucgcaauuccaaggauacguaggccagagaggggguagaagucaagucuccuacuaccccgcggaaaacuccuacagccgcuggaguggauuguuguccccaugugacgcggacuggcuaggaaugcuuguagugaagaaagccaaaggcucagacaugaucguccccgggcccagcuacaaaggaaaagucuucuuugaaagaccgacauucgacggguacgucggcugggggugcggcagcggaaaaagcaggacagaaagcggggaacugugcucgagugacaguggaaccucaagcgggcucuugcccuccgaccgcguauuguggauaggcgauguagccugccagccaaugaccccgaucccggaagaaacauuucucgaacuaaaauccuuuagccaaagcgaguuccccgacaucugcaagauagaugggaucgucuucaaccaaugcgagggagaaagucugccccagcccuucgacguagccuggauggacguaggccacucccacaagaucaucaugagagaacacaagaccaaaugggugcaagagucaagcagcaaagacuucgugugcuacaaagagggaacgggaccaugcuccgaaucagaagagaaaaccugcaaaaccaguggcucuugcagaggagacaugcaguucuguaaagucgccgggugcgaacauggcgaagaggcuucagaagcgaaaugucgaugcucacugguacauaaacccggagaagucgucgucuccuacggcggaaugaggguucgccccaaaugcuacggcuucucgagaaugauggccaccuuggaaguaagccaacccgaacaaaggauuggacaaugcaccgguugccaccuggaaugcaucaacggaggaguacgccugaucacacugacaucagagcucaaguccgcuaccgucugugcaagccauuucuguucaagugccaccucuggcaaaaagagcacagagauucaauuccacucggggagccucgugggcaaaacugcgauccacgucaagggagcucuaguagacgggacagaguucacauucgaaggcucgugcauguucccagacggaugcgaugcaguggacuguacauucugccgagaguuccugaaaaacccccaaugcuacccagcgaagaaauggcuauuuaucauaauaguaauacuacuaggcuacgcgggucucaugcugcucaccaacguacuaaaagccauaggagucuggggcucaugggucauagccccagucaaacucguauucgcgauaauaaagaaacugaugcgagcaguauccugccugauggggaaacuaauggaucgaggacgacagguaauacaugaagaaauuggagaaaaccgggaagggaaccaagacgacgucaggaucgaaauggcgaggccgagacgaguacggcacuggauguacucaccgguaauacucacgauacuugcuaucgggcuggccgaaggcugcgacgaaauggugcacgccgacuccaaacucgucagcugcagacaaggcucaggcaacaugaaagaaugcguaaccacaggcagagcccuacuaccagcaguaaaccccggacaagaagcgugucuccacuucacagcgccuggaucccccgacucgaaaugccuaaagaucaagguaaagagaauaaacuugaaaugcaaaaagagcuccaguuauuucguccccgacgccagaagcagaugcacaucaguacgccgcugccgaugggccggugacugccaaucaggaugcccgccacauuuuacaagcaauagcuuuucagacgacugggcagggaaaauggacagagcaggacuaggauucucgggcuguucagacggcugcggcggagcagcgugcgggugcuucaacgcagcacccagcugcaucuucuggagaaaauggguugaaaacccacacggcauaaucuggaaaguaagccccugcgccgcaugggugcccagcgccguuauagaacuaaccaugccgagcggagaaguucgaacguuccacccaauguccgggaucccaacacaggucuucaaaggagucagcguaacguaccuuggcucugauauggaaguaagcggccuaaccgaccuuugcgagaucgaggaacuaaaaagcaagaaacuagcgcuagcacccugcaaucaagcaggaaugggggucgugggaaaggucggagaaauacaaugcagcucagaagaaagcgcccggaccaucaagaaggauggcugcaucuggaacgcggaccuaguuggaaucgaacuaaggguagaugacgcaguuugcuacucaaagauaaccagugucgaagcaguggccaacuacuccgccauccccacaaccauaggaggucuacgguucgaacggucacacgacagccaggguaagaucucaggcucgccacuagacauuacggcgaucaggggauccuucagcgugaacuaucgaggcuuacgguugagccugagcgaaaucacggcaacaugcacgggggaagucaccaauguaaguggaugcuacagcugcaugacgggcgcgaagguauccaucaaauuacacagcagcaagaacucaaccgcccacguacgcugcaaaggcgacgaaacggccuucucggugcuggaagguguucacagcuacuccguuagccucagcuucgauuacgcaguggucgaugaacagugccaacucaacugcggaggacacgaaucgcaaguaacccuaagggggaacuuaauauuucuggauguaccaaaauucguagacggaagcuacaugcagacguaccacaguaccgugccaacaggagccaacauccccagcccaaccgacuggcuuaacgcccuauucggcaacgggcugagucgguggauacucggagucaucggcgugcuccucggaggccuggcccuguucuuccuaauaaugagccuguucaagcucggaacgaaacaaaucuuccgcagcaggaccaagcuggcauaa

SEQ ID NO: 16554 - RNA, 3222 nt, Artificial Sequence
  derived and/or modified CDS sequence (opt11) from SFTSV/Huaiyangshan virus(2010-FQM)__HQ419236.1__GP
augaugaaagucaucugguuuagcagccuaauaugcuuggucauacaaugcggaggcgacaccggccccauaauuugcgccggaccaauacauuccaacaaaucagcggacaucccacaccuacuuggcuacagcgagaaaauaugccaaauagacaggcucauacacgucaguuccugguuacgaaaccauagucaauuucaaggauacguggggcaacgcggugguagaagucaggucucguacuacccagcggaaaacagcuacucacgcuggucaggccuauuaaguccaugcgacgcagacuggcuaggaaugcuaguggugaaaaaggccaagggaagcgacaugaucguaccagggccgagcuacaaaggaaaagucuucuucgaaagaccaaccuucgacggauacguggguuggggcugcggcucgggcaaaagccgcacugaguccggggaacugugcuccagcgacagcgggacaucgaguggccucuugccaucagaccgcguacuauggauaggagacguagcaugucagcccaugacacccauaccagaagagaccuuccucgagcuaaagagcuucucacaaagcgaguuucccgacauaugcaaaaucgacggaaucguguucaaucagugugagggagagagccuaccgcaacccuucgauguagcuuggauggacgucggccacucacauaaaaucauaaugagggaacacaaaacgaaauggguccaggaaagcagcuccaaagacuucgugugcuacaaagaaggcacaggaccguguucagagagcgaggaaaaagccugcaaagcaucggguucaugcaggggcgauaugcaauucuguaaaguggccggaugcgaacacggcgaagaagcgucagaagcuaaaugcagauguucacuuguucacaaaccaggcgagguaguagugucguacggcggaaugcguguccgcccaaaguguuacggcuuuagccggaugauggccacccucgaaguaagccagcccgaacaacgaauaggacagugcaccggcugccaccucgaaugcauaaacggaggagucaggcucauaacacucacgagcgagcuaaagagcgcgaccguaugcgcaagccacuucugcagcuccgccacaagcgggaagaaaucgaccgagauccaauuucacucgggcagucucgucggcaagacagcaauccacguaaaaggagcgcuaguagacggaaccgaguucacguucgaaggcucaugcauguucccagacggcugcgacgcaguagacugcaccuuuugcagggaguuucugaagaacccccaguguuacccagccaagaaguggcucuuuaucauuauaguaauccugcucggguacgcgggauuaaugcuccuaacgaacguacucaaggccauaggcgucuggggaagcugggucauagccccggugaagcucguguucgcaauuauuaaaaagcugaugcgggccguaucgugcuuaaugggaaaacugauggaucggggacgccaaguaauacacgaagagauaggagagaacagggaggggaaucaagacgacguccgaaucgagauggcgcgccccagacguguucggcacuggauguauucaccggucauacucacgauacuagcaaucggacuagccgagggcugcgacgagaugguccacgccgauuccaagcuagugucaugcaggcaaggaaguggcaacaugaaagaaugcgucaccacaggcagggcccugcucccagcggucaaccccggacaagaagcaugccugcacuucaccgcaccagggagcccagacucaaaaugccucaaaauaaaaguaaagcgcaucaaccugaagugcaagaaaagcagcaguuacuucguaccagacgcgaggagccggugcaccagcgugcgaagaugccggugggccggcgacugccaaagcggaugcccgccccauuucacgagcaacaguuucagcgacgacugggccggcaaaauggaccgagcaggacuaggauucaguggcugcagugacggcugcgguggagccgcaugcggaugcuuuaacgcagcacccagcuguauauuuuggcgaaaaugggucgagaauccgcauggcaucauauggaaaguaucacccugcgccgcauggguacccagcgcaguaauagaacugaccaugccaucaggagaagugaggacauuccaccccaugaguggcaucccaacacaaguauucaaaggagucucagucaccuaccugggcucugacauggaagucagcggucucacggaccugugcgaaaucgaggaauuaaagaguaaaaagcuagcgcucgcgcccugcaaccaagccgggaugggcgucguuggcaaagucggggaaauccaaugcaguagcgaagagagcgcgcgcacaaucaagaaagacggaugcauuuggaacgcagaccuugucggaaucgagcuccgagucgacgacgccgucugcuacuccaaaauaaccuccgucgaagccgucgcaaauuauuccgcaauaccaacgacgaucggcggacuaagguucgaacgaucgcacgacagccagggcaagaucucgggaagcccccucgacauaacggcgaucagagguucguucucaguaaacuaucggggcuuacgcuugagucuguccgaaauuaccgcaacgugcacaggagaggucacgaacguguccgggugcuacagcugcaugacaggcgccaaagucagcaucaaacuccacucguccaaaaacucaaccgcacauguacgauguaaaggcgacgaaacagcauucagcgugcuagaggggguccacucuuacucgguaagccucagcuucgaccacgcugucguagacgaacaaugccaauuaaacugcggaggacacgaaucgcaagugacuuuaagaggcaacuuaaucuuccucgacgucccaaaauucguagacggcucauacaugcaaaccuaccauagcacaguuccaaccggggcaaacaucccaagcccgacagacuggcuaaacgcucucuucgguaacggccuaagccgauggauacuaggcgucauaggaguauuauugggaggacuugcccucuucuuccugaucauguuccucuucaaacucgggaccaaacaaauauuccgaucccggacaaagcuagcauag

SEQ ID NO: 16555 - RNA, 3222 nt, Artificial Sequence
  derived and/or modified CDS sequence (opt11) from SFTSV/Huaiyangshan virus(2010-LZR)__HQ419237.1__GP
augaugaagguaauaugguucagcagccucaucugccucgucauccagugcggcggagacacuggcccaauaauaugcgcggggcccauccauucaaacaagagcgccgacaucccccaccuacugggguacucugagaaaaucugucaaaucgaccgacucauccacguaagcagcuggcuccgaaaccacucccaauuccaaggcuacgugggccaacgcggcggcaggagccagguauccuacuaccccgcggaaaacuccuacuccaggugguccggccuccucucccccugcgacgcagacuggcucggcaugcucguagugaagaaagccaaaggaucagacaugaucgucccgggaccaucuuacaaaggcaaaguauuuuucgaacggccaacauucgauggguacguaggcuggggcugcggaucaggcaaaucucgaaccgagagcggcgagcuuugcuccagcgacuccggaacaucaucaggacuccuccccuccgaccgaguacucuggaucggcgacguagcaugccaacccaugaccccuaucccagaagagacuuuccucgagcucaaaucuuucucccaaagcgaguucccggacaucugcaaaaucgacggcaucgucuuuaaucagugcgaaggagaaucccuaccccaaccauucgacgucgccuggauggaugucgggcauucacacaaaaucaucaugcgggaacacaagaccaaauggguacaagaaucguccucaaaagacuuugucugcuacaaagaaggcaccgguccuugcagcgaaagcgaagagaaaacuugcaagacuucgggaucgugccgaggcgacaugcaauuuuguaaaguagcaggaugcgaacacggagaagaagcaagcgaagccaaaugccgcuguucccugguccauaaaccaggcgaagucgucgucagcuacggaggaaugcgcguccguccaaagugcuacggcuucucccgcaugauggcaacccucgaagugagccaacccgaacaacgaauaggacaaugcacagguugccaccuagaguguauaaaugguggcguccgcuugaucacucuaacgagugaacuaaaaucggccaccgucugcgcaucccacuucugcuccagcgccaccagcgggaagaaauccacagaaauacaauuccacuccgggucgcucguuggaaaaacagcaauucacgucaaaggggcacucguggacggaaccgaguucacauucgagggcuccugcauguucccagacgguugcgacgccguagacugcaccuucugccgagaguuccuaaagaacccccaauguuacccggcaaagaaauggcucuuuauaaucaucguaauacuccuaggcuacgccggucugauguuacuaaccaacguacuaaaagccauugggguguggggcagcugggucauagcaccgguaaagcuaguauucgcaauaaucaagaaacuuaugcgagcggucucgugccucauggguaaauuaauggacagaggaagacaagugauccacgaagaaauaggcgaaaaccgagaaggaaaucaggacgacgucagaauugaaauggcccggccccgccgcguaaggcacuggauguacuccccugucauccuuacuauccuagcuauaggacucgcagagggaugugacgaaaugguccacgcagacucgaaacucgugucaugcagacaaggcucuggcaacaugaaagaaugcguuacaaccggccgcgcacuccuacccgccgucaauccgggccaagaagcaugccugcacuucacagcccccgggagccccgacucgaaaugccuaaaaaucaaagucaaacgcauuaaccucaaaugcaagaaauccagcagcuacuucgugccggacgcacguucacgaugcaccucaguccgacgaugccgaugggccggggacugccaguccggaugcccaccccacuucacaaguaacucuuucagcgaugacugggcgggcaaaauggacagagccggacugggauucucaggcugcucggacgggugcggcggcgcagcaugcggauguuucaacgccgcacccucaugcaucuucuggcgcaaaugggucgaaaacccccacggaaucaucuggaaaguaucgcccugcgcagcguggaucccauccgcgguuauagaacuaaccaugccaagcggcgaagucagaaccuuccauccgauguccggcaucccaacgcaggucuuuaaaggaguaucaguaacguaccuuggcagugacauggagguaagcggacuaaccgacuuaugcgaaauagaagaacucaaauccaagaaacucgcacucgcacccugcaaccaagcaggaaugggagucgucggcaaagugggcgaaauccaauguuccagcgaagaauccgcacgcaccaucaagaaagacggcuguaucuggaacgccgaccuugucggaaucgagcuuagggucgacgacgcagucugcuauucgaaaaucacauccgucgaagcagucgccaacuacagcgccaucccaacuacaauaggaggccugagguucgaacgcagccacgacagccagggaaaaaucagcggcagcccccucgacaucaccgccaucaggggcuccuucucaguaaacuaccgcggccucagauuaagccuaucagaaauaaccgcaaccugcacgggagaagucacgaacgugagcggcuguuauagcugcaugacaggcgccaaagucagcauaaaacuacacuccagcaaaaacagcaccgcacacguccgcugcaaaggugaugagaccgccuucaguguccucgagggcguacacucauacucagugucacugagcuucgaccacgcggucgucgaugaacagugccaacuaaacugcggcggccaugaaucgcaagucacgcugagaggcaaccuaaucuuccuagacguuccgaaauucguagacggcuccuauaugcaaaccuaccacucgacagucccaaccggggccaauauaccaucacccaccgacuggcucaaugcgcuauucggcaacggccuauccagguggauacuaggcguaaucggcguacuccuaggaggcuuagcacucuuuuuccugauaaugucccuauucaaacuaggaaccaaacaaaucuucagaagccgaacaaaacuagcauga

SEQ ID NO: 16556 - RNA, 3222 nt, Artificial Sequence
  derived and/or modified CDS sequence (opt11) from SFTSV/Huaiyangshan virus(2010-T112)__HQ419238.1__GP
augaugaaggucauaugguucagcucccuaauaugcuuuguaauacaaugcuccggagacaguggaccgaucauaugcgcagggcccauacacucaaacaaaucagcugacauaccccaccucuugggauacucagaaaagaucugccaaauagacagacucauccacgucaguuccuggcuacgcaaucacucccaauuccaaggguacguagggcagcgcgggggacgaagccaaguaucguacuacccagcagaaaacagcuacucacgauggucaggccugcucuccccaugcgacgcagacuggcucggcaugcucguagucaaaaaggcaaaaggcagcgacaugauaguccccggaccuuccuacaaaggcaagguauucuucgaaagaccaaccuucgacggcuacguaggguggggaugcggaucgggcaagagccgcacagaaaguggcgaacuuugcucaagcgacagcggcaccucaucaggccugcuaccuucagacagaguccuauggauaggcgacguagcaugccagccaaugacaccaauacccgaggagaccuuccucgaacugaaauccuuuagccaaagugaguucccggacaucugcaagauagacggaaucguauucaaccaaugcgaaggcgaaagccugccccaaccauucgacgucgccuggauggacgucggccacucccacaaaaucaucaugagggaacacaaaacgaaauggguacaggagucaagcagcaaagacuucgucuguuacaaggaggggacaggccccugcucagaauccgaggagaaaacaugcaagaccagcggcagcugcagaggcgauaugcaguucuguaaaguagcaggaugcgaacacggcgaagaagccagcgaagcaaaaugccgaugcagccugguccacaagcccggcgaaguaguggucuccuacggcggcaugagagucagacccaaaugcuacggauucucgcggaugauggcuacacuggaaguaaaccaaccggugcaacgcaucgggcaaugcacagguugucaccuagaaugcauuaacggcgggguacgccuuaucacccuaaccagcgaacuaaaaagcgcuaccgucugugccagccauuucugcuccuccgcuaccucuggcaagaaaaguaccgagauacaauuccacagcggcucgcuaguaggcaaaaccgccauccacguuaagggagcccuaguagacggaaccgaauuuacauucgaaggaucaugcauguucccggacggcugcgacgcggucgacugcacauucugucgggaguuccugaaaaacccacaaugcuauccagcuaagaaaugguuguucauaauaauagucauccuccuaggauacgcaggacucaugcuccucacaaacgucuuaaaagcaaucgggauauggggauccuggguaauugccccagugaaacucauuuucgcaauaaucaagaaacuaaugcgcacaguaucaugccucaugggaaaacuuauggaccgagggcgccaagucauacacgaggagauuggcgaaaaccgcgaggguaaccaagacgacguacgaauagaaauggcgcgcccccgcagagucagacacuggauguacgccccagucauccuuacaauccuugccaugggacuggccgagagcugcgacgaaaugguccacgcggacaguaaacucguaagcugcaggcaaggguccggcaacaugaaagaaugcgucaccaccgguagggcccuccugccggcagugaaccccgggcaggaggccugccuucacuucaccgccccaggaucaccggacucaaaaugccugaaaaucaaagugaaacgcauaaaccucaaaugcaagaaaagcuccucguacuucguacccgacgcccgcagccgaugcaccaguguaaggcgcugccgaugggcgggagacugucaaucaggcugcccaccacacuucaccagcaacagcuucagcgacgacugggcaggcaaaauggaccgagcaggacucggauucucaggcugcagcgacggaugcggcggcgccgcaugcggcugcuucaacgccgcaccgagcugcaucuucuggagaaaaugggucgaaaacccgcacggaaucauauggaaagucagcccuugcguagcaugggugcccucggccgugaucgaacuaacaaugccgucaggagaaguccgaacauuccaccccaugagcggaauaccuacucaaguguucaaaggagucucagucacguaccuggggagcgacauggaagucagcggccucaccgaccucugcgaaaucgaagaacuuaaaagcaagaaacuugcccucgcacccuguaaccaggccggaaugggcguuguaggcaaaguuggggaaauccaaugcuccagcgaagaauccgcccgcaccaucaagaaagauggaugcaucuggaacgccgaccuaguaggaauagaacuucgcgucgacgacgcgguuugcuauucuaaaauaacauccgucgaggccguggccaauuacagcgccaucccaaccaccaucggcggccuacgauuugaacguagccacgacucacagggcaaaauauccggcucccccuuggacaucaccgcgauccggggaucauuuagcguaaacuaccgaggccugcgccuaucccuaagcgaaaucacagcaacaugcaccggcgaagucacaaacguaucgggcuguuacaguugcaugacgggcgcaaaagucuccaucaaacuccacaguagcaaaaacucaacagcgcacguacgcugcaaaggagacgagaccgcguucucgguccuagaggguguccacuccuacacagugucccuauccuucgaccacgcagucgucgacgagcagugccagcucaacugcggaggacacgagagccaaguaacccuaaaaggcaaccuaauauuccucgacguacccaaauucguagacggcucguacaugcaaacguaccauuccacagucccaaccggcgccaacauacccaguccgacagauuggcugaacgcccucuucggaaauggucugagccgauggauacuaggagugauagggguacuccuaggcggacucgcccuauucuucaugauaaugucccucuucaaacugggaaccaagcaaguauuccggagccgaacaaaacuagcguaa

SEQ ID NO: 16557 - RNA, 3222 nt, Artificial Sequence
  derived and/or modified CDS sequence (opt11) from SFTSV/Huaiyangshan virus(2010-WJ)__HQ419229.1__GP
augaugaaaguaaucugguucagcucccugaucuguuucguaauccaaugcagcggagacagcggucccaucauaugugcgggaccaauucauagcaacaaaucagccgauaucccccaccuccucggauacagcgagaagaucugccagauagaccgucuuauccaugugucaucauggcuaagaaaccacucccaguuucaaggauauguaggcaaacgagggggccgcucgcaaguaagcuacuaccuagccgaaaauagcuauagcagauggucaggauugcucucgcccugcgacgccgauuggcuaggcaugcugguugugaaaaaggcgaaagggagcgacaugaucguaccugggcccagcuacaaaggcaaggucuucuucgagcguccaacauucgacggauaugugggguggggaugcggaucaggaaaaagccggaccgaaagcggagaacuuugcucaagcgacagcggaaccucgucgggacuccuacccucagacaggguccuguggauaggugacgucgcaugccagccuaugacaccgauuccggaggagacguuccuagagcuaaagagcuucagccaaucagaguucccggacaucugcaaaaucgacggaauagucuuuaaccagugcgaaggcgagagccugccacagccauuugacguagccuggauggaugugggccacucccacaaaauaauaaugcgcgaacacaaaacaaaauggguucaagaaagcaguucaaaagacuucguaugcuauaaagaagguacaggccccuguucugaaagcgaggagaaaacauguaaaaccucagguagcugcagaggagacaugcaauucugcaaggucgccggaugcgaacacggcgaagaggcgucggaagcaaaaugccgaugcagucuaguacacaaaccaggugagguggucguuucauacggaggcaugcgaguccgucccaaaugcuacggcuuuucaagaaugauggccacccuagaagugaaccaaccagaacaaagaauuggccagugcaccgguugccaccuugagugcaucaacggcggcgugagacucaucacgcucacgagcgaacucaagagcgcgaccguaugcgcgagccacuucugcagcucggcaacaagcggaaagaaaagcacagagauccaauuccacaguggcucgcuaguaggcaagacugcaauccacgucaagggugcacucguggacggaacagaguucacauucgaaggaagcugcauguucccagacggaugcgacgccguagacugcaccuucugccgcgaguuccucaagaacccacaaugcuaucccgccaagaaauggcuguucaucauaaucgugauucuacugggguacgcgggccugaugcuucucacaaacgugcucaaagccauaggaaucuggggaagcugggucauugcccccguaaaacucauauucgcaaucauaaagaaauuaaugcgcacaguauccugccuaaugggcaaacugauggaucguggacggcaggucauacaugaagaaauaggagaaaacagggaagguaaccaagacgauguacgcauagaaauggccaggccacgacgcguccgacacuggauguacagcccagucauccucacaauauuggcgaucggacucgcggaauccugcgacgaaauggugcacgcagacagcaagcuaguaucgugcagacaaggcaguggcaacaugaaagaaugcgugaccacgggcagagcccugcugccggccguuaacccaggucaagaagcaugccugcacuucaccgcgccgggcuccccagacucgaaaugcuuaaaaauaaaaguaaaacgaaucaacuuaaaaugcaagaaaagcucgagcuacuuuguaccggacgcccgaaguaggugcaccucugugcgacgaugccggugggcuggugacugccaaagcggaugcccgccccacuucacgcccaacaguuucagcgacgauugggccggaaaaauggacagggccggacucggcuucagcggcuguagcgacggcugcgggggugccgccugcggaugcuucaacgcagccccaagcugcaucuucuggagaaaaugggucgaaaacccucacggaauaauauggaaagucagccccugcgcagcgugggucccauccgccgucaucgaacuaacaaugccaagcggagagguacgaacguuccaccccaugagugggaucccgacccaggucuucaaaggggucagcguaacguaccugggaucugacauggaaguaagcggacuaacagaccugugcgaaauagaagaacucaaaagcaagaaacuggcacuggccccaugcaaccaagcagggauggggguagugggcaaagucggagaaauacaauguagcucagaagaauccgcccgcacaauaaagaaagacggaugcaucuggaacgcggaccucguagggauagaacugcgggucgacgacgcagugugcuacagcaaaauaacgagcguugaagcaguggcuaacuacucggcaauaccaaccacgauaggaggacuuagauucgaaagaagccacgacagccagggcaagaucagcggcucgccccuggacauaaccgcgauucgggggagcuucucggugaauuaccgcggucuacgccuaagccucagcgaaauuacagccacaugcacaggggaaguaacaaacguaagcgggugcuacuccuguaugacaggcgccaaaguaagcaucaaacuucacuccagcaagaacucuaccgcacacguacgaugcaagggggacgagaccgcauucucagugcuagagggcguccauucauacaccgugagccuaaguuuugaccacgcuguuguagacgaacagugccaacucaacugcggagggcacgaaagccaaguaacgcucaaaggcaacuuaaucuuccuggacguccccaaauucgucgaugguaguuacaugcaaacguaucacagcaccguaccaacaggcgccaauauaccaagcccgaccgacuggcucaacgcccuauucggcaacggccuuagucgcuggauccugggagucauaggcgugcugcucggagggcucgcacucuucuucaugauaaugucccucuucaaacucggcaccaagcaagucuucagaagccgcacaaaacuagcguaa

SEQ ID NO: 16558 - RNA, 3222 nt, Artificial Sequence
  derived and/or modified CDS sequence (opt11) from SFTSV/Huaiyangshan virus(2010-WJQ)__HQ419230.1__GP
augaugaaaguaauaugguucagcucguugauaugccuagucauacagugcgggggcgacacaggcccgauaauaugcgccggaccaacccacuccaacaaaagcgccgauauaccccaccuacuaggauacagcgagaaaauaugccaaauagaucggcuaauacacguaucuuccuggcugagaaaccacucacaauuucagggguacguaggacagcgagguggccgaucucagguauccuacuauccagcagaaaacagcuacagccgguggagcggacugcucucuccgugcgacgcggacuggcuaggaaugcuagucguaaagaaagccaaaggaagugacaugaucgucccagggcccucguacaaaggcaaagucuucuucgagagacccaccuucgauggauacguaggauggggcugcggaucaggaaaaagccgaacagagagcggggaacuauguagcucagacaguggaacaucguccgggcuucugccgagcgaccgcguccuauggaucggcgacgucgccugccaaccaaugaccccgauaccagaagaaaccuuccuagaacuuaagagcuucagccaaagcgaauuucccgauaucugcaagaucgacggcauaguauucaaccagugugaaggagagucccucccccaacccuucgacgucgccuggauggaugucggacauagccacaaaaucauaaugagggagcacaaaaccaaguggguccaagagucaagcagcaaggacuucguuugcuacaaagaaggaacaggaccauguuccgaaucggaggagaaaaccugcaaaaccagcggcucaugccgaggcgauaugcaauucugcaaggucgcagggugcgaacacggagaagaagcaucggaagcaaaaugucgcuguagucugguacacaagccgggagagguaguaguaucauacggcggaaugcgaguacgaccgaagugcuacggauucucgcgaaugauggcgacacuagaagucucgcaacccgagcagaggaucgggcagugcaccggaugccaccuagagugcauaaacggcggcguccgccucaucacccucacgagcgagcuaaaauccgcgacggucugcgcaagccacuucuguucgucggcaaccuccggaaagaaaagcacagaaauacaguuccacuccggcagcuuagucggcaagacugcgauccacguaaaaggagcccuaguagacggaaccgaguucacguucgaaggcucaugcauguucccugacggaugcgacgcagucgacugcacauucugccgagaguuccucaaaaacccacaaugcuacccagcuaagaaguggcuguucaucaucauagucauccuacucggauacgccggccugaugcuacuuaccaauguccucaaggccaucggcgucuggggaagcuggguaauagcaccugucaagcucguuuucgcaauaaucaagaaacuaaugcgcgccgucucaugccuaauggggaaacuaauggaccgcggcagacaagugauacacgaagaaauaggagaaaaccgggaaggcaaccaagacgacgucagaaucgaaauggccaggccacguagagucagacacuggauguauagcccagugauccucacuauccuagccaucggccucgcugaggggugcgacgagaugguucacgccgacucaaaacucgucuccugcagacagggaagcgguaacaugaaagagugcguaaccacggggagagcccuacuaccggccguaaaccccggccaggaggccugcuugcauuuuaccgcacccggaagccccgacuccaaaugccucaaaauaaaaguaaagcgcaucaaccugaaaugcaagaaaagcagcagcuacuucguccccgaugcaagaagcggguguacaagcgugaggcgcugcagaugggcaggcgacugccagucaggaugucccccacauuucaccagcaacagcuucagugaugauugggcggggaagauggaucgcgccggacucggguucuccggaugcagcgacggaugcggcggagcagcaugcggcugcuucaacgcagcaccaagcugcaucuucuggcggaaauggguagaaaacccccaugggaucauauggaaagucagccccugcgccgccugggugcccucugcugugaucgagcucaccaugccaucgggcgaagugcgcacauuccaccccaugucaggaauaccaacacaaguauucaaaggagucucagucacauaccucggcagcgacauggaaguauccgggcucacagaccucugcgagaucgaagaacuaaaaucaaagaaacuugcccucgcccccugcaaccaagccggcaugggagucgugggaaaaguaggcgagauccagugcagcucggaagaaagcgcccgcacaaucaagaaggacggcugcauuuggaacgcggaccuggucgggauugaacuccggguagacgacgcagugugcuacucgaagaucacaucaguugaagccgucgcgaauuacuccgcaauccccacgacaauaggcggacuacgguucgagcguucgcacgacagccagggcaagauaaguggcagcccacuggacauaaccgcgauaagggguucguucuccgucaauuaccgaggccuucgccuaagucucuccgaaaucaccgcgaccugcacuggagaaguaaccaacgucucaggcuguuacagcugcaugacaggugccaaagucuccauuaagcugcacucgagcaagaacuccaccgcacauguacgcugcaaaggagacgagacagcauucucaguccuagaaggaguccacaguuacagcguaagccuauccuuugaccacgccguaguagacgaacaaugccaacucaacugcggcggacacgaaagccaagucacucugagaggaaaccuuauauucuuagacguaccuaaauucgucgacgguagcuacaugcaaacguaccacuccaccguccccaccggagccaacaucccgagucccaccgacuggcugaacgcgcuguucggcaacggcuugagucgauggauacucggaguaaucggagugcugcugggcggacuggcacucuucuuccuaaucaugagccuguuuaagcucgggacaaagcagauauucaggagccgcacaaaacucgccuaa

SEQ ID NO: 16559 - RNA, 3222 nt, Artificial Sequence
  derived and/or modified CDS sequence (opt11) from SFTSV/Huaiyangshan virus(2010-WSQ)__HQ419235.1__GP
augaugaaaguaauuugguucucaucccuaauaugccucguaauccaaugcuccggagacucuggcccaauaauaugcgcaggccccauccacagcaauaaauccgcaggaauaccccaccuacuaggauacucugagaaaaucugccaaauagaccgacucauccacgugagcucgugguugaggaaccacucgcaauuucaaggcuacgucggacaaagaggcgggaggucccaagucuccuacuaccccgcagaaaauagcuacagccgauggucagggcuccuaucaccgugcgacgccgacugguuagggaugcugguggucaaaaaggcaaaagaaagcgacaugaucguaccaggacccucguacaaaggaaaaguauucuucgaaagaccaacguucgacggauacguaggauggggcugcggcucgggaaaaagccgaaccgaaaguggagaacuguguaguucagacaguggaacaagcaguggacuucuacccucugaucggguacucuggauaggcgaugucgccugccaacccaugaccccaauccccgaagaaaccuuccucgagcuaaagagcuuuucccaaagcgaguucccagacaucugcaaaauagacgggaucgucuucaaccagugcgagggcgaaagccugccccagcccuucgacguagcauggauggaugugggacacucacauaaaaucaucaugcgugaacacaaaacaaaauggguccaggaauccagcucuaaggacuucguaugcuacaaagaagggacgggcccgugcuccgaguccgaggagagagcgugcaagacaucugguuccugccggggcgacaugcaauucugcaaaguggcuggcugcgaacacggcgaagaggcaucagaagcgaaaugccggugcagucucguccacaaaccuggcgaagucgucguauccuacggaggcaugcgcguacgcccaaaaugcuacgguuuuagcagaaugauggccacacuggaagugaacccgcccgaacaacgcaucggacagugcacaggcugccacuuggaaugcauuaacggaggaguacgccucauaacgcuaacgucggagcuacgcagcgccacggugugcgccagccacuuuugcagcucggccaccucaggcaagaaaucaacagaaauacacuuccacuccggaucacugauagggaaaacugccauccacguaaaaggagcgcucguagacggcaccgaguucaccuucgaaggauccugcauguucccggacgggugcgacgccguagacugcacauucugcagagaguuccuuaaaaacccgcaaugcuacccagccaagaaauggcuauucaucauaauagugauccuucugggguacgccggcuugaugcuccugacgaacgugcuaaaagccauaggcgucuggggcagcuggguaaucgcaccuguuaaacucauguucgccaucaucaagaaacuaaugcgaaccguauccugccucgucgguaaacuaauggaccgggggcgccaggugauccacgaagaaauaggcgagaacggcgaaggcaaccaagacgauguaaggaucgagauggcacgaccacgaagaguccgacacuggauguacaguccggucauacugacaauccuggcgauaggccuggccgaagauugugacgaaaugguacacgccgacagcaaacucgucucauguagacaaggauccggaaacaugaaagagugcauaaccacaggcagggcccuccucccagccguuaaccccggccaagaagccugccuacauuucaccgcgccuggaaguccggauucaaaaugucucaagaucaaaguaaagagaaucaaccuaaaaugcaagaaaagcuccagcuacuuugucccggaugcccgcagcagaugcaccagugugagacgaugccgcugggcgggcgacugccagaguggaugucccccucacuuuaccagcaauagcuucagcgacgauugggcgggcaaaauggaccgugcaggacuaggauucagcggcugcagcgauggcugcggcggggccgcaugcggcugcuucaaugcagcuccgucgugcauauucuggagaaaauggguggaaaacccccacgguauaauauggaaagugagccccugcgcggcauggguccccagugcaguaaucgaacugaccaugcccucaggagaaguacggacauuccaccccaugagcggaauccccacacaggucuucaaaggaguaagcgucacguaccugggcucggacauggaaguaagcgggcucacagaccugugcgaaauagaggaacucaaauccaagaaacucgcacuagcaccuugcaaccaagcaggcaugggcguaguaggcaaagucggagagauccagugcagcagugaagagagcgcaagaacaaucaagaaagacggcugcauauggaacgccgaccugguaggcaucgagcuaagggucgaugaugcaguauguuacucaaaaauaaccucagucgaagccguagcgaacuacagcgcgauccccacaacaauaggcgggcucagguucgaaaagucgcacgacagccagggcaaaaucucuggaagcccccuagauauaaccgccauaaggggaucauucagcguaaauuacagagggcuaagacugagccuaagcgagaucaccgcuacgugcacaggcgaggucacaaacguguccgggugcuauuccugcaugacaggcgccaaaguaagcaucaaauuacacucauccaaaaauagcacagcccacguccgcugcaagggagacgaaaccgcauucuccguccucgaaggaguucacucguacaucgugucccucagcuucgaccaugccgucguugacgagcaaugccagcuaaacugcggaggccacgaaucacaagugacacucaaaggcaaccuaaucuuccucgaugucccaaaauuugucgacgggucauacaugcagacguaccacuccacuguaccaacaggagccaacaucccaagcccgacagauuggcucaacgcguuauucggaaacggacuaucacgauggauacucggggucaucggaguccuccugggaggacuagcccuauuuuuccuaaucauguuccuacugaagcuaggaaccaagcaaguauuccgcucucgaaccaagcucgcauaa

SEQ ID NO: 16560 - RNA, 3222 nt, Artificial Sequence
  derived and/or modified CDS sequence (opt11) from SFTSV/Huaiyangshan virus(2010-WWG)__HQ419231.1__GP
augaugaaggugauaugguucucaacacucauaugcuucguaauacagugcucaggugacaguggaccaauaaucugcgcagggccgauacacucgaacaaaagcgcggacauaccgcaccuacugggguauagcgagaaaaucugucaaauagaccggcuaauccacgucagcuccuggcugagaaaucacucccaauuccaaggcuacgucggacaaagagggggcaggucccaaguuagcuacuaccccgccgaaaauagcuacucacgaugguccggccuacuaucccccugcgacgcagacugguuagguaugcucgucgucaagaaggccaaagguucagacaugauagugcccgggcccagcuacaaagggaaaguauucuucgaaagaccaacguucgacggcuacgucggguggggauguggcagcgggaaaucacgcacggaguccggcgaacucuguaguagcgacagcggaacaagcucaggccuccuaccaagugacaggguccuguggauaggcgacgucgcaugccagccgaugacccccauaccugaggaaacauuccucgaacucaaauccuuuagccaaucagaguuccccgacauuuguaaaauagacggcaucgucuuuaaccagugcgaaggcgaaagccucccgcagcccuuugacguagcauggauggacgucggccacagccacaaaauaaucaugcgagaacacaaaaccaaauggguacaagaaucauccagcaaagacuucguaugcuacaaagaaggcacgggcccgugcagcgaaucagaggagaaaaccugcaaaaccagcggcuccugcagaggcgacaugcaauucugcaaaguagcggggugcgaacacggcgaagaagcaagcgaagcaaaaugccgcugcagccucguacauaaacccggcgaaguggucguaucguacgggggcaugcgaguacgaccaaaaugcuacggauucccacgaaugauggccacccuagaaguaaaccagccagaacagcggauaggacaauguacagguugccaccucgaaugcauaaacgggggaguacgccugauaacccuuacaagcgaacugcgcucagcgacaguaugcgccagccauuucugcuccagcgcgaccagcgggaaaaagucaaccgagauacaguuucacucaggcucccuggucggcaagacggccauacacguaaagggggcacugguugacgggacagaguucaccuucgaaggcucgugcauguucccggacgggugcgacgccguagacugcacuuucugccgggaguuccucaaaaacccacaauguuaccccgccaagaaauggcuacuaaucauaaucguaauacuccugggguacgccggacucaugcuacuaaccaacguacucaaagcgaucggaauauggggaagcugggugauagccccgguaaaacucaucuucgccauaauaaagaaacucaugagagcagucagcugccuuaugggcaaauugauggaccgcggacgccaaguaauacacgaaggcaucggggaaaaccgcgaaggaaaccaagacgacguccgaauugaaauggcgaggccgcgacgugucaggcacuggauguacucacccguaauucucaccauccucgccauaggucuugccgaaagcugcgacgaaaugguccacgccgacagcaagcuagucagcugcaggcaaggaagcggcaacaugaaagaaugcguuaccaccggacgggcacuccucccagcaguaaacccggggcaagaagcaugccuacacuucacagcucccggauccccagacagcaaaugucucaaaaucaaagucaaaagaauuaaccuaaaauguaagaaauccagcagcuacuucguccccgacgcccggucacgaugcacaagcguacgaagaugcagaugggcgggagacugccaauccggguguccaccccacuucaccagcaauuccuucucagacgacugggcagggaaaauggacagagcugggcuaggcuucuccggaugcucugacggaugcggcggagcagccugcggcugcuucaacgcugccccaagcugcaucuucuggaggaaaugggucgagaacccccacggcauaaucuggaaagucucucccugugccgcauggguccccucagcggucaucgagcugaccaugcccaguggagaagugcgcaccuuccaccccaugucggggauuccuacccaaguguucaaaggcgucagcgucacguaccucggauccgacauggagguaucaggacuaacggaccuaugcgaaauagaggaacugaaaucuaaaaagcucgcacucgcacccugcaaccaggccggcaugggcguggucggaaaagucggcgaaauacaguguagcucagaagaaucagcaagaacaauaaagaaagaugggugcauauggaacgcagaccuaguagggaucgaacucagagucgacgacgcaguaugcuacagcaaaaucaccagcgucgaggccguagccaacuacagcgcuauaccaacaaccaucggcggacuaagguucgagcgcagucacgacucccaaggaaaaaucuccggcagcccccuagacauaacagcgauccgagggaguuucagcgucaacuacaggggacuccgacuaagccucucagaaaucacagcgaccugcacgggagaaguaaccaacguaagcggaugcuacucauguaugacaggugccaaaguaucaauaaagcuacacucaagcaaaaacagcacagcgcauguccggugcaagggagacgagacugccuuuagcguccuagaaggaguacacuccuacacaguaagccucagcuucgaccacgccgugguagacgaacaaugucaauuaaauugcggaggacacgaaagccaaguaacccugaagggaaaccugaucuuccuagauguaccaaaauucguagacgggucauacaugcagaccuaccauucaaccguccccacuggcgcaaacauccccucccccacagacuggcucaacgcacuguucggcaauggacuaagccguuggauacucggcguaaucggaguccuacuaggaggacuggcgcuauucuucaugaucaugucacuguucaagcucggcacaaaacaaguauucagaucccgaacaaagcuagcauaa

SEQ ID NO: 16561 - RNA, 3222 nt, Artificial Sequence
  derived and/or modified CDS sequence (opt11) from SFTSV/Huaiyangshan virus(2010-WWX)__HQ419232.1__GP
augaugaaagucaucugguucagcucgcucaucugcuucgucauacaaugcuccggugacucggggcccaucauaugugccgggcccauacacucuaacaaguccgcugauaucccgcaucugcucggauacucagaaaagauaugucagauagacagacuaauccacgucagcucguggcuacgcaaccacucccaauuccagggauacgugggccaacgcggcggacggagccaagucucguacuaccccgcggagaacaguuacuccagauggucaggccuacuaucucccugcgacgcagacuggcucgggaugcuagucguuaagaaagcuaaaggcuccgacaugauagugcccggacccucauacaaagggaaagucuucuuugagcgaccgaccuucgauggcuacguaggauggggcugcggcucgggcaaaagcagaacagaguccggcgaacugugcagcagcgacagcgguacaucaaguggacugcuaccaucggacaggguucucuggauaggagacgucgcuugccagcccaugacgccaaucccagaggagaccuuccuugagcucaagagcuuuucucagucugaguucccggacaucugcaaaauagacggcauuguauucaaccagugcgaaggcgaaagccucccacagccauucgacgucgcauggauggacgucggccacucccacaaaauuauuaugagggaacacaagacgaaguggguucaggaaucuucaucaaaagacuucgucugcuacaaagaaggcacgggaccuugcucagaaucagaggagaaaacgugcaaaaccuccggcucaugcaggggagacaugcaauucugcaaaguagccgggugcgaacacggggaagaggcuuccgaagccaaaugccgaugcagccuaguucacaaaccuggcgaaguagucgucucguacgggggaaugcgaguccgccccaaaugcuacggauucucccgcaugauggcgacacuggaaguaaaccaacccgaacaacggauaggccaguguacuggcugcuuacucgaauguaucaacggaggcguccgccucaucacgcugacgagcgagcucaaaagcgcgaccguaugugcaucccauuucugcagcagcgccacauccgggaagaaaagcacggaaauacaauuccacucagguucgcucguaggaaaaaccgcaauacacguaaaaggagcacucaucgacggaacggaauuuacauucgaaggcaguugcauguucccagacgggugcgacgccguggacugcaccuucugcagagaguuccuuaaaaacccccaaugcuaccccgccaagaaaugguuguucaucaucaucguaauccuccuaggguacgcggggcuaaugcuccucacaaacguacuaaaagcuauaggcaucuggggcaguugggucauugcgccaguaaagcugauauucgcaauuaucaaaaagcucaugcgaaccguuaguugccucaugggaaagcuaauggaucgaggacgccaggucauccacgaagagauaggagaaaaccgagaggggaaccaggacgauguacgaaucgaaauggcacgaccaagaagagugagacacuggauguacaguccagucauucuaacgaucuuggccaucgggcucgccgaauccugcgacgaaauggugcacgcugacucaaagcuaguuagcugccgccaaggcagcggcaacaugaaagaaugcgugaccaccggcagggcauugcuaccagccgugaaccccggucaagaagcgugccuacacuucaccgcgcccgggaguccagauagcaaaugccuaaagaucaaggucaaacgcauaaaccuaaaaugcaagaaauccucaaguuacuucgucccagacgcacggagccggugcaccagcgugcgacgaugccgaugggcaggcgacugccaauccgggugucccccucauuucacaucaaauuccuucagcgacgacugggcggggaaaauggaccgggccggccucggauucucagggugcuccgacggcugcggaggcgcagcauguggcugcuucaaugcggcacccucuugcauauucuggcgaaaaugggucgaaaacccacaugggauaaucuggaaaguaucacccugcgccgccuggguuccaucagcagugaucgaguuaaccaugccaagcggggaagugcggaccuuccaccccaugagugggauuccgacccaaguauuuaaaggagucucggucacuuacuugggcucagacauggaagucuccggacuaacagaccugugcgagaucgaagaauugaaaagcaaaaagcucgcccucgcccccugcaaccaagccggcauggguguuguaggaaaggucggagaaauacaaugcucaagcgaagagagcgcacgcacgauuaagaaagacggcugcaucuggaacgcggaccuagucggcaucgaacuaaggguugaugacgcugucugcuauucaaaaauaaccucgguagaggcaguagcaaacuacucggcaauaccaaccacaauaggcggucuacgguucgagcgaagucacgacagccaaggcaaaaucucgggcucuccccuggacaucaccgcaauccgcggaucguuuucagugaacuaccgagggcucagacuaucauuauccgaaaucacggccacaugcaccggugaggucacgaacgugaguggaugcuacuccugcaugacgggggcaaaagugagcauaaaauugcacucgucuaagaacuccacagcgcacgugcgaugcaaaggcgacgagacagcguucagcguacucgaaggcguccacagcuacaccgugagucucucuuucgaccacgcuguaguugacgaacaaugccaacucaauugcggaggacacgaaagccaagugacuuuaaaaggcaaccucaucuuccucgaugucccaaaauucguagacggaucauacaugcaaaccuaccauagcacggucccgacuggggcaaacaucccaagcccgacagauuggcugaaugcgcuguucggcaacggccucagccgcuggauacucggugucauaggcgugcuacugggaggacuagcccucuucuucaugauuaugagccucuucaagcucggcaccaagcaaguauuuaggagcagaacaaagcucgcguag

SEQ ID NO: 16562 - RNA, 3222 nt, Artificial Sequence
  derived and/or modified CDS sequence (opt11) from SFTSV/Huaiyangshan virus(2010-ZGQ)__HQ419233.1__GP
augaugaaagucaucugguucaguucacuaauaugucuagucauacagugcggaggagacacgggccccaucaucugcgcgggcccgacacacagcaacaaaucggcagauaucccgcacuugcucggauacucagagaaaauaugccaaaucgacaggcucauucacguaagcuccuggcuccgaaaccacucccaauuccaagguuaugucggacaacgcggaggccgcagccaagucucauacuacccagcagaaaacuccuauagucgauggucuggauuacucagcccaugcgacgcagacuggcucggaaugcuggucgucaaaaaggccaaagguucagauaugauaguacccggaccauccuacaaggguaaaguauucuucgaacgaccaaccuuugacggcuacgugggauggggcugcggauccggcaaaagccggacagaaagcggagaacuuugcucauccgacucagggaccucuagcggacuguugccguccgaccgaguucuguggauaggggaugucgcgugccagcccaugacacccauaccggaagaaaccuuucuagagcucaaauccuucucccaaagcgaguucccagacaucugcaaaauagacggcauagucuucaaccagugcgaaggggaaagccuaccgcaaccauucgauguagcauggauggacguagggcauucacacaagaucauaaugcgagaacacaaaacaaaguggguacaggaaucguccagcaaagacuucgucugcuacaaagaaggaacgggaccaugcucagaaucugaagagaaaacaugcaaaaccucaggcucaugccgcggcgacaugcaguucugcaaaguagcugggugcgaacauggcgaagaagcaucggaagccaaaugccgcugcagccuggugcacaaacccggagaagucgugguaucguacgggggcaugcgcguacgcccuaaaugcuacggcuucagccgaaugauggcaacacuggaaguaucucaaccagaacaacgaaucggccaauguaccggcugccaccucgaaugcaucaaugguggaguacgccugaucacccuaacgagcgaacucaaaucagccacgguaugcgcaagccauuuuugcagcuccgcaacaagcgggaaaaagagcacggaaauccaauuccacucgggcuccuuagucggaaaaaccgccauccaugucaagggggcacucgucgacggcacggaguucacauucgaaggcagcugcauguucccggacggcugcgacgcuguagacugcacauucugcagggaguuccuaaagaacccacaaugcuaccccgcaaagaaguggcuauuuauaauaguaguaauucugcugggcuacgcaggacugaugcuacucaccaauguacucaaagcaaucggcguguggggaagcugggucauagccccaguuaaacugguguucgcaaucauuaagaaacuaaugagagcagucaguugccuaaugggaaaacuuauggaccgaggacgacaggugauacacgaagaaauaggcgaaaaccgagaagggaaccaggacgauguccggauagagauggcucgaccgcgaagaguaagacacuggauguacuccccagucauacuuaccaucuuagcaaucggacucgcagaaggaugcgacgaaaugguacacgcagacucaaaacucgucucgugcagacaggggagcgggaacaugaaagaaugcguaaccacagggagggcacuuuuaccugccgucaacccgggccaggaagcgugccuacacuucaccgcgccugguagcccagacuccaaaugccucaagauaaaggucaaacgaauaaaucugaaauguaaaaagucaucgucauacuucguccccgacgccagaagccguugcaccuccguacggagaugccgcugggcgggggacugucaauccggaugcccgccccacuucaccagcaacagcuucucagacgacugggccggcaaaauggaccgggcagggcucggauucuccggaugcuccgacggaugcggcggagcagcaugcgguugcuucaacgcggcacccagcuguauauucuggcgaaaaugggucgaaaauccccacgggaucauauggaaagucagccccugcgcagcaugggugcccagcgcagucaucgaacugacaaugcccagcggggaaguaagaacguuccacccaaugagcgggauucccacacaaguauucaagggaguaagcguaacauaccuaggaucggacauggaaguaagcggacucacggaucuaugcgagaucgaggaacucaaaucgaaaaagcuagcgcuggcgccaugcaaccaagcaggaaugggggucgugggaaaagucggcgagauacaaugcagcagcgaggaaucagcacgaaccaucaagaaagacggcuguauauggaaugcggaucucgucggcauagagcuccggguagacgacgcaguaugcuauuccaaaaucacuucagucgaggcaguggccaacuacagcgcaaucccaacaaccaucgguggccucagauuugagcgcucacacgacucacaaggaaagaucagcggcaguccccuggacauuaccgcaauaagaggcucauucagcgucaacuaccggggccuccgccucagccuaagcgaaaucacggcaacgugcaccggcgaaguaacaaauguaagcggcugcuauagcugcaugaccggagcgaaagugagcauaaaacuacacucaucgaaaaauuccacagcccacgugcgcugcaagggcgacgagaccgcauucuccguacucgaaggaguccacagcuacucaguaagccucucauuugaccacgcagucguagacgaacagugccaacuaaauuguggagggcacgagucacaggucacacuacgcggaaaccuaaucuuccucgacguaccaaaauucguagacggcucguacaugcaaaccuaccacagcaccgucccaacgggagccaacauaccgucccccacggacugguuaaacgcccuauucggcaacgguuugagccgguggauccuaggagugaucggaguacuacuaggcggucucgcccuauuuuucuuaaucaugucacucuucaaacuaggcacgaaacagauauuccgaucccgcacgaagcucgccuag

SEQ ID NO: 16563 - RNA, 3222 nt, Artificial Sequence
  derived and/or modified CDS sequence (opt11) from SFTSV/Huaiyangshan virus(M-HZM)__JF951393.1__GP
augaugaaaguaauuugguucagcagccuaaccugccuagugauccaaugcagcggggauuccggacccaucaucugcgcagggcccauacacucaaauaaaagcgccggaaucccacaucuccuaggguacucagagaaaaucugucaaauugacagacucauccacguaagcucguggcuaaggaaccacagccaauuccagggauacguaggccaacgcggaggacgcagccaggucucauacuaucccgcagaaaacuccuacagucgguggucaggacuacucagcccaugcgacgcagacuggcuagggaugcucguaguaaagaaagcaaaagaauccgauaugaucguaccgggacccuccuacaaaggcaaaguauucuucgaaaggccuaccuucgacggcuacguaggcuggggcugcgggucagguaaaucucgcacggaauccggcgaacucugcucaagugacucaggcacguccagcggccuacucccauccgaccgaguacucuggaucggugacguggcgugccaacccaugaccccaauaccagaagaaaccuuccuagaacucaaauccuuuagccaaucugaguucccagacaucugcaaaauugacggcauagucuuuaaccagugcgaaggcgaaucccucccccaaccauucgacguggccuggauggacgucggccacagccacaaaauaauaaugcgcgagcacaaaaccaaauggguacaggaaagcucauccaaagacuucguaugcuacaaagagggaaccgguccauguuccgaaucagaggagaaagcgugcaaaacaagcgggaguugccgaggagacaugcaauucugcaaaguagcgggcugugaacacggagaagaggcaagcgaagcaaagugucggugcucccuaguacacaaacccggugaaguggucgucucauacgggggaaugcgaguuagaccuaaaugcuacggauucuccagaaugauggccacauuggaaguaaacccacccgaacaacgaaucggccaaugcacuggcugccaccucgagugcauaaacggaggcguccgccucauaacgcuaaccuccgagcuaaggagcgcaacagucugcgcgucccacuucugcuccuccgcaacuucaggcaagaaaaacacagaaauacacuuccauucaggcagcuuaguaggaaaaaccgccauccacgugaagggcgcacucgucgacggcacugaguucaccuucgaaggguccugcauguuccccgacggcugcgacgccgucgacuguacguucugccgagaguuccugaaaaacccccagugcuaccccgcuaagaaauggcuauucauaauaauagucauacuccuuggauaugcaggcuuaauguugcugacgaacguccuaaaagcaauaggugucuggggcucauggguuaucgcacccguaaaacuaauguuugcaaucauaaagaaacugaugcgaacgguauccugccuaguaggcaaacucauggaccgaggccgccaagugauccacgaagaaauaggcgaaaacggagaaggaaaucaagaugacguacgcaucgaaauggcacgccccagacgcgugcggcacuggauguacagcccagucauacucacuauccuagccaucggccuagccgaaggaugugacgaaaugguacacgccgacagcaaacucguaucaugcagacaagguuccggaaacaugaaagaaugcaucacgaccggacgcgcacuacuaccagcuguaaacccggggcaggaagccugccuacacuucacagccccaggcucccccgacagcaaaugucucaaaauaaaagucaaacgaaucaaucucaaaugcaagaaauccagcucauacuucgugcccgacgcgagaucccgcugcaccagcguaaggcgcugccggugggcuggcgacugccaaagcggcugcccaccgcauuucacaucaaacuccuucuccgacgacugggccggaaaaauggacagggcugggcuuggcuucucgggcugcagugacggcugcggcggagcugcgugcggaugcuucaacgcagcgccauccugcauuuucuggcgcaaaugggucgaaaacccccacggcaucaucuggaaagucagcccuugcgccgcaugggucccauccgccgugaucgaacugaccaugccaucaggcgaaguacgcaccuuccaccccaugucaggaauccccacacaggucuucaaaggagugagcguaacauaccucgggagcgacauggaaguuagcggacuaacggaccuaugcgaaaucgaggaacuaaaaagcaaaaagcuagcgcucgccccaugcaaucaagcuggcaugggaguagucgguaaagucggcgagauccaaugcagcagcgaagaaucggcccgcacaaucaagaaagacgggugcauauggaacgccgaccuagucgggaucgagcugcgcguagacgacgccgucugcuacuccaaaaucacgagcguagaagcuguagccaacuacagcgccauacccaccaccaucggaggacuccgauucgaacgaagccacgacucacaaggaaaaauuagcggauccccgcuagacaucaccgcaauccguggauccuucucggucaaccuuagaggacuccgccucucacucagcgaaaucacagcaacaugcaccggcgaggucacaaacgucucgggcugcuacucuugcaugacaggcgccaaagugucuaucaaacuccacucaagcaaaaacagcaccgcucauguccgaugcaaaggcgaugagaccgccuucucuguucuagaaggcguccacucuuacauaguaagccuauccuuugaccaugccguggucgacgagcaaugccagcucaacugcggaggucacgagucucaagugacacucaagggcaaccuaaucuuccucgacgucccaaaguucgucgacggcaguuacaugcaaaccuaccacucgacagucccaacaggagcaaauauacccucaccgacagacuggcugaacgcucuuuucggcaacggccuaagccgauggauacuagguguuauaggcguccugcuaggaggacucgcucuguucuuccuaauaauguuccuccucaaacuaggcacaaagcagguauuccgaucacgcaccaaacucgcauaa

SEQ ID NO: 16564 - RNA, 3222 nt, Artificial Sequence
  derived and/or modified CDS sequence (opt11) from SFTSV/Phlebovirus(AH15/China/2010 strain AH15)__HQ141593.1__GP
augaugaaagucaucugguucuucucccugauuugccuagucauacagugcgguggagacacagggccgauaaucugcgcaggaccgauccacagcaacaaaagugccgacaucccgcaccucuuggguuacagcgaaaagauaugccagaucgaccggcugauacacguaaguucguggcuaaggaaccauucccaguuccaaggguacguaggacaaagagggggcagaagccaagucucguacuaccccgcggaaaacuccuauucaagauggucgggcuuacucagcccaugcgacgcagauuggcuaggcaugcucgucguaaagaaagcgaaaggaucagacaugaucguacccgggccaagcuacaaaggcaaagucuucuucgaacggccgaccuuugacggauacgucggguggggcugugggucaggaaaaagccgaacagagagcggggaacugugcagcagugacuccggcaccuccagcggacuucugccaagugacagaguccuguggauuggcgacguagcaugucagccuaugaccccgauaccggaagaaacguuccuagaacuaaagagcuuuagccaaucagaguucccagacauaugcaaaaucgacggcauaguauucaaccagugcgaaggugaaucguuaccacaacccuucgacguagcuuggaugggaguagggcacagccacaaaaucauaaugagagaacacaaaacgaaauggguacaggaauccagcucaaaagacuucguaugcuacaaagaaggcacgggacccugcagcgaaucagaagagaaaaccugcaagaccagcggcucgugccgaggagacaugcaauucugcaaaguggccggaugcgaacacggagaagaagcaagcgaagcaaaaugucgaugcucccuaguucauaagccaggcgaaguagugguuucauacggaggaaugcgagugagacccaaauguuacggguucucgcggaugauggccaccuuggaagugaacgaaccagagcaaaggauaggacaaugcacaggaugucaccucgaauguauaaacggaggcguccgacugauaacccuaacaagcgaacucaagagcgcaaccguaugcgccucccacuucugcucauccgccacaagcggaaagaaaagcacggaaauacaauuccacucaggcagccucguaggcaaaacagcgauccacguaaagggggcacucguggacgguaccgaguucacauucgaaggcuccuguauguucccggauggcugcgaugcaguggacugcacuuucugucgggaauuucuaaagaacccgcaaugcuacccugcaaagaaaugguuauucaucauaauuguaauacuacuaggguacgccggccuaaugcuacugaccaacgugcugaaggcaaucggagugugggggucauggguaaucgccccuguaaaacuggucuucgcgaucauaaagaaacuaaugcgagcgguaucaugccuaauggggaaacuaauggaccgaggucggcaagucauacacgaagaaaucggagaaaacagagaggggaaccaagacgauguccgaauagaaauggcgagaccacgccgcguacgacacuggauguacagucccgucauacuaaccauccuagccaugggccucgccgaaggaugugacgaaaugguacacgcggacucgaagcuggugucaugcaggcaaggaagcggcaacaugaaagagugcguaaccacgggcagagcgcuacuaccggcagugaauccgggacaagaagccugucuacauuucacagcgcccggcucaccagacucgaaaugucucaagauaaaaguaaagcgcauaaaccuaaaauguaagaaaagcagcuccuacuucgugccggacgcccgaagccggugcacgucagugcggcggugccggugggcaggagacugccaaagcggaugcccgccccacuucacgagcaacaguuuuagcgacgacugggccggaaaaauggacagagccggacucggguucucgggcugcucggacggcugcggcggcgcagcaugcgggugcuucaacgcggcacccagcugcaucuucuggcgcaaauggguagaaaacccgcacgggaucaucuggaaagucaguccgugugcagcgugggucccaagugccgugaucgaacucacaaugccaucgggagaagugcgaacuuuccacccgaugagcgggaucccaacacaagucuuuaaaggagucucugucacguaccucggaucggacauggaaguaucaggucucacagaccugugcgagaucgaggaacucaaaagcaagaaacucgcgcuagcgccauguaaccaagcaggaaugggcguggugggcaaagucggggaaauacaauguagcagcgaagaaagcgcaagaacgauaaagaaagacggaugcaucuggaacgcagaucuggugggaauagaacucagagucgacgacgcggugugcuacuccaaaaucacaagcgucgaagcgguggcaaacuacucagcaauaccgaccaccauaggaggacugcgguucgaacgcagccacgacagccaaggcaaaauaucgggcuccccgcuggacauaacagcgauaagaggaucuuucagcauaaacuaccgaggccuccgccugagccugacagaaauaacagccacgugcaccggggaagucacgaacguaaguggcugcuacagcuguaugacaggagccaaaguaagcaucaaauugcacucgagcaaaaacuccacagcccacguacgaugcaaaggggaugagacagcuuuuagcguucuagaaggaguucacagcuauagcgugagcuuaaguuuugaccacgcaguagucgaugaacagugucagcuaaacugcgggggccaugaaagccaagugacacuccgggggaacuuaaucuuucuagacguccccaaauucguggacggcagcuauaugcaaaccuaccacagcaccguaccaacaggggccaacaucccgagcccaacugacuggcugaacgcucucuucggaaacggccuuagucgcuggauccuugguguaaucggaguacucuugggcgggcuagcguuguucuuccucaucaugucccuguucaaacuaggaacaaagcaaguguuccgaagcagaacaaaacucgcguga

SEQ ID NO: 16565 - RNA, 3222 nt, Artificial Sequence
  derived and/or modified CDS sequence (opt11) from SFTSV/Phlebovirus(HN6/China/2010 strain HN6)__HQ141596.1__GP
augaugaaaguaauaugguucagcucacuaauaugcuuuguaauacaaugcaguggugacagcgggccaaucaucugcgcugggcccauccacagcaacaaaagcgcagauaucccucaccuccucggcuacagcgaaaagauaugccaaauagaccgacuaauucacgucuccuccuggcuccgcaaccacucacaauuccagggcuacgugggccaacgaggcggccgaagccaaguauccuauuaccccgccgaaaauagcuacagucgguggagcggccuacugucaccgugcgacgccgauuggcucgggaugcuaguagugaaaaaggccaaaggcucagacaugauaguaccagggccgucauacaaaggaaagguauucuucgagcgcccaaccuucgacggauacgucgguuggggcugcggaagcgguaaaagcagaaccgagucaggcgagcuaugcuccucagacagcgggacauccaguggccuguugccaucugaccggguccucuggaucggcgacgucgcaugccaacccaugacaccgauaccggaagagaccuuccucgagcuaaagaguuuuagucaaucagaguuccccgauaucugcaaaauugacggaaucgucuuuaaccaaugcgagggagaauccuuaccacaacccuucgacguggcauggauggacguaggccacagccacaagauaaucaugcgagaacauaaaaccaaauggguacaagaaucaaguagcaaagacuucguaugcuacaaggagggcacaggacccugcagcgaaagcgaagaaaagacgugcaagaccagcggcaguugccgaggcgacaugcaauucugcaaaguagcaggaugugaacacggggaagaggcuucggaggcaaaaugccgaugcagucucguacacaaaccuggggaagucgucguaagcuacggaggaaugcgcguccggccaaaaugcuacggauucucccgaaugauggcaacacucgaaguaaaccaacccgagcaacgcauagggcaaugcacagggugccacuuagaaugcauuaacggagggguacgacucaucacccugacgucagagcuaaagagugcgaccguuugcgcaucacacuucugcagcucagcaacgucugggaaaaagagcaccgaaauccaguuccacucgggaagucuaguaggaaaaacggcgauacacguaaaaggagcacucguagauggaaccgaguucacauucgaaggcagcugcauguuccccgauggaugugacgccgucgacugcaccuuuugcagggaguuccucaaaaacccacagugcuaccccgcuaagaaauggcuauucaucauaaucgucauccuacugggauacgccggacuaaugcuauuaacgaacguccuaaaagccauaggcaucuggggauccuggguaauugcgccagugaaacugauauucgcgaucaucaaaaagcuaaugcgcacaguaagcugccuggucggaaaacucauggaccgaggccgacaagucauacaugaagaaauaggcgaaaaccgagaaggaaaccaggacgaugucagaaucgaaauggcgcgaccccggcggguccggcauuggauguacaguccagucauacugacaauccuagccauaggccuagcagaguccugcgacgagaugguccacgcagacucaaagcugguaucaugccgccagggguccggaaacaugaaggaaugcgucaccacaggaagggcacuucuccccgccgucaacccaggacaagaagcaugccuucauuucaccgcacccggcagccccgacagcaaauguuugaagauaaaagucaaacgcauaaaccugaagugcaagaaaagcucgucauacuucguaccagacgcaagaaguaggugcacgagcguacguagaugccgcugggccggcgacugccagagcgggugcccaccccacuucacaagcaacucuuucagcgacgacugggcgggaaaaauggaucgagccggacugggguucagcggcugcagcgacggaugcggcggagccgccugcggaugcuucaacgcagccccgagcugcauuuucuggcgcaaauggguagagaacccacacggcauaauauggaaagugagcccgugcgcggcgugggucccaagcgcgguaauagagcucaccaugccaagcggggaaaugcgaacguuccacccaauguccgggauuccaacacaaguauucaaaggcguaagcgucacauaccuaggcucagacauggaagucaguggacuaacggaccuaugugagauugaggagcuaaaaucaaagaaacuagcacucgccccaugcaaccaagccgggauggggguagugggcaaagucggggaaauacaaugcaguagcgaggaauccgcacgaacaaucaagaaagaugggugcaucuggaacgcagaccuaguaggaauagaacuccgagucgacgacgccguauguuacagcaaaaucaccagcguagaagccguggccaacuauucggcgauaccaaccaccauaggcggccuuagauucgagcgcagccacgacagccagggcaaaaucucuggaucaccacuggacauaaccgccauaagaggcuccuucagcguaaacuacagaggccuucgacugucccuaucagagauaaccgcaacaugcacaggcgaagucacaaacgucagcgggugcuacucuugcaugacaggcgcaaccguaucaauuaaacuacacaguagcaaaaacagcacagcccacgugcgcugcaaaggcgacgaaaccgcguuuagcguacucgaaggcguacacagcuacacagucagccuaucguucgaccacgccgucguagacgaacagugccaacucaacugcggcggacacgaaagccaagugacacucaaaggaaaccucaucuuccucgacguccccaaauucgucgauggaagcuacaugcagacauaccauuccacagugccgacgggcgcaaacaucccgagcccaacggacuggcuuaacgcauuauucggaaacggccugagccgguggauccucggcgugaucggcgugcucuugggcggacuagcccuauucuucaugauaaugagccuauucaagcucggaacuaaacagguauucaggucccgaaccaaacucgccuga

SEQ ID NO: 16566 - RNA, 3222 nt, Artificial Sequence
  derived and/or modified CDS sequence (opt11) from SFTSV/Phlebovirus(JN1/China/2010)__JN258706.1__GP
augaugaaagucauuugguuuucaucccucauaugccucguuauacaaugcagcggagacucaggccccaucauaugcgcgggaccuauccacuccaacaaauccgccgggauaccgcaucugcuaggguacucggagaaaauaugccaaauagaucgacucauccacgucucaucauggcuaagaaaccacucucaauuucaaggauacgugggccagaggggaggcaggucccaagucucauacuaccccgcagaaaauagcuacagucgcugguccggacugcuaucaccaugugaugcagacuggcuaggaaugcuaguaguuaaaaaggccaaggaaucagacaugauaguacccggaccaucguacaaaggcaaaguauucuucgagagaccaaccuucgauggguacguaggcuggggcugcggaagcggaaagagcagaaccgagagcggggaacugugcucaagcgauagcggcacgucauccggacuccuaccuucggaccgggugcuauggauaggcgacgucgcaugccaacccaugacaccaauucccgaagagaccuuucucgaacuuaagagcuuuucccagagcgaguuccccaacauauguaagaucgacggaaucgucuuuaaccaaugcgagggagaaucacucccccaacccuucgacguagcauggauggauguagggcacucacacaaaauaauaaugcgagaacacaaaaccaaauggguccaggagagcagcagcaaagauuucguaugcuacaaagaagguacagggcccugcuccgagagcgaagaaaaagcaugcaaaacaucgggaucaugcagaggcgacaugcaauuuugcaagguagcaggcugcgaacacggggaagaggcuucagaagcgaaaugccguugcucccuaguccacaaacccggcgaagucgucgucucuuacggaggcaugcgcguccgccccaaaugcuacggauucucgcgcaugauggcgacgcuagaaguaaacccaccagagcaaaggaucggacaaugcacaggcugccaccuugaauguauaaacggcggcguuagauuagucacacuaacgagugaacucagaagcgcuacagugugugcaucccacuucugcucaucggcaacgagcggaaagaaaagcacggagauacacuuccacuccggcucccucgugggaaaaacagcgauacacgucaaaggagcguuaguugacggcaccgaguucacguucgaaggaucgugcauguucccagacgggugugacgcgguagacuguacauucugccgagaguuccucaaaaacccgcaaugcuaccccgccaagaaguggcuauucaucaucaucgugauccuacuaggguacgcgggcuuaaugcuacuaacaaacgugcucaaagccauaggcguguggggcagcuggguaauagcccccguaaagcucauguucgcaauaaucaaaaagcucaugcgaaccgucuccugccucguaggcaaauugauggaccgagggcgacaggucauacacgaagaaauaggcgaaaauggcgaaggaaaccaagaugacgucagaauagaaauggcgcgcccacgacgaguucgccacuggauguacagcccaguuauacugacgaucuuagccaucggucuggcagaagguugcgacgaaauggugcaugccgauagcaaauuagucuccugccgccaaggaagcggaaacaugaaagaauguauuacaacggggagagcacuacuacccgcggugaacccaggucaggaggcuugcuuacacuuuacugcccccggaagcccagacagcaaaugucuaaaaaucaaagucaaacgaaucaacuugaagugcaagaaaucaucaagcuacuucguaccagacgcacggagcagaugcaccagcguacgucgguguaggugggcaggagacugccagucaggaugcccgccccacuucaccagcaauagcuuuagcgacgacugggccggcaaaauggauagagccgggcuagguuucucaggaugcagcgauggcugcggaggagcagccugcggaugcuucaacgcagccccguccugcauauucuggcgaaaauggguagaaaacccacaugggaucauauggaaaguaucaccuugcgcagcaugggugccuucagccgucaucgaacuaacgaugcccucaggagaaguacgcacguuccaccccaugagcggaauaccgacccagguguucaaagggguaucuguaacguaccugggauccgacauggaagugagugggcugacggaccugugcgagauagaggaacuuaaaucgaagaaacucgcgcuagcgcccugcaaucaggcuggaaugggaguggucggcaaaguaggagaaauacaaugcaguuccgaagagucugcaagaacgauaaagaaagaugguugcauauggaacgccgaccucgucggaaucgagcuccggguagacgacgcagucugcuacucaaaaauaaccucggucgaagcuguagccaacuacucagcaauucccacgaccaucggagggcuccgguucgaaagaucgcacgacucacagggcaaaaucagcggcuccccacuagacauaaccgcaauacggggaucuuucucggucaauuaccggggacuccgccuauccuugucagaaaucacggcuacuugcacgggcgaagucacgaacguuagugguugcuacagcuguaugaccggagcaaaagucagcauaaaacuccacucuuccaaaaacucaacagcacacguccgaugcaaaggagacgaaaccgcauucucaguccuaaaaggaguccacucauacaucguaagccucucuuucgaucacgccgugguugaugagcagugccagcuaaacugcggcggccacgaaucucaaguaacccucaaaggaaaccuaaucuuccuagacguaccaauauucgucgaugggucauacaugcagaccuaccauucgacggucccgaccggggccaacaucccguccccgaccgacuggcugaaugcacucuucgguaacgggcugagccgauggauacucggggucauaggcguacuacucggcggacuagcacuauuuuuccucaucauguuccuacuaaaacuaggcacaaaacagguguuucgaagcagaaccaaacuggcauga

SEQ ID NO: 16567 - RNA, 3222 nt, Artificial Sequence
  derived and/or modified CDS sequence (opt11) from SFTSV/Phlebovirus(JS2010-014)__JQ317170.1__GP
augaugaaggugauaugguuuagcuaccucaucuguuucgucauccaaugcucaggagacucggggccaauaauaugggcagguccgauacauagcaacaaauccgcagacauaccccaccuccucggauacagcgagaaaaucugccagauagaccgccuaauacacgucagcuccuggcuacgaaaccacucacaguuccagggguacgucggccagcgcggaggaagaagccaggucucauacuacccugccgaaaacagcuauuccagauggaguggacuacuaucaccaugcgacgccgacuggcucggcaugcuggucguaaagaaagccaaaggaucggacaugaucgucccagguccgucauacaagggaaagguauucuuugaacgcccaaccuucgacggcuauguaggcuggggauguggcucggggaaaagccgaaccgaaagcggggaacucugcagcuccgacucaggcaccaguuccggcuugcucccaagcgaccgcguccucuggaucggcgauguugccugccagccaaugacaccgauacccgaagaaacguuccuagaacuaaaaaguuucagccaaagugaguucccagacauaugcaagauagacgggauaguuuucaaccagugcgaaggagaaagccugccacaaccuuuugacguggccuggauggauguagggcacagccauaaaauaauaaugcgagaacacaagacaaaauggguacaggaaagcagcucgaaggauuucguaugcuacaaagagggaacaggcccaugcuccgagagcgaggagaaaaccugcaaaacauccgggagcugccgcggcgacaugcaguucugcaagguggcuggaugcgaacacggcgaagaagccucggaagcuaaauguaggugcagccuaguacacaaaccgggagaagucguugucucauacggugguaugcgcauacgacccaaauguuacggcuucucacgaaugauggcgacccuagagguaagccaacccgagcagcgacucggacaaugcaccggaugccaccuagaaugcauaaacggaggcgugcggcugauaacacuaaccagcgaacuaaaauccgcgacggucugcgcgucccacuucugcucguccgccacaagcgggaagaaaagcacggaaauacaauuccacagcggcagccuagucgggaaaacggcaauccacgugaaaggcgccuugguggacggcacggaauuuacguucgaaggaucaugcauguuccccgacggcugugacgcaguggacugcaccuucugcagagaguuccugaaaaacccacaaugcuaucccgccaagaaauggcucuuuauaaucauagugauacuccucggcuacgcaggccuaauguuacucacaaauguccuaaaggcgaucggaauauggggcucaugggucaucgcgccgguaaaacucauguucgccaucaucaagaaauugaugaggaccgugagcugccucaugcgaaaacugauggaccgagggcgacaggucauucaugaagagauuggagaaaacagaguaggaaaccaggacgacgucaggaucgagauggcgcgcccccgacgaguaagacauuggauguacagucccgucauccugaccauccuggcaaucggccuagcagagagcugcgacgaaaugguacacgcagacucgaagcuaguuagcugccgacaaggaagcgggaacaugaaagaaugcguaacuacaggccgggcccugcucccagccgugaaccccggccaagaagcgugccuccauuucaccgcuccaggaagccccgacagcaaaugccucaaaauaaaaguuaagcggauaaaccucaaaugcaagaaaaguucaagcuauuucgucccugacgcgaggagccgaugcacauccguacgccgguguaggugggcaggagacugccagagcggaugucccccacacuucacaucaaacucauucagcgacgacugggcgggaaaaauggaccgagcaggccugggcuuuucgggaugcagcgacggcugcgggggagccgccugcggcugcuucaacgccgcacccaguugcaucuucuggaggaaauggguugaaaauccccacgguauuaucuggaaaguaucaccuugcgcagcauggguaccaucggcaguaauagaacucaccaugcccagcggcgaagugcgcaccuuccacccgauguccggaaucccgacccaagucuucaaaggaguaucggucaccuaccucgggagcgacauggagguaagcggacuaacagaccuaugcgaaauagaagaacuuaaaagcaagaaacucgcucucgccccuugcaaucaggcgggaaugggcguagucggaaaaguaggcgaaauccaaugcucauccgaagagagcgcgcgcacuaucaagaaagacggaugcauuuggaacgcagaucucguuggaaucgaacuaagagucgacgacgccguaugcuacuccaaaaucacuagcguggaagcagucgccaacuacagugccauccccacaacgaucggcggccuccgcuucgaacgcucacacgacagucaagggaaaauuucaggaucaccacuugacauaacagcaauacgagggagcuuuagcgucaacuacagaggacuacgccucucacuaagugaaaucacggcaacaugcaccggagagguaacgaacgugagcgggugcuacagcugcaugacaggcgccaaagucucaauaaaauuacacucauccaaaaauagcaccgcgcacguacgcugcaaaggagaugaaacggcauucuccguccuggaaggaguacacuccuacaccgucucacucagcuucgaccacgcaguggucgacgaacagugccagcucaacugcggcggacacgaaucccaagugacuuuaaaaggaaaucugaucuuccuggacguaccgaaauucguggauggcucauacaugcaaacauaucacagcaccguccccaccggagccaacauaccgagccccacagacuggcuuaacgcacuguucggaaacggucucagccgauggauacuaggagucaucgggguacuccuuggagggcuagcccucuucuucaugauaaugagucuguucaaacuuggcacaaaacaagucuuccgaagccgaacaaaacucgccuag

SEQ ID NO: 16568 - RNA, 3222 nt, Artificial Sequence
  derived and/or modified CDS sequence (opt11) from SFTSV/Phlebovirus(JS2010-015)__JQ317173.1__GP
augaugaaagucauaugguucagcucacucauaugcuucguaauacaaugcagcggagacuccggcccgauaauaugugcaggaccaauccacagcaacaaaucggcggacauaccccaccuccuagguuacuccgagaaaauaugccaaaucgaccgacuaauccacgucagcagcuggcuaagaaaccauucacaauuccaaggcuacguaggccaacgcggcggccgaucgcagguauccuacuaccccgccgaaaacuccuacagccgguggucgggacuacugagcccaugcgacgcagacuggcucggcauguuagucgugaagaaagccaaaggauccgacaugauaguccccggaccgucguacaaggguaaagucuucuucgaaagaccgaccuucgacggcuacguaggcuggggaugcggcuccggcaaaagccggaccgaaagcggggaacucugcuccagcgacucagggaccucaucaggucuacuaccaagcgaccgcgucuuauggaucggcgacguagccugccaacccaugaccccgauuccggaagagaccuucuuagagcuaaaaaguuucagccaauccgaguucccagacaucugcaaaaucgacggaaucguauucaaccaaugcgaaggagaaagccucccacagcccuucgacguugcauggauggacguaggacacucacacaaaaucauaaugcgagaacacaaaaccaaauggguccaagaaucaucgagcaaagacuucgucugcuacaaggaagggacgggccccugcucagaauccgaggagaaaaccugcaaaaccucaggcagcugccggggcgauaugcaguucuguaaaguagccggcugcgaacauggagaagaagcaucggaagcgaaauguagaugcagucucguucacaaaccgggcgagguaguugucaguuacggaggaaugagaguacgcccaaaaugcuacggcuucagcagaaugauggcaacauuggaggucaaccaacccgaacaacggaucgggcaguguacaggaugccaccuagaaugcauaaacggcgggguccgccucaucacgcucacaagcgaacucaaaagcgcgaccguuugcgcuagccacuucugcagcagcgccacuuccggcaaaaagagcacggaaauacaauuccacucuggcucguugguaggaaagaccgcgauacacgucaaaggagcacugguagacgggacagaguucaccuuugaaggaucuugcauguucccagacggaugcaacgcggucgacuguacauucugccgagaauuucucaaaaacccacaaugcuacccggcuaagaaauggcuguucaucauaauugucauccuccugggauaugcaggccuaauguuacucacuaacguucugaaagcgauaggcaucuggggauccuggguaauagcaccaguaaaacucauguucgcgauaaucaagaaacuaaugcguacgguaucaugcuuaaugggcaaacugauggaccggggacgacaaguaauacacgaagaaauaggagagaacagggaaggaaaccaagacgauguccgaauugaaauggcacgcccaaggagagugcgucacuggauguacagccccgucauacugacauuccuggccaucggccuggcugaaaguugugacgaaaugguucacgcagacucaaaacuggugucaugcagacaaggcagcggaaacaugaaggagugcgucacaaccggccgagcgcugcucccggccgugaacccgggccaagaggcuugccuccauuuuaccgcacccggcagcccugacucaaaaugccucaaaaucaaggugaagcgaauuaaccugaaaugcaagaaaaguuccagcuacuucguacccgacgcccgaagccguugcaccucaguaaggaggugccgaugggccggcgacugccaauccggaugucccccacauuuuaccucgaacuccuucagcgacgacugggcggguaaaauggacagggccggccugggcuucagcggcugcagcgauggcugcggcggagcggccuguggcugcuucaacgcggcgccaucaugcaucuucuggagaaaaugggucgaaaacccacacggcauaauuuggaaaguauccccuugcgccgcuuggguccccucggcaguaauagaacuaaccaugccauccggugaagugcgaacguuccaccccaugucagggauccccacccagguauucaaaggcgucucgguaacguaccuagggucagacauggaagugagcggccuaacagaccuaugcgaaauugaagaacucaaaagcaagaaauuagcgcuugcgcccugcaaccaagccggaaugggagucguaggcaaagucggggaaauccaaugcaguucagaagagucagcacgaaccauaaagaaagacggcugcaucuggaacgcagaucuggucgggauagaacugcggguagacgacgccguaugcuacucaaaaauaacauccguagaggcaguagccaacuacuccgccauucccacaacuauaggaggccugagguucgagagaagucacgacagccagggaaaaaucuccggcagcccacuagacaucaccgccauaaggggaucguucuccguaaacuacagaggacuacgacuaagucuaagugaaauaacagccacuugcacgggcgaagucacaaacgucagcgggugcuacagcugcaugaccggcgccaaaguuuccaucaaacuccauucauccaagaacagcaccgcacacguccgaugcaaaggagacgaaacagccuucucaguccuagaagguguccacagcuacaccguuagcuuaaguuucgaccacgccguaguugacgaacagugccaacucaacugcggcggacacgagucgcaagucacccucaaagggaaccuaaucuuccucgacgucccgaaauucgucgacgggagcuacaugcaaacauaccauagcacugugccaacaggggccaauaucccuagccccacagauuggcucaaugcgcuauucgggaacggccuaaguagauggauucucgggguaaucggcguucuccucggaggucuugcccuauucuucaugauaaugagccucuucaagcucgggacgaaacaggucuuccgcagccgcaccaaacucgcauag

SEQ ID NO: 16569 - RNA, 3222 nt, Artificial Sequence
  derived and/or modified CDS sequence (opt11) from SFTSV/Phlebovirus(JS2010-019)__JQ317179.1__GP
augaugaagguaaucugguucucaucccuaaccugcuucgucauucaaugcagcggagacuccggccccaucaucugcgcaggcccuauccacagcaacaaaagcgcugacaucccccaccuccugggcuacagugagaaaaucugccaaauagacagacuaauccauguaagcucuuggcuccgcaaccacagccaauuucaaggauacgucggccaacgcggaggacggagccaaguguccuacuacccggcagagaacucauacucgagaugguccgggcuacugucgcccugcgaugccgacuggcucggcaugcucgucguaaagaaagccaagggcagcgacaugauuguacccggacccuccuacaagggcaaagucuuuuucgagcgaccaacauucgauggauacgucgguugggguugcggcuccggcaagagccgaaccgaguccggagaacucugcuccagcgacucaggaacaagcagcggccugcugccgucagaccgcgugcuauggauaggggacguugcgugccaaccaaugacccccauacccgaagaaaccuuccuagagcucaagucauuuucccaaagugaguucccagacauaugcaagaucgacggcaucgucuucaaccaaugugaaggcgaaagccucccgcagccauucgacguagcauggauggacgucgggcacucgcacaagaucauaaugcgcgaacacaaaaccaaauggguccaagaaucaagcagcaaagacuucguaugcuauaaagaaggaaccggccccugcucggaaucagaagaaaagacaugcaagaccagcggaagcugccgcggggacaugcaguucugcaagguggcaggcugcgaacacggcgaagaggccagcgaagccaaauguaggugcagccugguacacaaaccaggagaagucguagucucauacggcggaaugaggguaaggccaaaaugcuacggcuucucccggaugauggcaacccuagaagugaaccaaccagagcaacgacuaggacaaugcaccggaugccaccuagaaugcauaaacgggggagugcgacugaucacccuaacaagcgaacucaaauccgccaccgucugcgcaagccacuuuugcagcucggccaccuccggcaagaaaagcacagaaauacaauuccacagcggcucgcucgugggaaaaaccgccauacacgucaaaggggcacucgucgacggaacugaguucacauucgagggcuccugcauguuuccagacggcugcgacgccguagacugcaccuucugccgugaguuccucaaaaacccacaaugcuauccagcaaagaaauggcuauucaucaucauagucauccugcugggauaugcaggacuaaugcucuuaacgaacguacucaaagccauaggcaucugggggaguuggguaauagccccugucaaacuaauguucgcaauaauuaaaaagcugaugcguaccguauccugccucaugcgaaaacucauggacaggggcagacaagucauacaugaagaaauaggcgaaaacagagagggaaaccaagacgacguaagaaucgagauggcaagaccgcgucgcgugagacacuggauguacagcccagucauccucaccauacucgccaucggccuagccgaaucaugcgacgaaaugguccaugccgacagcaaacuuguaucaugccgccagggaucaggaaacaugaaggagugcguaaccacgggcagagcccugcucuccgcgguaaaccccggucaagaagcaugcuugcacuucacagcacccggauccccagacuccaaaugccugaaaauaaaggucaagcgcaucaaccuaaaauguaagaaaagcucaucuuacuucgucccagacgcccgcucccgcuguacaagcgugcgacgauguaggugggcaggagacugccaauccggaugcccaccacauuucaccucaaauagcuucagcgacgacugggcaggcaaaauggacagagccggccuuggauucucgggcugcucagacggcugcggcggagccgccugcggaugcuucaacgccgcaccaagcugcauauucuggcgaaaaugggucgaaaacccgcacggaauuauauggaaagugagccccugugcagccuggguacccucagcggucauugaacuaacaaugcccagcggggaagucagaacguuccauccaaugucugggaucccaacccagguauucaaaggcguauccguaaccuaccucggcucagacauggaaguaagcggacuuacagaccuaugcgaaaucgaagaguugaaaaguaagaaacucgcgcucgcucccuguaaccaagcaggaaugggagucguaggcaaagucggcgaaauacaauguucuucagaagaaucagcaagaacaauaaagaaagacggcugcaucuggaacgcagaccugguaggcauagaacuacgagucgacgacgcggucugcuacagcaaaaucacuucaguagaagccguagcgaacuacucagcaauaccaacaacuauaggaggcuuacguuuugaacgaagucacgacagccaagggaaaauaucggguagcccacucgacauaacagcaauaagaggcuccuucagcgucaauuacagaggccugcgcuuaagccuaagcgaaaucacagcgaccugcacgggagaggugacaaacguguccgggugcuacagcugcaugaccggcgccaaaguaagcauaaaacugcacucaucgaaaaacagcaccgcccacgucagaugcaaaggcgacgaaaccgcguucagcguccucgaagggggucacagcuacacggucucccucucuuucgaucacgccgugguagacgaacaaugccaacucaauugcggcggccacgagucacaggucacccucaaaggcaaccucauuuuccucgacgucccaaaauucguagauggguccuacaugcagaccuaccacagcacuguaccgaccggcgcgaacauaccaucacccaccgacuggcuaaacgcccuauucggaaacggucuaucgcgcuggauacuaggugucauaggaguacuccugggcgggcuagcacuauucuucaugaucaugagucuauucaaacucggaacaaaacaaguauuucggagucggacaaaacucgccuaa

SEQ ID NO: 16570 - RNA, 3222 nt, Artificial Sequence
  derived and/or modified CDS sequence (opt11) from SFTSV/Phlebovirus(JS24)__HQ830164.1__GP
augaugaaagucauaugguucucaucgcugaucugccuagucauacagugcggcggggacacgggaccaauaauaugcgcaggaccuauccacagcaauaaaagcgccgacauaccacaucuacucggauacagugaaaagauaugccaaauagacaggcuaauccacgucuccucauggcugcgaaaccacagccaguuccaaggauacgucggacagcgcggaggcagaagccaaguaucauacuaccccgcagaaaauucauacagcagauggucaggcuuacuuagcccgugcgaugcagacuggcucgggaugcugguagugaagaaagcuaaaggcucggacaugaucguaccgggucccucauacaaagguaaaguguucuucgaacgcccaacguucgacggauacguaggauggggaugcggguccgggaagagucguacagaaaguggagaacuaugcucaagugacagcgggaccucaagcggacuacugccaucagaccggguccucuggauuggugacguagcaugccagcccaugaccccaauaccggaggaaaccuuccucgaacuuaagagcuuuucccaaagcgaguuccccgacauaugcaaaauagacgggauaguguucaaccaauguggcggcgaaucccucccccaaccguucgacguggccuggauggacgucggacacagccacaagaucaucaugagggaacacaaaacgaaguggguacaggaaucauccagcaaagacuucgucugcuacaaggagggcacgggaccaugcagugaaagugaagagaaaacaugcaagaccucaggcuccugcagaggcgacaugcaauucuguaagguagcggguugcgaacacggagaagaggcaagcgaagcuaaaugccgcugcagccuaguccacaaaccuggcgagguagucgucagcuaugggggcaugcgugugagacccaaguguuacggguucagccgaaugauggcaacccucgaaguuaaccaacccgaacaaagaauaggacaaugcacuggaugccaccuagaaugcaucaacggaggaguacgucucauaacccucacaagcgaacuaaagagcgccaccgugugugcaucacacuucugcagcuccgcaacgaguggcaagaaaucaaccgagauacaauuccacucaggcagccucguaggcaaaacagccauccacgucaaaggggcccucguggacgggacagaguucaccuucgaaggaucgugcauguucccagacggaugcgacgcuguagacugcaccuucugcagagaguuccucaaaaacccccaaugcuacccagcaaagaaauggcuuuuuaucaucaucgugauacuccuaggauacgcaggacucaugcuacugaccaacguacucaaagcgaucggcgucuggggaagcuggguaauagcacccgugaaacucguauucgcaaucaucaagaagcugaugagagccgugucuugccucaugggcaaacuaauggaccgggggagacagguuauccacgaagaaauaggugaaaacagagaaggaaaccaagacgacguccgcaucgaaauggcacggccccgccgggucaggcacuggauguauagcccugucauacuaacaauacuggcaauaggccuggcagagggcugcgacgagauggugcacgccgacagcaaacugguuucaugcagacaaggauccggaaacaugaaggaauguguaaccaccggcagggcccuccucccagcagugaauccaggacaggaagcgugcuuacacuucaccgcacccggcucccccgauucaaaaugccucaagaucaaaguaaagaaaauaaaccuaaaaugcaaaaagagcucaucauauuucgugccagaugccagaagcagaugcacuuccgugcgaagaugccggugggcuggagacugccaaagcggaugcccgccacacuucacgagcaacagcuucagugaugacugggcaggcaaaauggaucgagcaggucuaggguucucaggaugcuccgacggaugcggaggcgcugccugugggugcuucaacgcggcccccagcugcauauucuggagaaaguggguagagaacccccacggaaucauauggaaggugagccccugcgccgcauggguacccucggcuguaaucgaacuaaccaugcccagcggagaaguccgcacguuccaccccaugaguggaauaccaacccaagucuucaaaggggucagcgugacauacuuaggaagcgacauggagguaagcgguuuaaccgaccucugcgaaauagaagaacuaaaaucgaaaaagcucgcguuagcacccuguaaccaggcaggaaugggcgucgucggcaagguaggcgaaauccaaugcucaucagaagagagcgcccguaccaucaagaaagacggguguauauggaaugccgaccugguugggaucgagcuccgggucgacgacgcggucugcuacuccaaaauaacaagugucgaggcuguagcaaacuacucggcaauccccacgacgauaggagggcuccgguucgaaagaagccacgacagucaaggcaaaauaucgggcucaccacucgacauaaccgcaaucagggggagcuucucgguaaacuacagaggacugcgccuaucccugagcgagaucaccgcaacaugcacaggagaagucaccaacgucucaggaugcuacuccugcaugacaggggcaaaagugucaauuaaacuacacagcagcaagaauaguacggcccacguacgcuguaaaggggacgaaacagcguucucggucuuggaaggaguacacagcuacagcguaagucuaucauuugaccacgccguuguggaugaacaaugccaauuaaacugcgggggccaugaaucccacgugacccucaaaggcaaccucauauuucuggacguaccgaaauucgucgacggcucauacaugcaaaccuaccacagcacaguuccaaccggugcaaacauaccgucgccaaccgacuggcucaacgcccuauucggaaacggauuaucacgcuggauccuaggaguuauaggcgugcuacuaggcggccucgcacuauuuuuccugauaaugucccucuucaaacugggaacgaaacaaguguucagaagccgaacaaagcuagcauga

SEQ ID NO: 16571 - RNA, 3222 nt, Artificial Sequence
  derived and/or modified CDS sequence (opt11) from SFTSV/Phlebovirus(JS4/China/2010 strain JS4)__HQ141605.1__GP
augaugaaggucauaugguucucaucacuaaucugcuucgucauacaaugcucgggcgauucagguccgaucaucugcgcaggccccauccacagcaacaaaagcgcggacaucccccaccuccuaggguacagcgaaaagauaugccaaauagaccgccuaauucacgugagcagcuggcuacgaaaccacucacaguuccagggauacgucggacagagaggcggccgaagccaaguuagcuacuaccccgcagaaaacagcuacagccgguggagcggccuguuaucacccugcgacgccgacuggcuaggaaugcuggucgucaaaaaggcgaaaggaucagacaugaucguaccagggcccucuuauaaaggcaaaguauucuucgagcgccccacauuugauggguacguaggcuggggcugcggguccggcaagucacggaccgaaagcggcgagcucugcucaagcgacagugggacaucguccggccuguugccauccgacaggguacucuggaucggugaugucgccugucaaccaaugacccccauacccgaggaaacuuuccuagaacucaagagcuucucccaauccgaguuccccgacaucugcaaaauugauggaaucgucuucaaccagugcgagggcgaaucccuuccacagcccuucgacgucgcauggauggacguagggcacucgcacaaaaucaucaugcgagagcacaaaacaaaauggguacaggaauccagcuccaaagacuucguaugcuacaaagaagggacaggccccugcucagagucagaagagaaaaccugcaaaacaagcggcagcugcaggggagauaugcaguucugcaaagucgccggaugcgaacauggcgaagaagccuccgaagcgaaaugccgauguagccuaguccacaagccgggcgaagucguagugucauacggaggcaugcgcguccgaccaaaaugcuacggcuucucccgaaugauggcaacacuggaagucaacccgccagaacagaggauaggacaaugcacaggaugccaccuggaaugcaucaacggcggcguacgacugaucacacucaccagcgaacugaaauccgccaccgucugcgccucacauuuuugcaguagcgcgacaaguggcaaaaagagcacagaaauccaauuccacagcggaagucuaguaggaaaaaccgcaauacacgucaaaggcgccuuggucgacggaacagaguucaccuuugagggcucaugcauguuuccagaugggugcgacgccguggacugcaccuucugccgugaguuccuaaagaacccgcagugcuacccagcgaagaaauggcuauucaucauaauaguaauauuacuaggauaugcaggccucaugcuacuaacaaaugucuuaaaagccauaggcgucuggggaagcugggucaucgcuccgguaaaacuucuauucgcaauaauaaagaaacuaaugcgcacgguguccugccuaaugggaaaacucauggacagaggucgccaaguaauacacgaagaaaucggagaaaaccgcgaaggaaaucaagaugacguccggauagaaauggcacguccaagacggguccgccacuggauguacucaccagucauacuaacaauccuagccauaggauuggccgaaggaugcgaugaaaugguccaugccgacucgaaacucgugagcugccgccagggcucagaaaauaugaaagaaugcgugaccacagggcgcgcgcuacuaccagcggucaaccccggacaagaagccugccuccacuucacugcccccgggagccccgacucaaaaugccucaagaucaaggugaaacgaaucaaccuaaaaugcaagaaauccagcagcuauuucguucccgaugcacgaucacgcugcaccucaguccgccgguguaggugggcaggggacugccaaaguggaugcccaccacacuucacguccaacucauuuagcgacgacugggccggcaaaauggaccgagccgggcugggguucucaggaugcagcgacggcugcggcggcgccgcaugcggaugcuucaaugcagcaccguccugcaucuucuggcgcaaaugggucgagaacccacaugggauaauauggaaaguaucucccugcgcagccuggguccccucggccgugauagaacuuacgaugcccucuggagaaguucgcacguuccacccgaugucaggcaucccgacgcaagucuuuaaaggcguaucggucaccuaccucggcuccgacauggaggucagcggccucacagauuuaugcgaaauagaggaacuaaaaucaaagaaacuagcacucgcccccugcaaccaagccggaauggggguaguaggcaaagucggcgaaauacaaugcuccucagaagaaucagcacgcacaaucaaaaaggacggcugcaucuggaaugccgaucuaguaggcauagagcuccgagucgacgaugcagucuguuacagcaaaauaaccagcgucgaagccgucgcaaacuacucagccaucccaaccacaauuggcgggcuccgauucgaaaggucacacgacagccaggggaagaucagugguucaccccuagacauaaccgcgauacgcggcucauucuccgucaauuaccgaggccugcgccuaagccuauccgaaauaacagccacaugcacaggggaaguuaccaaugucagcggaugcuacucgugcaugaccggggcaaaggucucaaucaaacuacauagcuccaagaacagcacggcacauguaagaugcaaaggagacgaaacagcguuuuccguccucgaaggcguccauagcuacacggugagccuaucauucgaccaugcagugguagacgagcaaugccagcucaacugcggcggccacgaaucacaagugacacugaaaggcaaccugauauuccuugacgucccgaaguucguggacgggagcuacaugcagacguaccacagcaccguaccaaccggagccaacauacccuccccgaccgacuggcuaaaugcccuauucggcaauggacuaagccgauggauccugggaguaauaggcguccuccucggaggccuugcccuuuucuuccucauaaugagcuuguucaaacuagggacaaaacaaguauuccgaucccgaacaaaacucgcauag

SEQ ID NO: 16572 - RNA, 3222 nt, Artificial Sequence
  derived and/or modified CDS sequence (opt11) from SFTSV/Phlebovirus(JS6)__HQ830170.1__GP
augaugaaaguuaucugguucagcucgcucaucugccuaguaauccaaugcggcggggacacgggcccaauaauaugcgcuggacccauccacagcaacaaaucagcagacaucccgcacuuguuaggauacucagaaaagaucugucagaucgaucgccugauacacgucagcucguggcugcgaaaccacucucaauuccagggcuacguaggccaacgaggagggaggagccaagucuccuacuacccggcggaaaacuccuacucaagauggucaggucuucucucgccaugcgacgccgacuggcucgggaugcuggucguuaaaaaggcaaaggggagcgacaugauaguccccggccccaguuacaaaggcaaaguguucuucgaacgccccacauucgacggauacguaggcuggggcugcggauccggaaaaagcagaacagaaagcggcgagcucugcagcucagacagcggcacaagcagcggccuccugcccagcgacaggguccuauggauaggcgauguggcuugccaacccaugacaccaauccccgaggagaccuuucuagagcugaaaaguuucucucaguccgaguuccccgacauaugcaaaauagacgguauaguauucaaccagugcgaaggagaaucccucccacaacccuucgacgucgcguggauggacgucggacacagccacaagauuaucaugcgggaacacaaaacgaaguggguccaagaaagcagcagcaaggauuucgucugcuacaaagaaggaacagggccauguagcgaaagcgaagagaaaaccugcaaaaccuccgggagcuguaggggagacaugcaauucugcaaagucgcaggcugcgaacacggagaagaagcauccgaagccaaaugcagaugcuccuuaguccacaaaccaggagaagucguaguaucguauggaggaaugcgugugcgcccgaagugcuacggauucucgagaaugauggcgacacuagagguaaaugaaccagagcaaagaauaggacaaugcaccggaugccaacuagagugcaucaacgguggcguacgacuaauaacacuaaccagcgagcuuaaaagcgcgaccguaugugcgucccacuucugcuccucagccacauccggcaagaaaagcacagaaauacaauuccacagcgggucacucguaggaaaaacggccauacacgucaaaggcgcgcuaguggacggcacagaguucacguucgaaggcuccugcauguucccagacgggugcgacgccguugacuguaccuucuguagagaguucuuaaagaacccgcagugcuauccggccaaaaaguggcuauucauaauaauaguaauacuacucggauacgcaggccuaaugcuccucacaaacguacuuaaagcaauaggcguauggggcagcugggucauagcgcccguaaaauuagucuucgcgauaaucaagaagcucaugcgcgccguaucaugccuaauggggaaauuaauggaccggggaagacaagucauacacgaagaaauaggagaaaacagggaaggcaaccaagacgaugucagaaucgaaauggcacgaccuagacgcguaagacacuggauguacagcccagucauacucacgauacuggcaaugggacuggcugaaggcugcgaugagauggugcacgccgacagcaaacucguaagcugcagacaaggcagcggcaacaugaaagaaugcguaacaacaggucgggcccuccuccccgccguaaacccaggacaggaggccugccuacacuuuaccgcacccgggaguccagacagcaaaugcuuaaaaauaaaggucaagaggauaaaccucaaaugcaagaaaagcucauccuacuucguccccgacgcacgaucaagauguacaucaguaagacgcugccgaugggcgggagauugccaguccggaugucccccgcauuucacguccaacagcuuuuccgacgacugggccggaaaaauggacagagcaggucucggcuucucaggcugcuccgacgguugcggcggagcagccuguggcuguuucaaugccgccccaagcugcaucuuuuggcggaaaugggucgaaaauccgcacggaauaaucuggaaagucucaccgugcgccgcauggguacccucagcaguaaucgagcuaaccaugccaagcggggaggugcgcacauuccacccgaugucaggaauaccgacacagguauucaaggguguauccguaaccuaccucggcagcgacauggaaguguccggacuaacggaucucugugaaauugaagaacuaaaauccaaaaagcucgcacucgcccccugcaaccaagccggaaugggggucguaggaaaagucggagaaauccaguguucauccgaagagagugcacgaacgaucaagaaggacggcugcaucuggaacgccgaccuggucggaaucgaacucagggucgacgacgcggucugcuacucaaagaucacguccgucgaagcaguagccaacuacagcgcaaucccaacaacaaucggaggccuccgcuuugaaagaagccacgacagucaaggcaaaauaucaggaucaccacuagacauaacagccauccgaggaucguucagcaucaacuaccggggccuaagacuaagccuauccgaaauuacagcuaccugcaccggcgaaguuacaaacgucucgggaugcuacaguugcaugaccggcgcaaaagugaguauaaaacugcacagcuccaaaaacuccaccgcacacguacgaugcaagggagacgaaacagcauuuagcgugcuagaaggcguacacagcuacagcgucagccucuccuucgaccacgccgucgucgacgaacagugccaacuaaacugcgggggccacgaaucacaaguaacacuacgcgguaaccuaauuuuccuggacgucccgaaauucguagacggcucauacaugcagacguaccacagcacagucccaacuggcgcgaacaucccaucccccacggacuggcuaaacgcacucuucggaaacggacugagccgguggauacugggcgucauaggcguucuccuaggaggccucgcgcuuuucuuccugauaaugucccuauucaaacugggaaccaaacaagucuuuagaagccgcaccaagcuggcauaa

SEQ ID NO: 16573 - RNA, 3222 nt, Artificial Sequence
  derived and/or modified CDS sequence (opt11) from SFTSV/Phlebovirus(JSD1)__JF267784.1__GP
augaugaaggugaucugguucuccucccucaucugcuucguaauccaaugcagcggggacucuggacccaucaucugcgcgggacccauccacaguaacaaaagugccgacauaccacaccuacuaggguacucugagaaaauaugccaaauagaccgacugauccacgugucgaguuggcuccgcaaccacagccaauuucaaggcuaugugggccaacgaggaggaagaucccaagucagcuacuacccagcggaaaacucacacaguagauggagcggccuacuaucccccugcgacgcggacuggcucggcauguuggucgucaaaaaggccaagggauccgacaugauagucccgggacccucguacaagggaaaggucuucuucgaacgcccaaccuucgacggcuacguaggauggggaugcggauccgggaaauccagaacagagagcggagaacuaugcucaagcgacagcgguacaucaagcggccuacuacccucugauagaguacuuuggauaggcgacguggcaugccagcccaugacaccaaucccggaagaaacuuuucucgaacugaaaucguucagccagagcgaguucccggacaucuguaaaauagacggcauagucuucaaucaaugcgaaggugaaagccucccacagcccuucgacgucgcauggauggacgucggccacagccacaaaaucauuaugcgcgagcacaaaacaaaauggguacaggaaaguucuagcaaagacuucguaugcuacaaagaaggcaccggcccaugcucagaaagugaagagaaaaccuguaaaacauccggcuccugccggggagacaugcaauuuugcaaggucgccggaugcgaacauggagaagaagccucugaagcaaagugccgauguagcuugguccacaaaccgggcgaaguagucguuucauacggaggcaugcgaguacgucccaaaugcuacggauucucccgcaugauggccacccuugaaguaaaucaacccgaacaacgaauaggacaaugcaccgguugccaccuagagugcaucaacggaggcguccgcuuaauaacccuaacuuccgagcuaaaaagcgcaacuguaugcgccucccacuucuguagcucagccaccuccggaaagaaaagcacugaaauccaauuccacucuggcuccuuagucggcaagacggccauacacgucaaaggcgcccugguagacgggacagaauuuacguucgaagggucaugcauguucccagacggaugcaacgcgguagacugcaccuucugccgcgaguuccugaagaacccgcaaugcuacccagccaagaaauggcuuuucauaauuaucguaauacuccuuggguacgcaggauuaaugcuccuaacgaacgugcucaaagcaauaggaauauggggcagcuggguaaucgccccaguaaaacucauguucgccauaauaaagaaacucaugagaaccguaagcugccuaaugggcaaacuuauggacagaggcagacaagucauacacgaagaaaucggcgaaaaccgugaggggaaccaggacgacguccggauagagauggcacggccgcgucgaguacggcacuggauguauagcccaguaauccuaaccuuccucgcuauaggucuagccgagagcugcgaugaaaugguacacgccgacucaaaauuaguaucaugcagacaaggcaguggcaacaugaaagagugcgugaccacaggccgggcacuccuacccgcaguaaaccccgggcaggaggcaugcuuacacuucaccgcacccgggaguccagacucaaaaugccucaaaauaaaagucaaacgaaucaaccucaaaugcaagaaaagcucauccuacuucguacccgacgcccgaaguaggugcacaagcgucagaagaugccgcugggcaggcgacugccagagcggaugucccccgcacuucacaucgaacagcuucagcgacgacugggcgggaaaaauggacagagccggccuuggcuucucaggcugcuccgacggcugcggaggagcggcaugcgguugcuucaaugcagcccccagcugcauauucuggagaaaaugggucgaaaacccacacggaauaauauggaaagucuccccaugcgcugccuggguccccucagcggucaucgaacucacaaugccauccggggaaguccgcacauuccaccccaugucaggcaucccaacgcaagucuucaaaggcgucucggucaccuaccuaggcuccgacauggaaguauccgggcuuacggaccucugcgagauagaggaacucaaaucgaagaaacuagcccuagcgcccugcaaccaagccggaaugggaguagugggaaaaguaggagaaauccaaugcuccagugaagaaagcgcacgaaccaucaagaaagacggcugcauauggaacgcagaccucgucggaaucgaacuccgcgucgaugacgccgugugcuacuccaaaauuacaucaguggaagcaguagcaaacuacucagccauucccacaaccaucggaggccucagauucgagagaucccacgacagccagggcaaaauaagugguucacccuuagacauaacagcgauccgggggaguuuuuccgucaacuaccggggacuaagacuaagccucagcgaaaucacagccacaugcacgggcgagguaacaaacguaagcggcugcuauucaugcaugaccggggccaaagucagcauaaaauuacauucgaguaaaaauuccaccgcacacgugcguugcaaaggggacgagacagcauucucgguacuagaaggcguccacagcuacacagugagccuaucuuucgaccacgcggucguagacgaacaaugccaacucaauugcggcggacaugaaucccaagugacccugaaaggcaaccuaaucuuccucgacguaccaaaauuuguagacggaucauacaugcaaacuuaccauagcaccgucccaaccggcgcaaacaucccgagccccaccgacuggcugaacgcccuuuucggcaacggccugucccgcuggauccuaggaguaaucggcguacuccugggagggcucgcccucuucuucaugauaaugagccuguucaaacuugguaccaaacaagucuucaggucacgcaccaaacuagcauaa

SEQ ID NO: 16574 - RNA, 3222 nt, Artificial Sequence
  derived and/or modified CDS sequence (opt11) from SFTSV/Phlebovirus(LN2/China/2010 strain LN2)__HQ141608.1__GP
augaugaaagugauaugguucagcucccucaucugcuuuguaauccagugcagcggggacagcggacccauaaucugcgcaggucccauacacagcaacaaaucagccgacaucccacaucugcuaggauacucugagaaaaucugccaaauagaccgacucauacauguauccagcuggcucagaaaccauucccaguuccagggauaugucggccagcgcggaggccgaagccaggucagcuacuauccggccgaaaacuccuacagccgguggucgggccuccuaucaccaugugacgccgacuggcuuggcaugcuagugguaaagaaagcaaaaggcuccgacaugauaguacccggcccaagcuacaagggaaaaguguucuucgaacgccccacguucgacggcuacgugggcuggggcugcggcagcggaaaaagcaggaccgaaagcggugaacuaugcaguagcgacucaggaacgucguccggccuucuacccagcgaccgcguacucuggaucggggacgucgccugccagcccaugacaccaauacccgaggaaacguuucuggaacuaaagagcuucucacaauccgaguucccagacaucugccgaauagacggcaucguguuuaaucaaugugagggugagagucugccgcaaccauucgauguagcauggauggacguaggacacucgcacaaaauuauaaugagagaacacaagacgaaauggguccaagagucaaguuccaaagacuucguauguuauaaagaaggcacgggcccaugcagcgaaagcgaggagaaaaccugcaaaacauccggaucaugucgaggagauaugcaauucugcaaaguagcgggcugcgaacacggugaagaagcgagcgaagccaaaugccgaugcucgcucgugcacaagccaggggaagucgucguuuccuacggaggcaugcgcguccgaccgaaaugcuacggauucucaaggaugauggcgacacuggaagucaaccaacccguccaaagaauaggccaaugcacaggcugccaccucgagugcauaaauggaggagucaggcucauaacccuuaccagcgaacucaaauccgccaccguaugcgccagccacuuuugcucgagcgccacaucgggaaagaaauccacagaaauacaguuccacaguggaagucucgugggcaaaaccgccauacacguuaaaggugcccuagucgacggaacugaauuuacauucgaaggaucgugcauguucccggacggcugcgacgcgguggacugcaccuucugcagagaguuccucaaaaacccccagugcuaccccgcaaagaaauggcuauucauaauaaucgucauacuccugggcuacgcagggcucaugcugcugaccaacguccuaaaagccauaggcaucuggggcagcugggucauagcaccagucaaacucauauucgcaauaauaaagaaacucaugagaaccgucucaugccuaaugggaaaacuaauggacagaggaagacaaguaauacacgaagaaaucggcgagaaccgagaaggaaaccaagacgacgucagaauagagauggcgcgaccccgacggguccggcacuggauguacgcaccgguaauucucacgauacuagcaaugggccuagcggaaagcugcgacgagaugguacacgccgacagcaaacucguauccugccgccaaggcaguggcaacaugaaagaaugcgucacaacgggccgcgcccuacucccggccgucaaucccggacaagaagccugccuacacuucacagcaccggggucccccgacaguaaaugccugaaaauuaaagucaaacgcaucaaccuuaagugcaagaagaguucaucauacuucguaccagacgcccgcagccggugcacaagcguacguagaugccgcugggccggagacugccagucaggauguccgccccauuucacaagcaacucauucagcgacgacugggcaggaaagauggacagagcgggacuaggguucagcggcugcucagacggcugcggaggagccgcgugcggcugcuucaaugccgcgccauccugcauauucuggcgcaaaugggucgagaacccccacggaauaaucuggaaaguaucaccuugcgccgccuggguaccaagcgcggugaucgagcugaccaugccguccggggaaguaagaaccuuccaccccaugucagggauaccgacgcaggucuucaaaggagugagcguaacauaccuagggucagacauggaagucagcggucuaacggaccucugcgaaauugaagaacuaaagucaaagaaacuagcacuggccccguguaaucaagcaggcaugggagucguaggcaaagucggugaaauacaauguucgagcgaagagagcgcccgcaccauaaagaaagacggcugcauauggaacgcggaccuagucggaaucgagcuaagagucgacgacgcagucugcuacuccaaaaucaccucuguggaagcaguggcaaacuacucagcaauacccacaaccauaggaggauugcgcuucgaaagaucgcacgacagucaaggaaaaaucagcgggucaccccucgacaucacggccaucagggggagcuucucaguaaacuauaggggccuacgacugagcuuaagcgaaauaacagccacaugcacuggcgaagucaccaacgugagcggaugcuacagcugcaugacuggagccaaaguuagcauaaaacugcacucaagcaaaaacagcacagcccacguacgcugcaaaggcgaugagacagcguucucagugcuagagggaguacacuccuacaccgucagccucagcuucgaccacgcugugguggacgagcaaugccagcuuaacugcggcggacacgaaucccaagugacauuaaaaggcaaccuaauauuccuagacgucccgaaguuuguagauggcagcuacaugcaaaccuaucacuccaccguccccaccggggcaaacauaccaucaccuacagacuggcucaaugcccuauucggcaacgggcugagucgauggauauuaggcgucauaggcguacuguuaggcgggcucgcccucuucuucaugaucaugagccuguucaaacuagggacaaagcaaguuuuuagaagcagaaccaaacuggcguag

SEQ ID NO: 16575 - RNA, 3222 nt, Artificial Sequence
  derived and/or modified CDS sequence (opt11) from SFTSV/Phlebovirus(LN3/China/2010 strain LN3)__HQ141611.1__GP
augaugaaagucauuugguucaguucgcucaucugccuaguaauacaaugcggaggggacaccggacccaucauaugcgcgggcccuauucacuccaauaagucagcggauaucccgcaccuacuaggauacagcgaaaagauuugccagaucgaccgacucauacacgugagcucauggcuccgcaaccacagccaauuccaaggguacguaggccagcggggagggaggagccaggucucauacuauccugcagagaacagcuauagccgauggucaggucucuuaagucccugcgacgcggacuggcucgggaugcuggucguaaagaaagcaaagggcagugacaugaucguaccagggccauccuacaaaggcaaaguauucuucgaacggccaaccuucgacggguacguaggauggggaugcggauccggcaaaaguagaaccgaaagcggugaacucugcagcagcgacagcgguacaagcagcggccuccugccauccgaccgaguccuguggaucggugacgucgcaugccaaccaaugaccccaaucccagaagaaaccuuccuagaacugaaauccuucagccaaucagaauuuccagacauuugcaagauagacggcauaguguucaaccagugugagggcgagaguuugccucaaccauuugacguagcguggauggacguaggacacucacacaagaucaucaugagagaacacaaaacaaaguggguacaggagucauccucgaaagauuucguaugcuauaaagagggaacgggaccgugcuccgagucagaagagaaaacgugcaaaacauccggcucgugccgaggagacaugcaauucugcaaaguagccgggugcgaacacggagaagaagcaucugaagccaaaugccgaugcucccugguccacaaacccggcgaaguggucgucagcuaugggggcaugcgcguccgcccgaaaugcuacggcuuuucaagaaugauggcgacacucgaagugaaccaaccagaacaacggauaggccagugcaccgggugccaccuagaaugcaucaauggaggcguaagacugaucacacuaaccagcgaacucaaaucagcaacggucugcgcaagccacuucugcaguagcgccacaucaggaaagaaaaguacggaaauccaauuccacagcggcucacucgucggaaaaaccgccauacaugucaaaggcgcccucguagacggaacagaguucacauucgagggcucauguauguucccggauggaugcgacgcggucgacugcacauucugccgggaguuccugaaaaacccccaaugcuauccagcuaagaaauggcuauuuaucaucaucguaauccugcuaggcuacgcgggacuaaugcuacucacgaacgugcugaaagccaucggcgucuggggauccuggguaauagcuccggucaaauugguguucgcgaucauaaagaaacuuaugcgggccguaucgugcuuaaugggaaaauuaauggaucgcggacgccaagucauccacgaggaaaucggagaaaaccgagaagggaaccaggacgacguaagaauugaaauggcaagaccaagaagagucagacacuggauguacuccccggugauacucacgaucuuggcaaucggccuggcagaaggaugcgacgagauggugcacgcggacucgcgcuugguaagcugcagacaagggaguggcaacaugaaagaaugcgugacgacagggagagcacuacuaccagcuguaaacccaggccaagaagcgugccuacacuuuacagcgccuggaagcccagacucgaaaugucucaaaaucaaggucaaacgaauaaaucucaagugcaagaaaaguucaagcuacuucguacccgacgcccgcuccaggugcaccagugugagacgaugccgaugggcgggcgacugccagagcgggugcccaccccacuucacaagcaacagcuucagcgacgacugggcgggaaaaauggacagggcaggacuaggguucucaggaugcucagacggaugcggaggagccgcuugcggaugcuuuaacgcagccccaagcugcauauucuggcggaaaugggucgaaaauccgcacgggaucaucuggaaagucuccccaugcgcugcguggguacccucggccgugauagaacuaaccaugcccucaggagaaguaaggacauuccaucccauguccgggauaccgacccaagucuucaagggcguaucaguaacguaccucggcagugacauggaaguguccggacucacagaccuaugcgaaaucgaagaauuaaagaguaagaagcucgcccuagcccccugcaaccaagccgggaugggggugguuggcaaaguaggcgagauccaguguagcagcgaagagagcgcccgcacaauuaaaaaggacgguuguauauggaacgcagaccuaguuggaaucgaacucagaguagacgacgcggucugcuacucgaaaauaaccucagucgaggccguagccaacuacucagcaauucccaccacaauaggaggacuaagguucgagcgcucucacgacagccaaggaaaaauuagcggcagcccccuagacaucaccgccaucagaggcagcuucagcgucaauuacaggggucuccgacucagucuaagcgaaauaacggcgacaugcacuggagaaguaacgaacguguccgggugcuacaguuguaugaccggcgccaaagucucaauuaaacuucauucguccaaaaacucaacagcccacguacgguguaaaggggacgaaacagcuuucagcguccuggaagggguccauagcuacagcguaucacugagcuucgaccacgccgucgucgacgagcaaugccaacuaaacugcggaggucacgaaucacacguaacacuacgcggaaaccuaaucuucuuagacgugccaaaauucgucgacggcuccuacaugcaaacguaccacagcacgguacccaccggggcgaacaucccgagcccaaccgacuggcugaacgcccucuuuggaaacggacuaagccgauggauacucggagugauaggcguacuccuuggagggcuugcccuauucuucuuaauaaugagccuauucaaacucgggaccaaacaaguauuuaggucacgaaccaaacucgccuaa

SEQ ID NO: 16576 - RNA, 3222 nt, Artificial Sequence
  derived and/or modified CDS sequence (opt11) from SFTSV/Phlebovirus(SD24/China/2010 strain SD24)__HM802201.1__GP
augaugaaagucaucugguucagcagccucaucugccugguaauacagugcuccggagacuccggcccaauaaucugcgccggaccaauccacagcaacaaaucagcuggaauaccccaccuguuaggcuacuccgagaaaauaugccagaucgaccgccuaauacacgucucaucauggcuacguaaccacagccaauuccagggguacgucggccaacgcgggggccgcagucaaguauccuacuaccccgcagaaaacagcuauucaagauggucagggcuacuaucacccugcgacgcggacuggcucggaauguuggucgucaagaaggccaaggaaagugacaugauaguaccaggucccagcuacaaaggcaaggucuucuuugaaagacccaccuucgacggguacgucggcuggggcugcggaucagggaaaucgagaaccgaaagcggggaauuaugcucaagcgacaguggaaccagcagugggcuacuaccaagcgaccgaguuuuguggauaggugacgucgcaugccaaccgaugacccccaucccggaagaaacauuccucgaacucaagagcuuuagccagagugaguucccagacauaugcaagauagacggaaucguauucaaccaaugugaaggagagucccuaccacagccguucgacaucgcauggauggacgucggccacucgcacaaaaucaucaugcgagaacacaaaacaaaaugggugcaggagagcagcucgaaagacuucguaugcuacaaagagggcacgggccccugcuccgagucagaagaaaaagcauguaagacauccgggagcugccgaggggauaugcaauucugcaaaguagcaggaugcgaacauggcgaagaagcaagcgaagcaaaaugccgaugcagccucguccacaagcccggagaggucguggucucauacggaggaaugcgagugcgaccaaaaugcuacggcuucuccagaaugauggccacccuggagguaaacccgcccgaacaaagaauuggccaaugcacagggugccaccuagagugcauaaacggagguguccgauuaauaacccuuacaagugagcuccgauccgcaacagucugcgcgagccacuucugcuccucagccacaagcggaaagaaaagcacagaaauacacuuccacucaggaucccuaguaggaaaaaccgccauacauguaaagggagcccuggucgacggaacagaguucaccuuugaaggcucaugcauguucccugacggaugcgacgcaguagacugcaccuucugccgagaguuccucaaaaauccacagugcuacccggccaaaaaguggcuauucauuaucauagucauauuacugggauacgcaggccuaaugcuccucaccaacguccuaaaagccauaggcguguggggauccugggugauagcgccagucaagcucauguucgcuaucaucaaaaagcucaugcgcacgguaagcugcuuggucgguaaacugauggaccgcggccgacaaguaauacacgaagagaucggcgaaaacggcgagggaaaccaggacgacguccgcaucgaaauggccaggccgaggcgcguccgccacuggauguacaguccaguaauacucacaauucuagccaucggacuagccgaaggcugcgacgagaugguacacgcagacagcaagcucguaagcugccgacaaggaucaggcaacaugaaggaauguauaaccaccggcagagcgcuccucccagcagugaacccaggacaggaagcaugccuccacuuuacggcacccggcaguccagacucgaaaugccugaaaauaaagguaaaacgaaucaaccugaaaugcaagaaauccuccucauacuucguucccgacgccagaucucggugcacaagcguccgccgcuguaggugggcgggagacugccagagcggaugucccccgcauuucacuucaaacagcuucucagacgacugggccggcaaaauggaucgcgccgggcucggauuuagcgggugcucagacggaugcggcggugcagcaugcggaugcuucaacgcggccccaucaugcauauucuggcgcaaauggguagagaauccacacggaauaauauggaaaguauccccgugcgcagccugggucccaucugccgugaucgagcucacaaugccgagcggcgaaguacgcaccuuccaccccaugucaggaauaccgacacagguauucaaaggaguuuccgucacauaccucgggagcgauauggaagugagcggacuaacagaccuaugcgagaucgaagaacucaagaguaagaaacucgcacuagcaccaugcaaccaggcaggcaugggcgucguaggcaaaguaggggagauacaaugcucaucggaggaaagcgccagaaccaucaagaaagacgggugcauuuggaacgcagaccucguaggaaucgaacuacgagucgacgacgccguaugcuacucgaaaauaaccuccgucgaggcgguagcaaacuacagcgcaauacccacaacaaucgguggacuacgguucgagcguagccacgauucccaaggaaaaaucucaggaagcccacucgacaucaccgcaauccgcggaaguuucagugucaacuacagaggccucagacugagccuaucagaaaucacagcaaccugcacgggagaaguaaccaauguaucaggaugcuauagcugcaugaccggcgccaaaguauccauaaaacuccacucauccaaaaacuccacagcccacguuagaugcaaaggcgacgaaacagcauucuccguccuagaagggguacauagcuacaucgucucccucagcuucgaccacgcgguaguggacgaacaaugccagcucaacugugggggccaugagagccaaguaacccuaaagggcaaccugauauuccuagacguccccaaauucgucgacggcucauacaugcaaacguaccacaguaccguccccacgggagcuaauauaccuucaccgaccgacugguuaaacgcgcuuuuuggaaacggccucaguagauggauauugggaguaauaggcguacuacugggaggccuugcccucuucuuccugaucauguuucuacugaagcucgggacaaaacaaguuuuccggagccgaacgaaacuugcauga

SEQ ID NO: 16577 - RNA, 3222 nt, Artificial Sequence
  derived and/or modified CDS sequence (opt11) from SFTSV/Phlebovirus(SD4/China/2010 strain SD4)__HM802203.1__GP
augaugaaaguuaucugguucuccucccucaucugcuucguuauacaaugcuccggcgacuccggcccaaucauaugugcaggccccauucauuccaacaagucugcagacaucccccaucugcucggcuacuccgaaaagaucugccaaaucgaccgauuaauacacgucuccagcuggcuccggaaccauucccaauuucaaggauauguaggccaacgcgggggucgaucacaaguauccuacuaccccgccgagaacuccuacagcagauggucaggacuccuaucacccugcgacgccgacuggcucggcaugcucgucguaaagaaagccaagggaagcgacaugauaguacccggacccagcuacaagggaaaagucuucuucgagcgacccacauuugacgguuacgucggaugggggugcggcucgggaaaaagccgaacugaauccggcgagcuaugcucauccgacuccggaacaagcuccggccuccuccccucggaccgaguacuauggaucggugacgucgcaugccaacccaugacccccaucccagaagagaccuuccuggaacucaaguccuucucacaaucagaguucccagacauaugcaaaauagacggcauugucuucaaccaaugcgaaggcgagucgcuaccccaacccuucgacguugcguggauggacguuggacacucucauaaaauuaucaugcgcgagcacaagaccaaauggguccaagaaucaagcucaaaggacuucguaugcuacaaagaaggcaccggcccaugcucggaaucagaagagaaaacaugcaaaaccucuggcucaugccgaggcgacaugcaauucuguaaaguugccggaugcgaacacggugaagaagccuccgaggcgaaaugccgcugcucccuuguccacaagccaggagaaguagucgucuccuacggagggaugcggguucgcccgaaauguuacggauuuucgcgaaugauggccacacucgaggugaacccacccgagcaacguauaggccaaugcacaggaugccaccucgagugcauuaaugguggcguacgucucaucacccuaaccagcgagcucaaauccgccaccguaugcgccagucacuucuguucuuccgccaccaguggcaagaaauccaccgaaauccaauuccacucaggcucccuagucggcaaaaccgcaauccauguaaaaggggcccuaguggauggcaccgaguucacauuugaaggaucuugcauguuuccugacggaugcgacgccgucgacugcaccuucugccgcgaguuccugaaaaauccacaaugcuacccggccaagaaauggcuauucauaauuauaguaauucuccuuggauacgccggacucaugcugcucacuaacguucucaaagcaaucggagucuggggcucuugggucauugcgccagucaaacuacucuucgcuauaaucaaaaagcucaugcgcacgguuuccugccuaauggggaaacugauggaccgcggccgccaaguaauacacgaagaaauaggagaaaacagagaaggcaaccaggacgacguacgcauugaaauggcgcgcccccgccgaguccgacacuggauguacucaccagucauacucacuauucuggcuacagggcuugccgaaggcugcgacgagaugguucacgcagauucaaagcucgucucgugccgccaaggguccggaaacaugaaagaaugcguaacaacgggacgggcccuccuaccugccgugaacccgggacaagaagccugccuccacuucaccgcgccaggaucccccgacucaaaaugccucaaaaucaagguaaaacgcaucaaccuaaagugcaagaaaucaagcagcuacuucguacccgacgcacguucgaggugcacgagcgugcgcagaugccgcugggcaggcgacugccagucaggaugcccuccacacuuuaccucuaacagcuucagcgacgacugggccggaaagauggaccgcgcaggccuuggcuucuccggcuguagcgacggaugcggcggggccgcaugcggcugcuucaaugcggcucccagcugcauauucuggagaaaaugggucgaaaacccgcauggaaucauuuggaaaguaucacccugcgccacguggguacccagcgcaguaaucgagcucacgaugccuucaggcgaagugagaaccuuccaccccaugucaggaaucccaacacaagucuucaagggcguuucgguaaccuaccuugggagcgacauggaggucucaggccuaacagaccucugcgagaucgaggaacucaaauccaaaaagcuagcccucgcgccgugcaaccaggccggcaugggcguaaucgggaaagucggugaaauacaaugcaguagcgaagaaucagccagaaccaucaagaaagacggcugcaucuggaacgcagaccuagucggaauagaacuaagagucgacgacgcugucugcuacucuaaaaucacaucagucgaggcugucgcuaacuacuccgccauaccaacuaccauagggggacugcgauucgagcgcucacacgacagccagggcaaaaucuccggaucaccccuugacaucacggccaucagaggcagcuuuucagucaacuaccgcggacucaggcuaucccugucagaaaucaccgcuacguguacaggcgaagucacgaacguuagcggcuguuacucaugcaugacgggcgccaaagucaguauaaaacuccacuccagcaagaacuccacagcccacguacgaugcaaaggagacgaaaccgcauucuccguacucgaaggaguccacucguacacaguaucacuaucuuucgaccacgccgucgucgacgaacaaugccaacucaacugcggaggccacgaaagccagguaacccugaagggcaaccuaauauuccuagacguaccaaaauucguagauggcagcuacaugcaaaccuaucacucaaccgucccuaccggcgccaauauaccgagcccaacagacuggcuaaacgcccucuuuggcaauggacucucccgcuggauucucgguguaaucgggguccuauuaggaggccucgcccucuucuuucuaauuaugucccuauucaagcucggcacaaaacagguguuccguagccggacaaaguuagccuaa

SEQ ID NO: 16578 - RNA, 3222 nt, Artificial Sequence
  derived and/or modified CDS sequence (opt11) from SFTSV/Phlebovirus(SDYY104/China/2011)__KU239112.1__GP
augaugaaagucaucugguucaguagucugauaugucuggucauacagugcucuggagacuccggacccaucaucugcgcaggccccauccacuccaacaaaagcgcgggcaucccccaccuacuaggauacagcgagaaaaucugccaaaucgacaggcucauacauguguccuccuggcuacgaaaccacucacaguuccaagguuauguaggccagcgcggagggcgaagccaggucuccuacuaccccgcugaaaacagcuacagcagauggagcgggcuacuaucgcccugcgacgccgacuggcucggaaugcuagucguaaagaaagcaaaagaauccgacaugaucguaccagggccuagcuacaaggguaaagucuucuucgagagaccgacauucgauggguaugucggcuggggcugcggaucaggaaagagccgcacagaaagcggugaauuaugcucaagugacuccggcacaucaucaggacugcugccauccgaccggguccuauggauaggcgacgucgcaugccagcccaugacccccauaccggaagaaacauuccuggaacucaacuccuucagccaaucagaguucccagacauaugcaagauagacggcaucguauucaaccaaugcgaaggagaaagccugccccaaccauucgacguugcauggauggacguuggacacucccacaaaaucauaaugagagaacacaaaacuaaauggguccaggaauccagcucaaaagacuucguaugcuacaaagagggcaccggcccaugcucagaaucagaagagaaagccugcaaaaccuccggcagcugccggggagacaugcaauucugcaagguggcaggcugcgaacacggagaggaagccucugaagccaaaugccgcuguucccucguccacaaacccggcgaaguaguagucagcuacggaggcaugcgagucagacccaagugcuacgguuucucacgcaugauggccacgcuggaaguuaacccaccugaacaacgcauaggacaaugcacgggaugccaccucgaaugcauaaacggcggcguacgacucauaacguuaaccagcgaacuucgcagcgcgacaguaugcgcaucccauuuuugcagcucggccacaagcggcaagaaaagcacggaaauccacuuccacucaggaucacucguaggaaaaacagcgauucacguaaaaggugcguuagucgacggcaccgaguucacauucgaaggcuccugcauguucccggacgggugcgacgcaguagacuguacauuuugccgagaguuccuuaaaaacccgcaaugcuaccccgcuaagaaauggcuguucauaaucauaguaauccuccucggguacgcgggacucaugcuccucacgaacguccuaaaggcaauaggcgugugggggagcuggguaauagccccggucaaacuaauguuugccaucaucaagaaacucaugcgcaccgucagcugccuggugggcaaacuaauggaccgcgggcgacaaguaauacacgaagaaauaggcgaaaacggagaagguaaccaagaugauguaaggauagagauggcgaggccccggagaguuagacacuggauguacagccccgucauccucacaaucuuggccaucgggcuagccgaaggcugcgacgaaaugguccacgcggacagcaaacucgucucuugccggcaagggagcggcaacaugaaagagugcaucacaacaggacgcgccuuguuaccagcagucaacccgggccaagaagccugcuuacacuucacggcaccggggagcccagacaguaagugccuaaagauuaaagugaagcgaaucaaccucaaaugcaagaaaucuaguagcuacuuuguacccgacgccagaagucgcugcacuagcguacgcagauguagaugggcgggagauugccaauccggaugcccaccccacuucacaagcaacucauucagcgacgacugggccggcaaaauggaccgggcaggacucggauucuccggcugcuccgacggaugcggcggagcugcuuguggcugcuucaacgcagcaccaagcugcaucuuuuggcggaaaugggucgaaaacccccacggaaucaucuggaaaguauccccaugcgcagccugggugccaucagcugugaucgagcucaccaugcccagcggcgaaguacgaaccuuccacccgauguccggcauccccacccaagucuucaaaggugucuccgucaccuaucuaggcucugacauggaagugagcggauugaccgaccuuugcgaaaucgaggagcuaaaaucaaagaaacuagcccuagcacccugcaaccaggccgggaugggaguaguuggaaaagucggagagauccagugcuccucagaagaaagcgcccgaacgaucaagaaagacgguugcauauggaacgccgaccuagucggaaucgaacuucgugucgacgacgcagucugcuacagcaaaaucaccucagucgaggcuguagccaacuacagugccaucccuacgaccaucgggggccugcgauucgaacgcagccacgauagccaaggaaaaaucucaggcagcccacucgacauaacagcgaucagaggcagcuucuccgucaacuaccgaggacuccgccuaagccucucagaaauaacggccacuugcacaggugagguuaccaacguaagcggguguuacagcugcaugacaggagcaaaaguaagcauuaaguugcacucgagcaaaaacucaaccgcucacguaagaugcaaaggcgacgagaccgcauucagcguccuggagggaguacacaguuacauugucucgcucagcuucgaccaugcugucgucgaugaacaaugccaacuaaacugcggcggacacgaaagccaaguaacccucaaaggaaacuuaauuuuucuggacguccccaaauucgucgacggcucauacaugcaaaccuaccacucaacagucccgacuggagcaaacauccccagccccacagacuggcucaacgcgcucuuuggcaacggguuaagcagauggauccucggaguaauaggaguucuccuaggcgggcucgcacucuucuucuuaaucguauuccuucuaaaacuuggaacuaaacaggcguucaggucaagaacaaaacucgcguaa

SEQ ID NO: 16579 - protein, 428 aa, Artificial Sequence; identical to SEQ ID NO: 234
  derived and/or modified protein sequence (wt) from ANDV(Chile-9717869)__AF291702.1__N

SEQ ID NO: 16580 - protein, 1138 aa, Artificial Sequence; identical to SEQ ID NO: 926
  derived and/or modified protein sequence (wt) from ANDV(Chile-9717869)__AF291703.2__GP

SEQ ID NO: 16581 - protein, 1138 aa, Artificial Sequence
  derived and/or modified protein sequence (wt) from ANDV(Chile-9717869)__AF291703.2__IgE-leader_Gn-Gc
MDWTWILFLVAAATRVHSMPKTIYELKMECPHTVGLGQGYIIGSTELGLISIEAASDIKLESSCNFDLHTTSMAQKSFTQVEWRKKSDTTDTTNAASTTFEAQTKTVNLRGTCILAPELYDTLKKVKKTVLCYDLTCNQTHCQPTVYLIAPVLTCMSIRSCMASVFTSRIQVIYEKTHCVTGQLIEGQCFNPAHTLTLSQPAHTYDTVTLPISCFFTPKKSEQLKVIKTFEGILTKTGCTENALQGYYVCFLGSHSEPLIVPSLEDIRSAEVVSRMLVHPRGEDHDAIQNSQSHLRIVGPITAKVPSTSSTDTLKGTAFAGVPMYSSLSTLVRNADPEFVFSPGIVPESNHSTCDKKTVPITWTGYLPISGEMEKVTGCTVFCTLAGPGASCEAYSENGIFNISSPTCLVNKVQRFRGSEQKINFICQRVDQDVVVYCNGQKKVILTKTLVIGQCIYTFTSLFSLMPDVAHSLAVELCVPGLHGWATVMLLSTFCFGWVLIPAVTLIILKCLRVLTFSCSHYTNESKFKFILEKVKIEYQKTMGSMVCDVCHHECETAKELESHRQSCINGQCPYCMTITEATESALQAHYSICKLTGRFQEALKKSLKKPEVKKGCYRTLGVFRYKSRCYVGLVWCLLLTCEIVIWAASAETPLMESGWSDTAHGVGEIPMKTDLELDFSLPSSSSYSYRRKLTNPANKEESIPFHFQMEKQVIHAEIQPLGHWMDATFNIKTAFHCYGACQKYSYPWQTSKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWCTTSCAFGDPGDIMSTPSGMRCPEHTGSFRKICGFATTPVCEYQGNTISGYKRMMATKDSFQSFNLTEPHITTNKLEWIDPDGNTRDHVNLVLNRDVSFQDLSDNPCKVDLHTQAIEGAWGSGVGFTLTCTVGLTECPSFMTSIKACDLAMCYGSTVTNLARGSNTVKVVGKGGHSGSSFKCCHDTDCSSEGLLASAPHLERVTGFNQIDSDKVYDDGAPPCTFKCWFTKSGEWLLGILNGNWIVVVVLVVILILSIIMFSVLCPRRGHKKTV

SEQ ID NO: 16582 - RNA, 1287 nt, Artificial Sequence; identical to SEQ ID NO: 2569
  derived and/or modified CDS sequence (wt) from ANDV(Chile-9717869)__AF291702.1__N

SEQ ID NO: 16583 - RNA, 1287 nt, Artificial Sequence
  derived and/or modified CDS sequence (wt) from ANDV(Chile-9717869)__AF291702.1__N
augagcacccuccaagaauugcaggaaaacaucacagcacacgaacaacagcucgugacugcucggcaaaagcugaaggaugccgagaaggcaguggagguggacccggaugacguuaacaagagcacacuacaaaguagacgggcagcugugucuacauuggagaccaaacucggagaacuuaagaggcaacuugcagauuugguggcagcucaaaaauuggcuacaaaaccaguugauccaacagggcuugagccugaugaucaucuaaaggaaaaaucaucucugagauaugggaauguccuggauguuaauucaauugauuuggaagaaccgaguggacagacugcugauuggaaggcuauaggagcauacaucuuaggguuugcaauuccgaucauccuaaaggccuuauacaugcugucaacccgugggagacaaacugugaaagacaacaaagggaccaggauaagguuuaaggaugauucuuccuuugaagaagucaaugggauacguaaaccaaaacaccuuuacgucucaaugccaacugcacaguccacuaugaaggcugaagaaaucacgccaggacgauuuaggacaauugcuuguggccuuuuuccagcacaggucaaagcccgaaauauaauaaguccuguaaugggaguaauuggauuuggcuucuuuguaaaggauuggauggaucggauagaagaguuucuggcugcagaguguccauucuuaccuaagccaaaggucgccucagaagccuucaugucuaccaauaagauguauuuucugaacagacagagacaagucaaugaaucuaagguucaagauauuaucgauuugauagaccaugcugagaccgagucugcuaccuuguuuacagagauugcaacaccccauucagucuggguguuugcaugugcaccugaccggugcccuccaacugcauuguauguugcagggguaccggaacuuggugcauuuuuuucuauccuucaggacaugcguaauaccaucauggcaucuaaaucuguagggacugcagaagagaagcuaaagaaaaaaucugccuucuaccaaucauaccuaagaaggacacaaucuaugggaauccaacuggaccagaagaucauaauccuuuacaugcuaucaugggguaaagaagcugugaaucacuuccaucuuggugaugauauggacccugaacucaggcagcuagcacaaucucugaucgauacuaaggugaaggagaucuccaaccaagagccacuuaaguuguag

SEQ ID NO: 16584 - RNA, 3417 nt, Artificial Sequence; identical to SEQ ID NO: 3261
  derived and/or modified CDS sequence (wt) from ANDV(Chile-9717869)__AF291703.2__GP

SEQ ID NO: 16585 - RNA, 3417 nt, Artificial Sequence
  derived and/or modified CDS sequence (wt) from ANDV(Chile-9717869)__AF291703.2__GP
auggaagggugguaucugguuguucuuggagucugcuauacgcugacacuggcaaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaa

SEQ ID NO: 16586 - RNA, 3417 nt, Artificial Sequence
  derived and/or modified CDS sequence (wt) from ANDV(Chile-9717869)__AF291703.2__IgE-leader_Gn-Gc
auggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauucugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaauucacaaagucacuuaagaauagugggaccuaucacagcaaaagugccaucaacuaguuccacagauacccuaaaggggacagccuuugcaggcgucccaauguauagcucuuuaucuacacuagucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuugaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaa

SEQ ID NO: 16587 - RNA, 3417 nt, Artificial Sequence
  derived and/or modified CDS sequence (wt) from ANDV(Chile-9717869)__AF291703.2__IgE-leader_Gn-Gc
auggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaa

SEQ ID NO: 16588 - RNA, 1287 nt, Artificial Sequence; identical to SEQ ID NO: 4904
  derived and/or modified CDS sequence (opt4) from ANDV(Chile-9717869)__AF291702.1__N

SEQ ID NO: 16589 - RNA, 3417 nt, Artificial Sequence; identical to SEQ ID NO: 8364
  derived and/or modified CDS sequence (opt4) from ANDV(Chile-9717869)__AF291703.2__GP

SEQ ID NO: 16590 - RNA, 3417 nt, Artificial Sequence
  derived and/or modified CDS sequence (opt4) from ANDV(Chile-9717869)__AF291703.2__IgE-leader_Gn-Gc
auggacuggaccuggauccuguuccugguggccgccgccaccagagugcacagcaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccguguga

SEQ ID NO: 16591 - RNA, 1287 nt, Artificial Sequence; identical to SEQ ID NO: 5596
  derived and/or modified CDS sequence (opt3) from ANDV(Chile-9717869)__AF291702.1__N

SEQ ID NO: 16592 - RNA, 3417 nt, Artificial Sequence; identical to SEQ ID NO: 10007
  derived and/or modified CDS sequence (opt3) from ANDV(Chile-9717869)__AF291703.2__GP

SEQ ID NO: 16593 - RNA, 3417 nt, Artificial Sequence
  derived and/or modified CDS sequence (opt3) from ANDV(Chile-9717869)__AF291703.2__IgE-leader_Gn-Gc
auggacuggaccuggauccuguuccucguggccgcugcaacaagaguccacagcaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccguguga

SEQ ID NO: 16594 - RNA, 1287 nt, Artificial Sequence; identical to SEQ ID NO: 6288
  derived and/or modified CDS sequence (opt1) from ANDV(Chile-9717869)__AF291702.1__N

SEQ ID NO: 16595 - RNA, 3417 nt, Artificial Sequence; identical to SEQ ID NO: 11650
  derived and/or modified CDS sequence (opt1) from ANDV(Chile-9717869)__AF291703.2__GP

SEQ ID NO: 16596 - RNA, 3417 nt, Artificial Sequence
  derived and/or modified CDS sequence (opt1) from ANDV(Chile-9717869)__AF291703.2__IgE-leader_Gn-Gc
auggacuggaccuggauccuguuccucguggccgccgcgacccgcguccacagcaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucuga

SEQ ID NO: 16597 - RNA, 1287 nt, Artificial Sequence; identical to SEQ ID NO: 6980
  derived and/or modified CDS sequence (opt5) from ANDV(Chile-9717869)__AF291702.1__N

SEQ ID NO: 16598 - RNA, 3417 nt, Artificial Sequence; identical to SEQ ID NO: 13293
  derived and/or modified CDS sequence (opt5) from ANDV(Chile-9717869)__AF291703.2__GP

SEQ ID NO: 16599 - RNA, 3417 nt, Artificial Sequence
  derived and/or modified CDS sequence (opt5) from ANDV(Chile-9717869)__AF291703.2__IgE-leader_Gn-Gc
auggacuggaccuggauccuguuccucguggccgcugccacaagaguccacagcaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucuga

SEQ ID NO: 16600 - RNA, 1287 nt, Artificial Sequence; identical to SEQ ID NO: 7672
  derived and/or modified CDS sequence (opt11) from ANDV(Chile-9717869)__AF291702.1__N

SEQ ID NO: 16601 - RNA, 3417 nt, Artificial Sequence; identical to SEQ ID NO: 14936
  derived and/or modified CDS sequence (opt11) from ANDV(Chile-9717869)__AF291703.2__GP

SEQ ID NO: 16602 - RNA, 3417 nt, Artificial Sequence
  derived and/or modified CDS sequence (opt11) from ANDV(Chile-9717869)__AF291703.2__IgE-leader_Gn-Gc
auggauuggacguggauacucuuucucguggccgcggccacgcgcgugcacucgaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaa

SEQ ID NO: 16603 - RNA, 1504 nt, Artificial Sequence
  mRNA product Design1 comprising derived and/or modified sequence from ANDV(Chile-9717869)__AF291702.1__N (wt)
gggagaaagcuuaccaugagcacccuccaagaauugcaggaaaacaucacagcacacgaacaacagcucgugacugcucggcaaaagcuuaaggaugccgagaaggcaguggagguggacccggaugacguuaacaagagcacacuacaaaguagacgggcagcugugucuacauuggagaccaaacucggagaacuuaagaggcaacuugcagauuugguggcagcucaaaaauuggcuacaaaaccaguugauccaacagggcuugagccugaugaucaucuaaaggaaaaaucaucucugagauaugggaauguccuggauguuaauucaauugauuuggaagaaccgaguggacagacugcugauuggaaggcuauaggagcauacaucuuaggguuugcaauuccgaucauccuaaaggccuuauacaugcugucaacccgugggagacaaacugugaaagacaacaaagggaccaggauaagguuuaaggaugauucuuccuuugaagaagucaaugggauacguaaaccaaaacaccuuuacgucucaaugccaacugcacaguccacuaugaaggcugaagaaaucacgccaggacgauuuaggacaauugcuuguggccuuuuuccagcacaggucaaagcccgaaauauaauaaguccuguaaugggaguaauuggauuuggcuucuuuguaaaggauuggauggaucggauagaagaguuucuggcugcagaguguccauucuuaccuaagccaaaggucgccucagaagccuucaugucuaccaauaagauguauuuucugaacagacagagacaagucaaugaaucuaagguucaagauauuaucgauuugauagaccaugcugagaccgagucugcuaccuuguuuacagagauugcaacaccccauucagucuggguguuugcaugugcaccugaccggugcccuccaacugcauuguauguugcagggguaccggaacuuggugcauuuuuuucuauccuucaggacaugcguaauaccaucauggcaucuaaaucuguagggacugcagaagagaagcuaaagaaaaaaucugccuucuaccaaucauaccuaagaaggacacaaucuaugggaauccaacuggaccagaagaucauaauccuuuacaugcuaucaugggguaaagaagcugugaaucacuuccaucuuggugaugauauggacccugaacucaggcagcuagcacaaucucugaucgauacuaaggugaaggagaucuccaaccaagagccacuuaaguuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16604 - RNA, 1504 nt, Artificial Sequence
  mRNA product Design1 comprising derived and/or modified sequence from ANDV(Chile-9717869)__AF291702.1__N (wt)
gggagaaagcuuaccaugagcacccuccaagaauugcaggaaaacaucacagcacacgaacaacagcucgugacugcucggcaaaagcugaaggaugccgagaaggcaguggagguggacccggaugacguuaacaagagcacacuacaaaguagacgggcagcugugucuacauuggagaccaaacucggagaacuuaagaggcaacuugcagauuugguggcagcucaaaaauuggcuacaaaaccaguugauccaacagggcuugagccugaugaucaucuaaaggaaaaaucaucucugagauaugggaauguccuggauguuaauucaauugauuuggaagaaccgaguggacagacugcugauuggaaggcuauaggagcauacaucuuaggguuugcaauuccgaucauccuaaaggccuuauacaugcugucaacccgugggagacaaacugugaaagacaacaaagggaccaggauaagguuuaaggaugauucuuccuuugaagaagucaaugggauacguaaaccaaaacaccuuuacgucucaaugccaacugcacaguccacuaugaaggcugaagaaaucacgccaggacgauuuaggacaauugcuuguggccuuuuuccagcacaggucaaagcccgaaauauaauaaguccuguaaugggaguaauuggauuuggcuucuuuguaaaggauuggauggaucggauagaagaguuucuggcugcagaguguccauucuuaccuaagccaaaggucgccucagaagccuucaugucuaccaauaagauguauuuucugaacagacagagacaagucaaugaaucuaagguucaagauauuaucgauuugauagaccaugcugagaccgagucugcuaccuuguuuacagagauugcaacaccccauucagucuggguguuugcaugugcaccugaccggugcccuccaacugcauuguauguugcagggguaccggaacuuggugcauuuuuuucuauccuucaggacaugcguaauaccaucauggcaucuaaaucuguagggacugcagaagagaagcuaaagaaaaaaucugccuucuaccaaucauaccuaagaaggacacaaucuaugggaauccaacuggaccagaagaucauaauccuuuacaugcuaucaugggguaaagaagcugugaaucacuuccaucuuggugaugauauggacccugaacucaggcagcuagcacaaucucugaucgauacuaaggugaaggagaucuccaaccaagagccacuuaaguuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16605 - RNA, 3634 nt, Artificial Sequence
  mRNA product Design1 comprising derived and/or modified sequence from ANDV(Chile-9717869)__AF291703.2__GP (wt)
gggagaaagcuuaccauggaagggugguaucugguuguucuuggagucugcuauacgcugacacuggcaaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauucugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaauucacaaagucacuuaagaauagugggaccuaucacagcaaaagugccaucaacuaguuccacagauacccuaaaggggacagccuuugcaggcgucccaauguauagcucuuuaucuacacuagucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuugaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16606 - RNA, 3634 nt, Artificial Sequence
  mRNA product Design1 comprising derived and/or modified sequence from ANDV(Chile-9717869)__AF291703.2__GP (wt)
gggagaaagcuuaccauggaagggugguaucugguuguucuuggagucugcuauacgcugacacuggcaaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16607 - RNA, 3634 nt, Artificial Sequence
  mRNA product Design1 comprising derived and/or modified sequence from ANDV(Chile-9717869)__AF291703.2__IgE-leader_Gn-Gc (wt)
gggagaaagcuuaccauggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauucugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaauucacaaagucacuuaagaauagugggaccuaucacagcaaaagugccaucaacuaguuccacagauacccuaaaggggacagccuuugcaggcgucccaauguauagcucuuuaucuacacuagucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuugaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16608 - RNA, 3634 nt, Artificial Sequence
  mRNA product Design1 comprising derived and/or modified sequence from ANDV(Chile-9717869)__AF291703.2__IgE-leader_Gn-Gc (wt)
gggagaaagcuuaccauggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16609 - RNA, 1504 nt, Artificial Sequence
  mRNA product Design1 comprising derived and/or modified sequence from ANDV(Chile-9717869)__AF291702.1__N (opt4)
gggagaaagcuuaccaugagcacccugcaggagcugcaggagaacaucaccgcccacgagcagcagcuggugaccgccagacagaagcugaaggacgccgagaaggccguggagguggaccccgacgacgugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggacagaaucgaggaguuccuggccgccgagugccccuuccugcccaagcccaagguggccagcgaggccuucaugagcaccaacaagauguacuuccugaacagacagagacaggugaacgagagcaaggugcaggacaucaucgaccugaucgaccacgccgagaccgagagcgccacccuguucaccgagaucgccaccccccacagcguguggguguucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16610 - RNA, 3634 nt, Artificial Sequence
  mRNA product Design1 comprising derived and/or modified sequence from ANDV(Chile-9717869)__AF291703.2__GP (opt4)
gggagaaagcuuaccauggagggcugguaccugguggugcugggcgugugcuacacccugacccuggccaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16611 - RNA, 3634 nt, Artificial Sequence
  mRNA product Design1 comprising derived and/or modified sequence from ANDV(Chile-9717869)__AF291703.2__IgE-leader_Gn-Gc (opt4)
gggagaaagcuuaccauggacuggaccuggauccuguuccugguggccgccgccaccagagugcacagcaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16612 - RNA, 1504 nt, Artificial Sequence
  mRNA product Design1 comprising derived and/or modified sequence from ANDV(Chile-9717869)__AF291702.1__N (opt3)
gggagaaagcuuaccaugagcacccugcaggagcuccaagaaaacaucacagcccacgagcagcagcuugugacugcuagacagaagcugaaagacgcagaaaaggccgucgagguugaucccgacgaugugaauaaauccacguugcaaucuaggcgggcggcuguaucaaccuuagaaacaaagcugggcgagcuaaaacgccagcucgccgaccugguggcagcccagaaacuugcuacuaagccugucgauccaaccgggcuggagccggacgaucauuugaaagaaaagaguagccuccgauacggaaacgugcuggacguuaauuccauugaucuggaggaacccucuggucagacagcagacuggaaagccauaggcgcuuauauccucggguucgccauuccuaucauuuuaaaggcgcuguacaugcuuucgacccguggaagacaaacugugaaagauaacaagggcacaaggauccgguuuaaggacgauagcucauucgaggaggucaaugguauacgcaaaccaaagcacuuguaugugaguaugcccaccgcacaguccacgaugaaagccgaagagaucacuccugggagauuuaggaccauugcuugcggacuguucccagcccagguaaaggcacggaacaucauuucucccguuaugggcgugaucggcuuuggguucuuugucaaagacuggauggaccgcauagaagaguuccuagcugccgaauguccuuuucucccaaagccgaaaguggcgagcgaggccuucauguccacaaauaagauguacuuucugaaccgacagagacaagugaaugagucaaagguccaggauauuaucgaccuuauugaucaugcagaaacugagagugcuacccuguucacagaaaucgccacgccccacagcguuuggguguuugcuugcgccccugacagguguccacccaccgcauuguauguagccggagugccugagcucggugcuuucuucucuauccugcaggauaugcggaacacuauuauggcguccaaaucagucggcacagcagaagagaaguuaaagaagaaaagcgccuuuuaccaaaguuaucugcgucgcacccagucuauggggauacagcucgaccagaagaucauuauccuuuacaugcuguccuggggaaaggaggcugugaaucauuuccacuugggcgaugacauggauccagaacuaagacaacuggcccagagccucauagacacuaaaguuaaggagauuucgaaccaggaaccccugaaacuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16613 - RNA, 3634 nt, Artificial Sequence
  mRNA product Design1 comprising derived and/or modified sequence from ANDV(Chile-9717869)__AF291703.2__GP (opt3)
gggagaaagcuuaccauggagggcugguaccuggugguccucgggguuugcuauacccuuacacuggccaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16614 - RNA, 3634 nt, Artificial Sequence
  mRNA product Design1 comprising derived and/or modified sequence from ANDV(Chile-9717869)__AF291703.2__IgE-leader_Gn-Gc (opt3)
gggagaaagcuuaccauggacuggaccuggauccuguuccucguggccgcugcaacaagaguccacagcaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16615 - RNA, 1504 nt, Artificial Sequence
  mRNA product Design1 comprising derived and/or modified sequence from ANDV(Chile-9717869)__AF291702.1__N (opt1)
gggagaaagcuuaccaugagcacccugcaggagcuccaggagaacaucaccgcccacgagcagcagcuggugacggcccgccagaagcugaaggacgcggagaaggccgucgagguggaccccgacgacgugaacaaguccacccuccagagccggcgcgccgccgucuccacccuggagaccaagcugggcgagcucaagcggcagcuggccgaccugguggcggcccagaagcucgccacgaagccgguggaccccaccgggcuggagcccgacgaccaccugaaggagaaguccagccuccgcuacggcaacguccuggacgugaacagcaucgaccuggaggagcccuccgggcagaccgccgacuggaaggcgaucggcgccuacauccucggguucgccaucccgaucauccugaaggcccuguacaugcucagcacccggggccgccagacggugaaggacaacaagggcacccggauccgcuucaaggacgacuccagcuucgaggaggucaacgggauccggaagcccaagcaccuguacguguccaugcccaccgcccagagcaccaugaaggcggaggagaucacgcccggccgcuuccggaccaucgccugcgggcuguucccggcccaggugaaggcccgcaacaucaucucccccgucaugggcgugaucggguucggcuucuucgugaaggacuggauggaccggaucgaggaguuccucgccgcggagugccccuuccugcccaagccgaaggucgccagcgaggccuucauguccaccaacaagauguacuuccugaaccgccagcgccaggugaacgagagcaaggugcaggacaucaucgaccucaucgaccacgccgagaccgaguccgccacgcuguucaccgagaucgcgacgccccacagcgucuggguguucgccugcgcccccgaccggugcccgcccaccgcccuguacguggccggcguccccgagcucggggcguucuucuccauccugcaggacaugcggaacaccaucauggccagcaagagcgugggcaccgccgaggagaagcugaagaagaaguccgccuucuaccagagcuaccuccgccggacccaguccauggggauccagcuggaccagaagaucaucauccuguacaugcucagcuggggcaaggaggcggugaaccacuuccaccugggcgacgacauggaccccgagcugcgccagcucgcccagucccugaucgacaccaaggucaaggagaucagcaaccaggagccccugaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16616 - RNA, 3634 nt, Artificial Sequence
  mRNA product Design1 comprising derived and/or modified sequence from ANDV(Chile-9717869)__AF291703.2__GP (opt1)
gggagaaagcuuaccauggagggcugguaccuggugguccucggggugugcuacacccugacccuggccaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16617 - RNA, 3634 nt, Artificial Sequence
  mRNA product Design1 comprising derived and/or modified sequence from ANDV(Chile-9717869)__AF291703.2__IgE-leader_Gn-Gc (opt1)
gggagaaagcuuaccauggacuggaccuggauccuguuccucguggccgccgcgacccgcguccacagcaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16618 - RNA, 1504 nt, Artificial Sequence
  mRNA product Design1 comprising derived and/or modified sequence from ANDV(Chile-9717869)__AF291702.1__N (opt5)
gggagaaagcuuaccaugagcacccugcaggagcuccaagaaaacaucacagcccacgagcagcagcuggugacggcuagacagaaacuuaaggacgccgaaaaggcggucgagguugaucccgacgaugugaauaaauccacccugcaaucucggcgcgcugccgugagcacacucgaaaccaagcugggcgagcuuaaaagacagcuggccgaccucgucgcugcccagaagcuggcuacaaagccuguggauccgaccgggcuggagcccgacgaucaucucaaagaaaaguccucucugcgguacggaaacguucuugacgugaauagcauugaucuggaggaaccuuccggccagacagccgacuggaaagcgaucggggccuauauucucggauucgcuauccccauuauccugaaggcccuuuacaugcugucuacccgcggcagacaaacggucaaagauaacaaggggacccggauccgcuuuaaggacgauagcuccuucgaggaggugaauggaauuagaaaaccuaagcaccucuauguuagcaugcccacagcucagucuaccaugaaagccgaagagaucacaccuggccgguuucgcaccauugcgugcggccuguucccggcccaggugaaggcuagaaacaucauuucccccgucaugggggugaucggauuuggcuucuuugugaaagacuggauggaccggauugaagaguuccuggccgcugaauguccuuuucuccccaagccuaaagucgccagcgaggccuucaugucuacgaauaagauguacuuucugaaccgccagagacaaguuaaugaguccaaggugcaggauaucaucgaccuuauugaucaugcugaaacagagagcgcgacccuguucacagaaaucgccacaccccacucugugugggucuuugcuugcgccccggaccgguguccucccaccgcccucuauguggcugggguuccugagcugggagccuucuucuccauucuucaggauaugcgcaacaccaucauggcgagcaaauccgugggcacggcugaagagaagcugaaaaagaaaucugccuuuuaccaaagcuaucucagacggacccaguccauggggauucagcuggaccagaagaucaucauucuguacaugcucagcuggggaaaggaggccgucaaucauuuccaccugggcgaugacauggaucccgaacuuagacaacuggcucagucucucaucgacacaaaagugaaggagauuuccaaccaggaaccccugaaacuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16619 - RNA, 3634 nt, Artificial Sequence
  mRNA product Design1 comprising derived and/or modified sequence from ANDV(Chile-9717869)__AF291703.2__GP (opt5)
gggagaaagcuuaccauggagggcugguaccuggugguccucgggguuugcuauacccugacacuugccaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16620 - RNA, 3634 nt, Artificial Sequence
  mRNA product Design1 comprising derived and/or modified sequence from ANDV(Chile-9717869)__AF291703.2__IgE-leader_Gn-Gc (opt5)
gggagaaagcuuaccauggacuggaccuggauccuguuccucguggccgcugccacaagaguccacagcaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16621 - RNA, 1504 nt, Artificial Sequence
  mRNA product Design1 comprising derived and/or modified sequence from ANDV(Chile-9717869)__AF291702.1__N (opt11)
gggagaaagcuuaccauguccacccuccaagaacuccaagaaaacaucacagcacacgagcaacaacucguaacugcccgucaaaaacucaaagacgcggaaaaagccgucgaagucgaccccgacgacgucaauaaauccacccuccaaucacgccgcgccgcagucagcacccucgaaaccaaacucggcgaacucaaacgacaacuagccgaccucguagcagcccaaaaacucgcaaccaaacccguagaccccaccggacuagaacccgacgaccaccucaaagaaaaauccucccuaagauacggcaacguccucgacgucaacagcaucgaccuagaggaaccaagcggccaaacagcagacuggaaagccaucggcgccuacauccuaggauucgccaucccaaucauacucaaagcccucuacaugcuuuccacacgcggacgccaaacgguuaaagacaacaaaggcacacgaauaagauuuaaagacgacagcuccuucgaagaagucaacggcauccgcaaacccaaacaccucuacguaucaaugcccaccgcccaauccaccaugaaagccgaagaaaucacacccggccgauucagaacaaucgccugcggacucuucccggcccaagucaaagcccgaaacaucauaucccccgucaugggagucaucggcuucggcuucuucgucaaagacuggauggaccgcaucgaagaguuccucgccgccgaaugcccauucuuaccaaaaccgaaagucgccuccgaggcuuucaugucuacgaacaaaauguacuuccucaacagacaacgccaagucaacgaaucaaaaguccaagacauaaucgacuuaaucgaccaugcagaaacagaauccgccacccucuucaccgaaauagccacaccccacagcgucugggucuucgccugcgcccccgaccgaugcccaccaaccgcccuauauguagccggcguacccgaacucggcgccuucuucucaauccuccaagacaugaggaacaccaucauggcauccaaaucaguaggcaccgccgaagaaaagcuaaagaagaaaagcgcauucuaccaaagcuaccuacgacgcacccaaucaaugggaauccaacucgaccagaaaaucauaauccuauacaugcucuccuggggaaaagaagcaguaaaccacuuccaccuaggcgacgacauggaccccgaacuccgccaacucgcccaaucacucaucgacacuaaaguaaaagagauauccaaccaagaaccacucaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16622 - RNA, 3634 nt, Artificial Sequence
  mRNA product Design1 comprising derived and/or modified sequence from ANDV(Chile-9717869)__AF291703.2__GP (opt11)
gggagaaagcuuaccauggaggggugguacuuagucguauugggagucugcuacacacugacacuugccaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16623 - RNA, 3634 nt, Artificial Sequence
  mRNA product Design1 comprising derived and/or modified sequence from ANDV(Chile-9717869)__AF291703.2__IgE-leader_Gn-Gc (opt11)
gggagaaagcuuaccauggauuggacguggauacucuuucucguggccgcggccacgcgcgugcacucgaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16624 - RNA, 1669 nt, Artificial Sequence
  mRNA product Design2 comprising derived and/or modified sequence from ANDV(Chile-9717869)__AF291702.1__N (wt)
ggggcgcugccuacggagguggcagccaucuccuucucggcaucaagcuuaccaugagcacccuccaagaauugcaggaaaacaucacagcacacgaacaacagcucgugacugcucggcaaaagcuuaaggaugccgagaaggcaguggagguggacccggaugacguuaacaagagcacacuacaaaguagacgggcagcugugucuacauuggagaccaaacucggagaacuuaagaggcaacuugcagauuugguggcagcucaaaaauuggcuacaaaaccaguugauccaacagggcuugagccugaugaucaucuaaaggaaaaaucaucucugagauaugggaauguccuggauguuaauucaauugauuuggaagaaccgaguggacagacugcugauuggaaggcuauaggagcauacaucuuaggguuugcaauuccgaucauccuaaaggccuuauacaugcugucaacccgugggagacaaacugugaaagacaacaaagggaccaggauaagguuuaaggaugauucuuccuuugaagaagucaaugggauacguaaaccaaaacaccuuuacgucucaaugccaacugcacaguccacuaugaaggcugaagaaaucacgccaggacgauuuaggacaauugcuuguggccuuuuuccagcacaggucaaagcccgaaauauaauaaguccuguaaugggaguaauuggauuuggcuucuuuguaaaggauuggauggaucggauagaagaguuucuggcugcagaguguccauucuuaccuaagccaaaggucgccucagaagccuucaugucuaccaauaagauguauuuucugaacagacagagacaagucaaugaaucuaagguucaagauauuaucgauuugauagaccaugcugagaccgagucugcuaccuuguuuacagagauugcaacaccccauucagucuggguguuugcaugugcaccugaccggugcccuccaacugcauuguauguugcagggguaccggaacuuggugcauuuuuuucuauccuucaggacaugcguaauaccaucauggcaucuaaaucuguagggacugcagaagagaagcuaaagaaaaaaucugccuucuaccaaucauaccuaagaaggacacaaucuaugggaauccaacuggaccagaagaucauaauccuuuacaugcuaucaugggguaaagaagcugugaaucacuuccaucuuggugaugauauggacccugaacucaggcagcuagcacaaucucugaucgauacuaaggugaaggagaucuccaaccaagagccacuuaaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16625 - RNA, 1669 nt, Artificial Sequence
  mRNA product Design2 comprising derived and/or modified sequence from ANDV(Chile-9717869)__AF291702.1__N (wt)
ggggcgcugccuacggagguggcagccaucuccuucucggcaucaagcuuaccaugagcacccuccaagaauugcaggaaaacaucacagcacacgaacaacagcucgugacugcucggcaaaagcugaaggaugccgagaaggcaguggagguggacccggaugacguuaacaagagcacacuacaaaguagacgggcagcugugucuacauuggagaccaaacucggagaacuuaagaggcaacuugcagauuugguggcagcucaaaaauuggcuacaaaaccaguugauccaacagggcuugagccugaugaucaucuaaaggaaaaaucaucucugagauaugggaauguccuggauguuaauucaauugauuuggaagaaccgaguggacagacugcugauuggaaggcuauaggagcauacaucuuaggguuugcaauuccgaucauccuaaaggccuuauacaugcugucaacccgugggagacaaacugugaaagacaacaaagggaccaggauaagguuuaaggaugauucuuccuuugaagaagucaaugggauacguaaaccaaaacaccuuuacgucucaaugccaacugcacaguccacuaugaaggcugaagaaaucacgccaggacgauuuaggacaauugcuuguggccuuuuuccagcacaggucaaagcccgaaauauaauaaguccuguaaugggaguaauuggauuuggcuucuuuguaaaggauuggauggaucggauagaagaguuucuggcugcagaguguccauucuuaccuaagccaaaggucgccucagaagccuucaugucuaccaauaagauguauuuucugaacagacagagacaagucaaugaaucuaagguucaagauauuaucgauuugauagaccaugcugagaccgagucugcuaccuuguuuacagagauugcaacaccccauucagucuggguguuugcaugugcaccugaccggugcccuccaacugcauuguauguugcagggguaccggaacuuggugcauuuuuuucuauccuucaggacaugcguaauaccaucauggcaucuaaaucuguagggacugcagaagagaagcuaaagaaaaaaucugccuucuaccaaucauaccuaagaaggacacaaucuaugggaauccaacuggaccagaagaucauaauccuuuacaugcuaucaugggguaaagaagcugugaaucacuuccaucuuggugaugauauggacccugaacucaggcagcuagcacaaucucugaucgauacuaaggugaaggagaucuccaaccaagagccacuuaaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16626 - RNA, 3799 nt, Artificial Sequence
  mRNA product Design2 comprising derived and/or modified sequence from ANDV(Chile-9717869)__AF291703.2__GP (wt)
ggggcgcugccuacggagguggcagccaucuccuucucggcaucaagcuuaccauggaagggugguaucugguuguucuuggagucugcuauacgcugacacuggcaaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauucugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaauucacaaagucacuuaagaauagugggaccuaucacagcaaaagugccaucaacuaguuccacagauacccuaaaggggacagccuuugcaggcgucccaauguauagcucuuuaucuacacuagucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuugaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16627 - RNA, 3799 nt, Artificial Sequence
  mRNA product Design2 comprising derived and/or modified sequence from ANDV(Chile-9717869)__AF291703.2__GP (wt)
ggggcgcugccuacggagguggcagccaucuccuucucggcaucaagcuuaccauggaagggugguaucugguuguucuuggagucugcuauacgcugacacuggcaaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16628 - RNA, 3799 nt, Artificial Sequence
  mRNA product Design2 comprising derived and/or modified sequence from ANDV(Chile-9717869)__AF291703.2__IgE-leader_Gn-Gc (wt)
ggggcgcugccuacggagguggcagccaucuccuucucggcaucaagcuuaccauggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauucugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaauucacaaagucacuuaagaauagugggaccuaucacagcaaaagugccaucaacuaguuccacagauacccuaaaggggacagccuuugcaggcgucccaauguauagcucuuuaucuacacuagucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuugaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16629 - RNA, 3799 nt, Artificial Sequence
  mRNA product Design2 comprising derived and/or modified sequence from ANDV(Chile-9717869)__AF291703.2__IgE-leader_Gn-Gc (wt)
ggggcgcugccuacggagguggcagccaucuccuucucggcaucaagcuuaccauggacuggaccuggauccuguuccucguggccgccgcgacccgcguccacagcaugcccaagaccauuuaugagcuuaaaauggaaugcccgcacacugugggucucggucaagguuacaucauuggcucaacagaacuagguuugaucucaauugaggcugcaucugauauaaagcucgagagcucuugcaauuuugaucuucauacaacaucuauggcccagaagaguuucacccaaguugaauggagaaagaaaagugacacaacugauaccacaaaugcugcguccacuaccuuugaagcacaaacuaaaacuguuaaccuuagagggacuuguauacuggcaccugaacucuaugauacauugaagaaaguaaaaaagacaguccugugcuaugaucuaacauguaaucaaacacauugucagccaacugucuaucugauugcaccuguauugacaugcaugucaauaagaaguuguauggcuaguguguuuacaagcaggauucaggugauuuaugaaaagacacauuguguaacaggucagcugauugagggucaguguuucaacccagcacacacauugacauuaucucagccugcucacacuuaugauacugucacccuuccuaucucuuguuuuuucacaccaaagaagucggagcaacuaaaaguuauaaaaacauuugaaggaauccugacgaagacagguugcacggagaaugcauugcaggguuauuauguguguuuuuuagggagucauucagaaccuuuaauuguuccgaguuuggaggacauacggucugcugaaguuguuaguaggaugcuuguacacccuaggggagaagaccaugaugccauacagaacucacaaagucacuuaagaauagugggaccuaucacagcaaaagugccaucaacaaguuccacagauacccuaaaggggacagccuuugcaggcgucccaauguauagcucuuuaucuacacuugucagaaaugcagacccagaauuuguauuuucuccagguauaguaccugaaucuaaucacaguacaugugauaagaagacaguaccuaucacauggacaggcuaccuaccaauaucaggugagauggaaaaagugacuggauguacaguuuuuuguacacuagcaggaccuggugcuaguugugaggccuauucugaaaaugguauauuuaacaucaguucuccaacaugucuuguaaacaaaguccaaagauuucguggaucugaacagaaaauaaauuuuaucugucagcggguagaucaggauguuguuguauacugcaaugggcaaaagaaagucauauuaaccaaaacuuugguuauugggcaguguauuuauacauucacaagccuauuuucauugaugccugauguagcccacucauuggcuguagaauuaugugucccgggauuacauggaugggccacugucaugcuucuaucaacauucugcuuugggugggucuugauuccugcggucacauuaauaauauuaaagugucuaaggguuuugacguuuucuuguucccauuacacuaaugagucaaaauuuaaauucauccuggaaaaaguuaaaauugaauaccaaaagacuaugggaucaauggugugcgauguaugucaucaugagugugaaacagcaaaagaacuugaaucacauagacagaguuguaucaauggacaauguccuuauugcaugacaauaacugaagcaacugaaagugccuugcaagcccauuauuccauuuguaaauugacaggaagauuucaggaggcacugaaaaagucacuuaaaaagccagagguaaaaaaagguuguuacagaacacucgggguauuuagauauaaaaguagauguuauguggguuugguauggugccuauuguugacaugugaaauuguuauuugggccgcaagugcagagacuccacuaauggagucaggcuggucagauacggcucaugguguuggugagauuccaaugaagacagaccucgagcuggacuuuucacugccuucuucauccucuuacaguuauaggagaaagcucacaaacccagccaauaaagaagagucuauucccuuccacuuccagauggaaaaacaaguaauucaugcugaaauccaaccccugggucauuggauggaugcgacauuuaauauuaagacugcauuucauuguuauggugcaugccagaaauacucuuauccauggcagacaucuaagugcuucuuugaaaaggacuaccaguaugaaacaggcuggggcuguaauccuggugacugcccagggguugggacuggaugcacugcuugugguguuuaucucgauaaacuaaaaucuguugggaaggccuauaagauaauuucuuuaaaauauaccagaaagguuuguauucaguuaggaacagaacaaacuugcaagcauauugaugcaaaugauuguuuagugacaccaucugugaaaguuugcauagugggcacaguuucaaaacuucaaccaucugauacucuuuuguucuuagguccacuagaacaagggggaaucauucuuaagcaauggugcacaacaucaugugcauuuggggacccuggugauaucauguccacucccagugguaugagguguccagagcacacuggaucauuuaggaaaauuugcgguuuugcuacuacaccaguuugugaauaucaaggaaauaccauuucuggauauaaaagaaugauggcaacaaaagauucauuccaaucauuuaacuuaacagaaccucacaucacaacaaacaagcuggaauggaucgacccagaugggaauacaagagaccacguaaaccuugucuuaaauagagaugucucauuucaggauuuaagugauaaccccuguaaaguagaccuacacacacaagcaauagaaggggcaugggguucugguguaggguuuacacucacauguacugucggauuaacagagugcccaaguuuuaugacaucaauuaaggcaugugaccuagcuauguguuauggaucaacaguaacaaaccuugccaggggcucuaauacagugaaaguaguugguaaaggaggccauucaggguccucauuuaaaugcugucaugauacagauugcuccucugaagguuuacuugcaucagccccucaucuugagaggguaacaggauucaaucaaauugauucagauaagguuuaugaugauggugcaccaccuugcacauucaaaugcugguucacuaagucaggugaguggcuucuugggaucuuaaacgggaauuggauuguuguuguagugcuuguugugauacucauucucucuaucauaauguucaguguuuugugucccaggagagggcacaagaaaacugucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16630 - RNA, 1669 nt, Artificial Sequence
  mRNA product Design2 comprising derived and/or modified sequence from ANDV(Chile-9717869)__AF291702.1__N (opt4)
ggggcgcugccuacggagguggcagccaucuccuucucggcaucaagcuuaccaugagcacccugcaggagcugcaggagaacaucaccgcccacgagcagcagcuggugaccgccagacagaagcugaaggacgccgagaaggccguggagguggaccccgacgacgugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggacagaaucgaggaguuccuggccgccgagugccccuuccugcccaagcccaagguggccagcgaggccuucaugagcaccaacaagauguacuuccugaacagacagagacaggugaacgagagcaaggugcaggacaucaucgaccugaucgaccacgccgagaccgagagcgccacccuguucaccgagaucgccaccccccacagcguguggguguucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16631 - RNA, 3799 nt, Artificial Sequence
  mRNA product Design2 comprising derived and/or modified sequence from ANDV(Chile-9717869)__AF291703.2__GP (opt4)
ggggcgcugccuacggagguggcagccaucuccuucucggcaucaagcuuaccauggagggcugguaccugguggugcugggcgugugcuacacccugacccuggccaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16632 - RNA, 3799 nt, Artificial Sequence
  mRNA product Design2 comprising derived and/or modified sequence from ANDV(Chile-9717869)__AF291703.2__IgE-leader_Gn-Gc (opt4)
ggggcgcugccuacggagguggcagccaucuccuucucggcaucaagcuuaccauggacuggaccuggauccuguuccugguggccgccgccaccagagugcacagcaugcccaagaccaucuacgagcugaagauggagugcccccacaccgugggccugggccagggcuacaucaucggcagcaccgagcugggccugaucagcaucgaggccgccagcgacaucaagcuggagagcagcugcaacuucgaccugcacaccaccagcauggcccagaagagcuucacccagguggaguggagaaagaagagcgacaccaccgacaccaccaacgccgccagcaccaccuucgaggcccagaccaagaccgugaaccugagaggcaccugcauccuggcccccgagcuguacgacacccugaagaaggugaagaagaccgugcugugcuacgaccugaccugcaaccagacccacugccagcccaccguguaccugaucgcccccgugcugaccugcaugagcaucagaagcugcauggccagcguguucaccagcagaauccaggugaucuacgagaagacccacugcgugaccggccagcugaucgagggccagugcuucaaccccgcccacacccugacccugagccagcccgcccacaccuacgacaccgugacccugcccaucagcugcuucuucacccccaagaagagcgagcagcugaaggugaucaagaccuucgagggcauccugaccaagaccggcugcaccgagaacgcccugcagggcuacuacgugugcuuccugggcagccacagcgagccccugaucgugcccagccuggaggacaucagaagcgccgagguggugagcagaaugcuggugcaccccagaggcgaggaccacgacgccauccagaacagccagagccaccugagaaucgugggccccaucaccgccaaggugcccagcaccagcagcaccgacacccugaagggcaccgccuucgccggcgugcccauguacagcagccugagcacccuggugagaaacgccgaccccgaguucguguucagccccggcaucgugcccgagagcaaccacagcaccugcgacaagaagaccgugcccaucaccuggaccggcuaccugcccaucagcggcgagauggagaaggugaccggcugcaccguguucugcacccuggccggccccggcgccagcugcgaggccuacagcgagaacggcaucuucaacaucagcagccccaccugccuggugaacaaggugcagagauucagaggcagcgagcagaagaucaacuucaucugccagagaguggaccaggacguggugguguacugcaacggccagaagaaggugauccugaccaagacccuggugaucggccagugcaucuacaccuucaccagccuguucagccugaugcccgacguggcccacagccuggccguggagcugugcgugcccggccugcacggcugggccaccgugaugcugcugagcaccuucugcuucggcugggugcugauccccgccgugacccugaucauccugaagugccugagagugcugaccuucagcugcagccacuacaccaacgagagcaaguucaaguucauccuggagaaggugaagaucgaguaccagaagaccaugggcagcauggugugcgacgugugccaccacgagugcgagaccgccaaggagcuggagagccacagacagagcugcaucaacggccagugccccuacugcaugaccaucaccgaggccaccgagagcgcccugcaggcccacuacagcaucugcaagcugaccggcagauuccaggaggcccugaagaagagccugaagaagcccgaggugaagaagggcugcuacagaacccugggcguguucagauacaagagcagaugcuacgugggccugguguggugccugcugcugaccugcgagaucgugaucugggccgccagcgccgagaccccccugauggagagcggcuggagcgacaccgcccacggcgugggcgagauccccaugaagaccgaccuggagcuggacuucagccugcccagcagcagcagcuacagcuacagaagaaagcugaccaaccccgccaacaaggaggagagcauccccuuccacuuccagauggagaagcaggugauccacgccgagauccagccccugggccacuggauggacgccaccuucaacaucaagaccgccuuccacugcuacggcgccugccagaaguacagcuaccccuggcagaccagcaagugcuucuucgagaaggacuaccaguacgagaccggcuggggcugcaaccccggcgacugccccggcgugggcaccggcugcaccgccugcggcguguaccuggacaagcugaagagcgugggcaaggccuacaagaucaucagccugaaguacaccagaaaggugugcauccagcugggcaccgagcagaccugcaagcacaucgacgccaacgacugccuggugacccccagcgugaaggugugcaucgugggcaccgugagcaagcugcagcccagcgacacccugcuguuccugggcccccuggagcagggcggcaucauccugaagcaguggugcaccaccagcugcgccuucggcgaccccggcgacaucaugagcacccccagcggcaugagaugccccgagcacaccggcagcuucagaaagaucugcggcuucgccaccacccccgugugcgaguaccagggcaacaccaucagcggcuacaagagaaugauggccaccaaggacagcuuccagagcuucaaccugaccgagccccacaucaccaccaacaagcuggaguggaucgaccccgacggcaacaccagagaccacgugaaccuggugcugaacagagacgugagcuuccaggaccugagcgacaaccccugcaagguggaccugcacacccaggccaucgagggcgccuggggcagcggcgugggcuucacccugaccugcaccgugggccugaccgagugccccagcuucaugaccagcaucaaggccugcgaccuggccaugugcuacggcagcaccgugaccaaccuggccagaggcagcaacaccgugaagguggugggcaagggcggccacagcggcagcagcuucaagugcugccacgacaccgacugcagcagcgagggccugcuggccagcgccccccaccuggagagagugaccggcuucaaccagaucgacagcgacaagguguacgacgacggcgccccccccugcaccuucaagugcugguucaccaagagcggcgaguggcugcugggcauccugaacggcaacuggaucguggugguggugcugguggugauccugauccugagcaucaucauguucagcgugcugugccccagaagaggccacaagaagaccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16633 - RNA, 1669 nt, Artificial Sequence
  mRNA product Design2 comprising derived and/or modified sequence from ANDV(Chile-9717869)__AF291702.1__N (opt3)
ggggcgcugccuacggagguggcagccaucuccuucucggcaucaagcuuaccaugagcacccugcaggagcuccaagaaaacaucacagcccacgagcagcagcuugugacugcuagacagaagcugaaagacgcagaaaaggccgucgagguugaucccgacgaugugaauaaauccacguugcaaucuaggcgggcggcuguaucaaccuuagaaacaaagcugggcgagcuaaaacgccagcucgccgaccugguggcagcccagaaacuugcuacuaagccugucgauccaaccgggcuggagccggacgaucauuugaaagaaaagaguagccuccgauacggaaacgugcuggacguuaauuccauugaucuggaggaacccucuggucagacagcagacuggaaagccauaggcgcuuauauccucggguucgccauuccuaucauuuuaaaggcgcuguacaugcuuucgacccguggaagacaaacugugaaagauaacaagggcacaaggauccgguuuaaggacgauagcucauucgaggaggucaaugguauacgcaaaccaaagcacuuguaugugaguaugcccaccgcacaguccacgaugaaagccgaagagaucacuccugggagauuuaggaccauugcuugcggacuguucccagcccagguaaaggcacggaacaucauuucucccguuaugggcgugaucggcuuuggguucuuugucaaagacuggauggaccgcauagaagaguuccuagcugccgaauguccuuuucucccaaagccgaaaguggcgagcgaggccuucauguccacaaauaagauguacuuucugaaccgacagagacaagugaaugagucaaagguccaggauauuaucgaccuuauugaucaugcagaaacugagagugcuacccuguucacagaaaucgccacgccccacagcguuuggguguuugcuugcgccccugacagguguccacccaccgcauuguauguagccggagugccugagcucggugcuuucuucucuauccugcaggauaugcggaacacuauuauggcguccaaaucagucggcacagcagaagagaaguuaaagaagaaaagcgccuuuuaccaaaguuaucugcgucgcacccagucuauggggauacagcucgaccagaagaucauuauccuuuacaugcuguccuggggaaaggaggcugugaaucauuuccacuugggcgaugacauggauccagaacuaagacaacuggcccagagccucauagacacuaaaguuaaggagauuucgaaccaggaaccccugaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16634 - RNA, 3799 nt, Artificial Sequence
  mRNA product Design2 comprising derived and/or modified sequence from ANDV(Chile-9717869)__AF291703.2__GP (opt3)
ggggcgcugccuacggagguggcagccaucuccuucucggcaucaagcuuaccauggagggcugguaccuggugguccucgggguuugcuauacccuuacacuggccaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16635 - RNA, 3799 nt, Artificial Sequence
  mRNA product Design2 comprising derived and/or modified sequence from ANDV(Chile-9717869)__AF291703.2__IgE-leader_Gn-Gc (opt3)
ggggcgcugccuacggagguggcagccaucuccuucucggcaucaagcuuaccauggacuggaccuggauccuguuccucguggccgcugcaacaagaguccacagcaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16636 - RNA, 1669 nt, Artificial Sequence
  mRNA product Design2 comprising derived and/or modified sequence from ANDV(Chile-9717869)__AF291702.1__N (opt1)
ggggcgcugccuacggagguggcagccaucuccuucucggcaucaagcuuaccaugagcacccugcaggagcuccaggagaacaucaccgcccacgagcagcagcuggugacggcccgccagaagcugaaggacgcggagaaggccgucgagguggaccccgacgacgugaacaaguccacccuccagagccggcgcgccgccgucuccacccuggagaccaagcugggcgagcucaagcggcagcuggccgaccugguggcggcccagaagcucgccacgaagccgguggaccccaccgggcuggagcccgacgaccaccugaaggagaaguccagccuccgcuacggcaacguccuggacgugaacagcaucgaccuggaggagcccuccgggcagaccgccgacuggaaggcgaucggcgccuacauccucggguucgccaucccgaucauccugaaggcccuguacaugcucagcacccggggccgccagacggugaaggacaacaagggcacccggauccgcuucaaggacgacuccagcuucgaggaggucaacgggauccggaagcccaagcaccuguacguguccaugcccaccgcccagagcaccaugaaggcggaggagaucacgcccggccgcuuccggaccaucgccugcgggcuguucccggcccaggugaaggcccgcaacaucaucucccccgucaugggcgugaucggguucggcuucuucgugaaggacuggauggaccggaucgaggaguuccucgccgcggagugccccuuccugcccaagccgaaggucgccagcgaggccuucauguccaccaacaagauguacuuccugaaccgccagcgccaggugaacgagagcaaggugcaggacaucaucgaccucaucgaccacgccgagaccgaguccgccacgcuguucaccgagaucgcgacgccccacagcgucuggguguucgccugcgcccccgaccggugcccgcccaccgcccuguacguggccggcguccccgagcucggggcguucuucuccauccugcaggacaugcggaacaccaucauggccagcaagagcgugggcaccgccgaggagaagcugaagaagaaguccgccuucuaccagagcuaccuccgccggacccaguccauggggauccagcuggaccagaagaucaucauccuguacaugcucagcuggggcaaggaggcggugaaccacuuccaccugggcgacgacauggaccccgagcugcgccagcucgcccagucccugaucgacaccaaggucaaggagaucagcaaccaggagccccugaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16637 - RNA, 3799 nt, Artificial Sequence
  mRNA product Design2 comprising derived and/or modified sequence from ANDV(Chile-9717869)__AF291703.2__GP (opt1)
ggggcgcugccuacggagguggcagccaucuccuucucggcaucaagcuuaccauggagggcugguaccuggugguccucggggugugcuacacccugacccuggccaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16638 - RNA, 3799 nt, Artificial Sequence
  mRNA product Design2 comprising derived and/or modified sequence from ANDV(Chile-9717869)__AF291703.2__IgE-leader_Gn-Gc (opt1)
ggggcgcugccuacggagguggcagccaucuccuucucggcaucaagcuuaccauggacuggaccuggauccuguuccucguggccgccgcgacccgcguccacagcaugcccaagacgaucuacgagcucaagauggagugcccgcacaccgugggccuggggcagggcuacaucaucgggagcaccgagcugggccucaucuccaucgaggccgccagcgacaucaagcuggaguccagcugcaacuucgaccugcacaccacguccauggcccagaaguccuucacccaggucgaguggcgcaagaaguccgacaccaccgacacgaccaacgccgccagcaccaccuucgaggcccagacgaagaccgugaaccuccgggggaccugcauccuggcgcccgagcuguacgacacccucaagaaggugaagaagacgguccugugcuacgaccugaccugcaaccagacccacugccagcccaccguguaccucaucgcccccgugcugacgugcaugagcauccgcagcugcauggccuccgucuucaccagccggauccaggugaucuacgagaagacccacugcgugaccgggcagcugaucgagggccagugcuucaacccggcccacacgcucacccugucccagcccgcgcacaccuacgacaccgucacgcugcccaucagcugcuucuucacccccaagaaguccgagcagcucaaggugaucaagaccuucgaggggauccugaccaagacgggcugcaccgagaacgcccugcagggguacuacgugugcuuccucggcagccacuccgagccgcugaucguccccagccuggaggacauccgcuccgccgagguggugagccggaugcucguccacccccgcggcgaggaccacgacgccauccagaacagccagucccaccuccggaucguggggcccaucaccgccaaggugccgagcaccuccagcacggacacccugaagggcaccgcguucgccgggguccccauguacuccagccuguccacccuggugcgcaacgccgaccccgaguucguguucagccccggcaucgucccggaguccaaccacagcacgugcgacaagaagaccgugcccaucaccuggaccggcuaccugcccaucuccggggagauggagaaggucaccggcugcacgguguucugcacccucgccgggcccggcgccagcugcgaggcguacuccgagaacgggaucuucaacaucagcuccccgaccugccuggugaacaagguccagcgguuccgcggcagcgagcagaagaucaacuucaucugccagcggguggaccaggacguggucguguacugcaacggccagaagaaggugauccugaccaagacgcucgucaucgggcagugcaucuacaccuucaccucccuguucagccugaugcccgacguggcccacucccucgccguggagcugugcguccccggccugcacgggugggccaccgugaugcuccugagcacguucugcuucggcugggugcugauccccgccgucacccucaucauccugaagugccugcgcgugcucaccuucagcugcucccacuacaccaacgagagcaaguucaaguucauccuggagaaggugaagaucgaguaccagaagacgaugggguccauggucugcgacgugugccaccacgagugcgagaccgcgaaggagcuggagagccaccggcaguccugcaucaacggccagugcccguacugcaugaccaucaccgaggccacggagagcgcccugcaggcccacuacuccaucugcaagcucaccggccgcuuccaggaggcccugaagaagucccugaagaagcccgaggugaagaaggggugcuaccggacccucggcgucuuccgcuacaagagccggugcuacguggggcugguguggugccugcuccugaccugcgagaucgucaucugggcggccagcgccgagacgccccugauggaguccggcuggagcgacaccgcccacggggugggcgagauccccaugaagaccgaccucgagcuggacuucucccugccgagcuccagcuccuacagcuaccgccggaagcucaccaaccccgcgaacaaggaggagagcauccccuuccacuuccagauggagaagcaggucauccacgccgagauccagccgcugggccacuggauggacgccacguucaacaucaagaccgccuuccacugcuacggggccugccagaaguacuccuaccccuggcagaccagcaagugcuucuucgagaaggacuaccaguacgagaccggcugggggugcaaccccggcgacugccccggcguggggacgggcugcaccgcgugcgggguguaccuggacaagcucaaguccgugggcaaggccuacaagaucaucagccugaaguacacccgcaaggucugcauccagcuggggaccgagcagacgugcaagcacaucgacgccaacgacugccucgugaccccguccgugaaggucugcaucgugggcaccgugagcaagcugcagcccuccgacacccuccuguuccugggcccccuggagcagggcggcaucauccucaagcaguggugcaccacgagcugcgccuucggggaccccggcgacaucauguccaccccgagcgggaugcggugccccgagcacaccggcuccuuccgcaagaucugcggcuucgccaccacgcccgucugcgaguaccaggggaacaccaucagcggcuacaagcgcaugauggcgaccaaggacuccuuccagagcuucaaccugaccgagccccacaucacgaccaacaagcuggaguggaucgacccggacgggaacacccgggaccacgugaaccucgugcugaaccgcgacgucuccuuccaggaccugagcgacaaccccugcaagguggaccuccacacccaggccaucgagggcgccuggggguccggcgugggcuucacgcugaccugcaccgucgggcugaccgagugccccagcuucaugacguccaucaaggccugcgaccucgccaugugcuacggcagcaccgugaccaaccuggcgcgggggagcaacaccgugaaggucgugggcaagggcgggcacuccggcagcuccuucaagugcugccacgacacggacugcagcuccgaggggcugcucgccagcgcgccccaccuggagcgcgugaccggcuucaaccagaucgacuccgacaaggucuacgacgacggggccccgcccugcaccuucaagugcugguucaccaagagcggcgaguggcugcucggcauccugaacgggaacuggaucgugguggucgugcuggucgugauccucauccuguccaucaucauguucagcgugcugugcccccggcgcggccacaagaagacggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16639 - RNA, 1669 nt, Artificial Sequence
  mRNA product Design2 comprising derived and/or modified sequence from ANDV(Chile-9717869)__AF291702.1__N (opt5)
ggggcgcugccuacggagguggcagccaucuccuucucggcaucaagcuuaccaugagcacccugcaggagcuccaagaaaacaucacagcccacgagcagcagcuggugacggcuagacagaaacuuaaggacgccgaaaaggcggucgagguugaucccgacgaugugaauaaauccacccugcaaucucggcgcgcugccgugagcacacucgaaaccaagcugggcgagcuuaaaagacagcuggccgaccucgucgcugcccagaagcuggcuacaaagccuguggauccgaccgggcuggagcccgacgaucaucucaaagaaaaguccucucugcgguacggaaacguucuugacgugaauagcauugaucuggaggaaccuuccggccagacagccgacuggaaagcgaucggggccuauauucucggauucgcuauccccauuauccugaaggcccuuuacaugcugucuacccgcggcagacaaacggucaaagauaacaaggggacccggauccgcuuuaaggacgauagcuccuucgaggaggugaauggaauuagaaaaccuaagcaccucuauguuagcaugcccacagcucagucuaccaugaaagccgaagagaucacaccuggccgguuucgcaccauugcgugcggccuguucccggcccaggugaaggcuagaaacaucauuucccccgucaugggggugaucggauuuggcuucuuugugaaagacuggauggaccggauugaagaguuccuggccgcugaauguccuuuucuccccaagccuaaagucgccagcgaggccuucaugucuacgaauaagauguacuuucugaaccgccagagacaaguuaaugaguccaaggugcaggauaucaucgaccuuauugaucaugcugaaacagagagcgcgacccuguucacagaaaucgccacaccccacucugugugggucuuugcuugcgccccggaccgguguccucccaccgcccucuauguggcugggguuccugagcugggagccuucuucuccauucuucaggauaugcgcaacaccaucauggcgagcaaauccgugggcacggcugaagagaagcugaaaaagaaaucugccuuuuaccaaagcuaucucagacggacccaguccauggggauucagcuggaccagaagaucaucauucuguacaugcucagcuggggaaaggaggccgucaaucauuuccaccugggcgaugacauggaucccgaacuuagacaacuggcucagucucucaucgacacaaaagugaaggagauuuccaaccaggaaccccugaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16640 - RNA, 3799 nt, Artificial Sequence
  mRNA product Design2 comprising derived and/or modified sequence from ANDV(Chile-9717869)__AF291703.2__GP (opt5)
ggggcgcugccuacggagguggcagccaucuccuucucggcaucaagcuuaccauggagggcugguaccuggugguccucgggguuugcuauacccugacacuugccaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16641 - RNA, 3799 nt, Artificial Sequence
  mRNA product Design2 comprising derived and/or modified sequence from ANDV(Chile-9717869)__AF291703.2__IgE-leader_Gn-Gc (opt5)
ggggcgcugccuacggagguggcagccaucuccuucucggcaucaagcuuaccauggacuggaccuggauccuguuccucguggccgcugccacaagaguccacagcaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16642 - RNA, 1669 nt, Artificial Sequence
  mRNA product Design2 comprising derived and/or modified sequence from ANDV(Chile-9717869)__AF291702.1__N (opt11)
ggggcgcugccuacggagguggcagccaucuccuucucggcaucaagcuuaccauguccacccuccaagaacuccaagaaaacaucacagcacacgagcaacaacucguaacugcccgucaaaaacucaaagacgcggaaaaagccgucgaagucgaccccgacgacgucaauaaauccacccuccaaucacgccgcgccgcagucagcacccucgaaaccaaacucggcgaacucaaacgacaacuagccgaccucguagcagcccaaaaacucgcaaccaaacccguagaccccaccggacuagaacccgacgaccaccucaaagaaaaauccucccuaagauacggcaacguccucgacgucaacagcaucgaccuagaggaaccaagcggccaaacagcagacuggaaagccaucggcgccuacauccuaggauucgccaucccaaucauacucaaagcccucuacaugcuuuccacacgcggacgccaaacgguuaaagacaacaaaggcacacgaauaagauuuaaagacgacagcuccuucgaagaagucaacggcauccgcaaacccaaacaccucuacguaucaaugcccaccgcccaauccaccaugaaagccgaagaaaucacacccggccgauucagaacaaucgccugcggacucuucccggcccaagucaaagcccgaaacaucauaucccccgucaugggagucaucggcuucggcuucuucgucaaagacuggauggaccgcaucgaagaguuccucgccgccgaaugcccauucuuaccaaaaccgaaagucgccuccgaggcuuucaugucuacgaacaaaauguacuuccucaacagacaacgccaagucaacgaaucaaaaguccaagacauaaucgacuuaaucgaccaugcagaaacagaauccgccacccucuucaccgaaauagccacaccccacagcgucugggucuucgccugcgcccccgaccgaugcccaccaaccgcccuauauguagccggcguacccgaacucggcgccuucuucucaauccuccaagacaugaggaacaccaucauggcauccaaaucaguaggcaccgccgaagaaaagcuaaagaagaaaagcgcauucuaccaaagcuaccuacgacgcacccaaucaaugggaauccaacucgaccagaaaaucauaauccuauacaugcucuccuggggaaaagaagcaguaaaccacuuccaccuaggcgacgacauggaccccgaacuccgccaacucgcccaaucacucaucgacacuaaaguaaaagagauauccaaccaagaaccacucaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16643 - RNA, 3799 nt, Artificial Sequence
  mRNA product Design2 comprising derived and/or modified sequence from ANDV(Chile-9717869)__AF291703.2__GP (opt11)
ggggcgcugccuacggagguggcagccaucuccuucucggcaucaagcuuaccauggaggggugguacuuagucguauugggagucugcuacacacugacacuugccaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16644 - RNA, 3799 nt, Artificial Sequence
  mRNA product Design2 comprising derived and/or modified sequence from ANDV(Chile-9717869)__AF291703.2__IgE-leader_Gn-Gc (opt11)
ggggcgcugccuacggagguggcagccaucuccuucucggcaucaagcuuaccauggauuggacguggauacucuuucucguggccgcggccacgcgcgugcacucgaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16645 - protein, 429 aa, Artificial Sequence; identical to SEQ ID NO: 249
  derived and/or modified protein sequence (wt) from DOBV(DOBV/Ano-Poroia/Afl9/1999)__NC_005233.1__N

SEQ ID NO: 16646 - protein, 1135 aa, Artificial Sequence; identical to SEQ ID NO: 933
  derived and/or modified protein sequence (wt) from DOBV(DOBV/Ano-Poroia/Afl9/1999)__NC_005234.1__GP

SEQ ID NO: 16647 - protein, 1135 aa, Artificial Sequence
  derived and/or modified protein sequence (wt) from DOBV(DOBV/Ano-Poroia/Afl9/1999)__NC_005234.1__IgE-leader_Gn-Gc
MDWTWILFLVAAATRVHSLRNVYDMKIECPHSINFGESSVTGKVELPPLLLTDAEALVPESSCNMDNHQSMSIIQKVTKVSWRKKADKAQAAKDSFETTSSEVNLKGTCALSHRMVEESYRNRRSVICYDLSCNSTHCKPTMHMIVPVHSCNMMKSCLVGLGPYRIQIVYERTYCTTGILTEGKCFVPDQSIVNVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPVIYSPGLFPRLNQSSCDKIALPLIWEGYIDLPGYYETVHPCNVFCVLSGPGASCEAFSEGGIFNITSPTCLVSKQNRFRAAEQQVNFVCQRVDQDIVIYCNGQKKTILTKTLVIGQCIYSVTSLFSIMPGVAHSIAIELCVPGFHGWATAALLTTFCFGWILILSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASETVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENNWGCNPADCPGIGTGCTACGLYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQESEKVYDDGAPQCGISCWFVKSGEWITGIFNGNWIVIVVLVFFFILSLILLSLLCPIRKHKRS

SEQ ID NO: 16648 - RNA, 1290 nt, Artificial Sequence; identical to SEQ ID NO: 2584
  derived and/or modified CDS sequence (wt) from DOBV(DOBV/Ano-Poroia/Afl9/1999)__NC_005233.1__N

SEQ ID NO: 16649 - RNA, 1290 nt, Artificial Sequence
  derived and/or modified CDS sequence (wt) from DOBV(DOBV/Ano-Poroia/Afl9/1999)__NC_005233.1__N
auggcaacauuagaggaacuccaaaaagaaaucaacaaccacgagggccaauuggugauagccaggcagaaggugaaagaugcagaaaagcaguaugaaaaggauccugacgaccugaauaaaagggcauugagugaccgggaaagcauugcacaaucaauucagggaaaaauagaugaauuaaggagacagcuggcugaucguguggcagcagggaaaaacauuggcaaagagagggacccaacuggacuagacccuggagaucaccucaaagagaagucaaugcucaguuauggaaaugucauugaccucaaccaucuugacauugaugaaccuacagggcaaaccgcagacuggcugagcauuguggucuaccugacaucauucgugguuccaauauuguugaaggcucuuuacaugcuuaccaccagagggagacaaacuacuaaagacaauaagggaaugagaauccgauuuaaggaugacagcucuuuugaagaugugaaugggauuagaaagccaaagcaccuguucuugucaaugcccaaugcacaaucuagcaugaaggcagaugagauuacaccaggucgguucaggacugcaauuuguggacuauacccagcccaggugaaggcaaggaacuuaaucaguccugugaugagugugauuggguuuuuagcccuugcaaagaacuggacagagcggguugaggaauggcuugaccucccgugcaagcuacuaucugagccaucuccaacgucuuugaccaaaggcccauccaccaaucgugacuacuugaaucaaagacaaggagcgcuugcaaaaauggaaacaaaagaagcucaggcugugaggaaacaugccauagaugcuggcugcaaccuuaucgaccauauagacucaccaucaucaaucugggucuuugcaggagcacccgacagaugcccuccuaccugccuguucauugcaggcauggcagagcuaggugcauucuuugcuguucuccaggauaugaggaacaccaucauggcgucaaaaacuaucggaacaucugaggagaagcuaaagaagaaaucaucuuuuuaccaaucuuaccuacggaggacacaaucuauggggauacaacuggaccagcgcaucaucgugcuguucaugguugacuggggaaaagaggcaguugauaguuuucaucuuggugaugauauggauccugagcuccggggccuggcacaggcauuaauugaucaaaaagugaaggaaauaucuaaucaggaaccgcuuaagcuguaa

SEQ ID NO: 16650 - RNA, 3408 nt, Artificial Sequence; identical to SEQ ID NO: 3268
  derived and/or modified CDS sequence (wt) from DOBV(DOBV/Ano-Poroia/Afl9/1999)__NC_005234.1__GP

SEQ ID NO: 16651 - RNA, 3408 nt, Artificial Sequence
  derived and/or modified CDS sequence (wt) from DOBV(DOBV/Ano-Poroia/Afl9/1999)__NC_005234.1__GP
augaucaugugggguuuacuauugacaaugauuuugaucgauuuuggggcauccuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaa

SEQ ID NO: 16652 - RNA, 3408 nt, Artificial Sequence
  derived and/or modified CDS sequence (wt) from DOBV(DOBV/Ano-Poroia/Afl9/1999)__NC_005234.1__IgE-leader_Gn-Gc
auggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacuaguuuauuuucaauaaugccugggguagcacauucaauugcaauugaauuauguguaccaggguuccaugguugggcaacugcugcucuucucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacuaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcucuucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaa

SEQ ID NO: 16653 - RNA, 3408 nt, Artificial Sequence
  derived and/or modified CDS sequence (wt) from DOBV(DOBV/Ano-Poroia/Afl9/1999)__NC_005234.1__IgE-leader_Gn-Gc
auggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaa

SEQ ID NO: 16654 - RNA, 1290 nt, Artificial Sequence; identical to SEQ ID NO: 4919
  derived and/or modified CDS sequence (opt4) from DOBV(DOBV/Ano-Poroia/Afl9/1999)__NC_005233.1__N

SEQ ID NO: 16655 - RNA, 3408 nt, Artificial Sequence; identical to SEQ ID NO: 8371
  derived and/or modified CDS sequence (opt4) from DOBV(DOBV/Ano-Poroia/Afl9/1999)__NC_005234.1__GP

SEQ ID NO: 16656 - RNA, 3408 nt, Artificial Sequence
  derived and/or modified CDS sequence (opt4) from DOBV(DOBV/Ano-Poroia/Afl9/1999)__NC_005234.1__IgE-leader_Gn-Gc
auggacuggaccuggauccuguuccugguggccgccgccaccagagugcacagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcuga

SEQ ID NO: 16657 - RNA, 1290 nt, Artificial Sequence; identical to SEQ ID NO: 5611
  derived and/or modified CDS sequence (opt3) from DOBV(DOBV/Ano-Poroia/Afl9/1999)__NC_005233.1__N

SEQ ID NO: 16658 - RNA, 3408 nt, Artificial Sequence; identical to SEQ ID NO: 10014
  derived and/or modified CDS sequence (opt3) from DOBV(DOBV/Ano-Poroia/Afl9/1999)__NC_005234.1__GP

SEQ ID NO: 16659 - RNA, 3408 nt, Artificial Sequence
  derived and/or modified CDS sequence (opt3) from DOBV(DOBV/Ano-Poroia/Afl9/1999)__NC_005234.1__IgE-leader_Gn-Gc
auggacuggaccuggauccuguuccucguggccgcugcaacaagaguccacagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucauga

SEQ ID NO: 16660 - RNA, 1290 nt, Artificial Sequence; identical to SEQ ID NO: 6303
  derived and/or modified CDS sequence (opt1) from DOBV(DOBV/Ano-Poroia/Afl9/1999)__NC_005233.1__N

SEQ ID NO: 16661 - RNA, 3408 nt, Artificial Sequence; identical to SEQ ID NO: 11657
  derived and/or modified CDS sequence (opt1) from DOBV(DOBV/Ano-Poroia/Afl9/1999)__NC_005234.1__GP

SEQ ID NO: 16662 - RNA, 3408 nt, Artificial Sequence
  derived and/or modified CDS sequence (opt1) from DOBV(DOBV/Ano-Poroia/Afl9/1999)__NC_005234.1__IgE-leader_Gn-Gc
auggacuggaccuggauccuguuccucguggccgccgcgacccgcguccacagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcuga

SEQ ID NO: 16663 - RNA, 1290 nt, Artificial Sequence; identical to SEQ ID NO: 6995
  derived and/or modified CDS sequence (opt5) from DOBV(DOBV/Ano-Poroia/Afl9/1999)__NC_005233.1__N

SEQ ID NO: 16664 - RNA, 3408 nt, Artificial Sequence; identical to SEQ ID NO: 13300
  derived and/or modified CDS sequence (opt5) from DOBV(DOBV/Ano-Poroia/Afl9/1999)__NC_005234.1__GP

SEQ ID NO: 16665 - RNA, 3408 nt, Artificial Sequence
  derived and/or modified CDS sequence (opt5) from DOBV(DOBV/Ano-Poroia/Afl9/1999)__NC_005234.1__IgE-leader_Gn-Gc
auggacuggaccuggauccuguuccucguggccgcugccacaagaguccacagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccuga

SEQ ID NO: 16666 - RNA, 1290 nt, Artificial Sequence; identical to SEQ ID NO: 7687
  derived and/or modified CDS sequence (opt11) from DOBV(DOBV/Ano-Poroia/Afl9/1999)__NC_005233.1__N

SEQ ID NO: 16667 - RNA, 3408 nt, Artificial Sequence; identical to SEQ ID NO: 11657
  derived and/or modified CDS sequence (opt11) from DOBV(DOBV/Ano-Poroia/Afl9/1999)__NC_005234.1__GP

SEQ ID NO: 16668 - RNA, 3408 nt, Artificial Sequence
  derived and/or modified CDS sequence (opt11) from DOBV(DOBV/Ano-Poroia/Afl9/1999)__NC_005234.1__IgE-leader_Gn-Gc
auggauuggacguggauacucuuucucguggccgcggccacgcgcgugcacucgcuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcuga

SEQ ID NO: 16669 - RNA, 1507 nt, Artificial Sequence
  mRNA product Design1 comprising derived and/or modified sequence from DOBV(DOBV/Ano-Poroia/Afl9/1999)__NC_005233.1__N (wt)
gggagaaagcuuaccauggcaacauuagaggaacuccaaaaagaaaucaacaaccacgagggccaauuggugauagccaggcagaaggugaaagaugcagaaaagcaguaugaaaaggauccugacgaccugaauaaaagggcauugagugaccgggaaagcauugcacaaucaauucagggaaaaauagaugaauuaaggagacagcuggcugaucguguggcagcagggaaaaacauuggcaaagagagggacccaacuggacuagacccuggagaucaccucaaagagaagucaaugcucaguuauggaaaugucauugaccucaaccaucuugacauugaugaaccuacagggcaaaccgcagacuggcugagcauuguggucuaccugacaucauucgugguuccaauauuguugaaggcucuuuacaugcuuaccaccagagggagacaaacuacuaaagacaauaagggaaugagaauucgauuuaaggaugacagcucuuuugaagaugugaaugggauuagaaagccaaagcaccuguucuugucaaugcccaaugcacaaucuagcaugaaggcagaugagauuacaccaggucgguucaggacugcaauuuguggacuauacccagcccaggugaaggcaaggaacuuaaucaguccugugaugagugugauuggguuuuuagcccuugcaaagaacuggacagagcggguugaggaauggcuugaccucccgugcaagcuacuaucugagccaucuccaacgucuuugaccaaaggcccauccaccaaucgugacuacuugaaucaaagacaaggagcgcuugcaaaaauggaaacaaaagaagcucaggcugugaggaaacaugccauagaugcuggcugcaaccuuaucgaccauauagacucaccaucaucaaucugggucuuugcaggagcacccgacagaugcccuccuaccugccuguucauugcaggcauggcagagcuaggugcauucuuugcuguucuccaggauaugaggaacaccaucauggcgucaaaaacuaucggaacaucugaggagaagcuaaagaagaaaucaucuuuuuaccaaucuuaccuacggaggacacaaucuauggggauacaacuggaccagcgcaucaucgugcucuucaugguugacuggggaaaagaggcaguugauaguuuucaucuuggugaugauauggauccugagcuccggggccuggcacaggcauuaauugaucaaaaagugaaggaaauaucuaaucaggaaccgcuuaagcuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16670 - RNA, 1507 nt, Artificial Sequence
  mRNA product Design1 comprising derived and/or modified sequence from DOBV(DOBV/Ano-Poroia/Afl9/1999)__NC_005233.1__N (wt)
gggagaaagcuuaccauggcaacauuagaggaacuccaaaaagaaaucaacaaccacgagggccaauuggugauagccaggcagaaggugaaagaugcagaaaagcaguaugaaaaggauccugacgaccugaauaaaagggcauugagugaccgggaaagcauugcacaaucaauucagggaaaaauagaugaauuaaggagacagcuggcugaucguguggcagcagggaaaaacauuggcaaagagagggacccaacuggacuagacccuggagaucaccucaaagagaagucaaugcucaguuauggaaaugucauugaccucaaccaucuugacauugaugaaccuacagggcaaaccgcagacuggcugagcauuguggucuaccugacaucauucgugguuccaauauuguugaaggcucuuuacaugcuuaccaccagagggagacaaacuacuaaagacaauaagggaaugagaauccgauuuaaggaugacagcucuuuugaagaugugaaugggauuagaaagccaaagcaccuguucuugucaaugcccaaugcacaaucuagcaugaaggcagaugagauuacaccaggucgguucaggacugcaauuuguggacuauacccagcccaggugaaggcaaggaacuuaaucaguccugugaugagugugauuggguuuuuagcccuugcaaagaacuggacagagcggguugaggaauggcuugaccucccgugcaagcuacuaucugagccaucuccaacgucuuugaccaaaggcccauccaccaaucgugacuacuugaaucaaagacaaggagcgcuugcaaaaauggaaacaaaagaagcucaggcugugaggaaacaugccauagaugcuggcugcaaccuuaucgaccauauagacucaccaucaucaaucugggucuuugcaggagcacccgacagaugcccuccuaccugccuguucauugcaggcauggcagagcuaggugcauucuuugcuguucuccaggauaugaggaacaccaucauggcgucaaaaacuaucggaacaucugaggagaagcuaaagaagaaaucaucuuuuuaccaaucuuaccuacggaggacacaaucuauggggauacaacuggaccagcgcaucaucgugcuguucaugguugacuggggaaaagaggcaguugauaguuuucaucuuggugaugauauggauccugagcuccggggccuggcacaggcauuaauugaucaaaaagugaaggaaauaucuaaucaggaaccgcuuaagcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16671 - RNA, 3625 nt, Artificial Sequence
  mRNA product Design1 comprising derived and/or modified sequence from DOBV(DOBV/Ano-Poroia/Afl9/1999)__NC_005234.1__GP (wt)
gggagaaagcuuaccaugaucaugugggguuuacuauugacaaugauuuugaucgauuuuggggcauccuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacuaguuuauuuucaauaaugccugggguagcacauucaauugcaauugaauuauguguaccaggguuccaugguugggcaacugcugcucuucucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacuaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcucuucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16672 - RNA, 3625 nt, Artificial Sequence
  mRNA product Design1 comprising derived and/or modified sequence from DOBV(DOBV/Ano-Poroia/Afl9/1999)__NC_005234.1__GP (wt)
gggagaaagcuuaccaugaucaugugggguuuacuauugacaaugauuuugaucgauuuuggggcauccuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16673 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (wt)
gggagaaagcuuaccauggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacuaguuuauuuucaauaaugccugggguagcacauucaauugcaauugaauuauguguaccaggguuccaugguugggcaacugcugcucuucucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacuaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcucuucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16674 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (wt)
gggagaaagcuuaccauggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16675 - RNA, 1507 nt, Artificial Sequence
  mRNA product Design1 comprising derived and/or modified sequence from DOBV(DOBV/Ano-Poroia/Afl9/1999)__NC_005233.1__N (opt4)
gggagaaagcuuaccauggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16676 - RNA, 3625 nt, Artificial Sequence
  mRNA product Design1 comprising derived and/or modified sequence from DOBV(DOBV/Ano-Poroia/Afl9/1999)__NC_005234.1__GP (opt4)
gggagaaagcuuaccaugaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16677 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (opt4)
gggagaaagcuuaccauggacuggaccuggauccuguuccugguggccgccgccaccagagugcacagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16678 - RNA, 1507 nt, Artificial Sequence
  mRNA product Design1 comprising derived and/or modified sequence from DOBV(DOBV/Ano-Poroia/Afl9/1999)__NC_005233.1__N (opt3)
gggagaaagcuuaccauggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcaguaugaaagccgaugagauuacccccggccgguuccgcacugcuaucugcggcuuguacccugcccaggugaaggcgcgaaaucugauauccccagucaugucugugauuggguuucuagcacucgccaaaaacuggacagaaagaguagaggaauggcuggaccuucccuguaagcuguugagcgagccuuccccaaccucacucacgaaaggaccgaguacuaauagggauuaucugaaccagcggcagggugcuuuagccaagauggaaaccaaggaggcacaagcuguucguaaacacgccaucgacgcgggcugcaaucugauugaucauaucgacagccccucuuccaucuggguguucgccggggcaccugaucgcuguccacccacaugccucuuuauugcuggaauggccgagcuuggcgcuuucuuugccguccugcaggacaugagaaacacuauaauggcaucaaagaccaucgguacaagcgaagagaaauugaagaaaaagaguucuuucuaccaguccuaucuaaggcggacccaaagcauggggauucagcuggaucagcgaaucauagugcucuuuaugguggacuggggaaaggaagccgucgacucguuccaccugggcgaugacauggauccugagcuucgcggccuggcucaggcguugauugaccaaaaaguuaaggaaaucucuaaucaggagccacucaaacugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16679 - RNA, 3625 nt, Artificial Sequence
  mRNA product Design1 comprising derived and/or modified sequence from DOBV(DOBV/Ano-Poroia/Afl9/1999)__NC_005234.1__GP (opt3)
gggagaaagcuuaccaugaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16680 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (opt3)
gggagaaagcuuaccauggacuggaccuggauccuguuccucguggccgcugcaacaagaguccacagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16681 - RNA, 1507 nt, Artificial Sequence
  mRNA product Design1 comprising derived and/or modified sequence from DOBV(DOBV/Ano-Poroia/Afl9/1999)__NC_005233.1__N (opt1)
gggagaaagcuuaccauggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggucauguccgugaucggcuuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggggcccuggccaagauggagaccaaggaggcccaggccguccgcaagcacgcgaucgacgccggcugcaaccucaucgaccacaucgacagccccuccagcaucuggguguucgccggggcccccgaccggugcccgccgaccugccuguucaucgccggcauggcggagcugggcgccuucuucgccgugcuccaggacaugcgcaacaccaucauggccagcaagacgaucgggaccuccgaggagaagcugaagaagaaguccagcuucuaccagagcuaccugcggcgcacccaguccaugggcauccagcucgaccagcgcaucaucguccuguucaugguggacugggggaaggaggccguggacagcuuccaccugggcgacgacauggaccccgagcuccgggggcuggcgcaggcccugaucgaccagaaggucaaggagaucuccaaccaggagccccucaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16682 - RNA, 3625 nt, Artificial Sequence
  mRNA product Design1 comprising derived and/or modified sequence from DOBV(DOBV/Ano-Poroia/Afl9/1999)__NC_005234.1__GP (opt1)
gggagaaagcuuaccaugaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16683 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (opt1)
gggagaaagcuuaccauggacuggaccuggauccuguuccucguggccgccgcgacccgcguccacagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16684 - RNA, 1507 nt, Artificial Sequence
  mRNA product Design1 comprising derived and/or modified sequence from DOBV(DOBV/Ano-Poroia/Afl9/1999)__NC_005233.1__N (opt5)
gggagaaagcuuaccauggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcaugaaagcggaugagauuacccccgggagauuccggacggccaucugcggacucuacccugcucaggucaaggcccgcaaucugauuucuccggugauguccguuaucggcuuucuggcucucgccaaaaacuggaccgaaagaguggaggaauggcuggaccuucccuguaagcugcucagcgagccuucucccacaucccugaccaaagggccuagcacaaaucgggauuaucuuaaccagcgccagggagcgcuggccaagauggaaaccaaggaggcucaagccgucagaaaacacgcuaucgacgccggcugcaaucucauugaucauaucgacucucccuccagcauuuggguguucgccggggcuccggaucgguguccucccacgugccuguuuaucgcgggaauggccgagcugggcgcuuucuuugccgugcuccaggacaugagaaacacaauuauggccuccaagaccaucggcacaucugaagagaaacugaagaaaaagagcuccuucuaccagagcuaucuucgccggacccaaucuauggggauccagcuggaucagagaauuaucguccucuuuaugguugacuggggaaaggaagcuguggacuccuuccaccugggcgaugacauggauccugagcuucgcgggcuggcccaggcgcucauugaccaaaaagugaaggaaaucagcaaucaggagccccugaaacugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16685 - RNA, 3625 nt, Artificial Sequence
  mRNA product Design1 comprising derived and/or modified sequence from DOBV(DOBV/Ano-Poroia/Afl9/1999)__NC_005234.1__GP (opt5)
gggagaaagcuuaccaugaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16686 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (opt5)
gggagaaagcuuaccauggacuggaccuggauccuguuccucguggccgcugccacaagaguccacagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16687 - RNA, 1507 nt, Artificial Sequence
  mRNA product Design1 comprising derived and/or modified sequence from DOBV(DOBV/Ano-Poroia/Afl9/1999)__NC_005233.1__N (opt11)
gggagaaagcuuaccauggccacccuagaagaacuccaaaaagaaaucaacaaccacgaaggacaacucguaaucgcacgccaaaaagucaaagacgccgaaaaacaauacgaaaaagaccccgacgaucuuaacaaacgagcacucucagaccgcgaaagcaucgcccaaagcauccaaggaaaaauagacgaacuccgccgucaacucgcagaccgagucgcagcaggcaaaaacaucggaaaagaacgcgacccuaccggccuugacccaggcgaccaccugaaagaaaaaucaaugcuaagcuacggcaacgucaucgaccuuaaccaccuagacauugacgagccaacaggccaaaccgccgacuggcuauccaucgucguauaccugaccucauucguaguccccauccuccuaaaagcccucuacaugcucaccacccgcggcagacaaacaaccaaagacaacaaaggcaugagaauacgcuucaaagacgacaguuccuucgaagacguuaacggcaucagaaaacccaaacaccucuuucucuccaugcccaacgcacaauccucaaugaaagccgacgaaaucacaccuggccgcuuccgaaccgccaucugcggacucuaccccgcacaagucaaagccagaaaccucaucucccccgucauguccgucauaggauuccucgcccucgccaaaaacuggacagaacgcgucgaagaauggcuagaccuacccugcaaacucuuauccgagcccagccccaccucccucacaaaaggccccucaacaaaccgcgacuaccucaaccaacgccaaggugcacucgcaaaaauggaaacuaaagaagcccaagccguccgcaaacacgccaucgacgccggcugcaaccucaucgaccacaucgacagcccgagcuccaucugggucuucgccggcgcaccagaccgcugcccaccaaccugccucuucaucgccggcauggcagaacucggcgccuucuucgccguacuccaagacaugcguaacaccaucauggcaagcaagaccaucggaaccuccgaagaaaaacuuaagaaaaagucaucauucuaccaauccuaccuccgccgaacccaaagcaugggcauccaacuagaccagcgcauaaucguccucuucauggucgacuggggaaaagaagcagucgauuccuuccaccucggagacgacauggacccagagcuacgaggccucgcgcaagcccucauagaccaaaaaguaaaagagaucuccaaucaagaaccacucaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16688 - RNA, 3625 nt, Artificial Sequence; identical to SEQ ID NO: 16682
  mRNA product Design1 comprising derived and/or modified sequence from DOBV(DOBV/Ano-Poroia/Afl9/1999)__NC_005234.1__GP (opt11)

SEQ ID NO: 16689 - RNA, 3625 nt, Artificial Sequence
  mRNA product Design1 comprising derived and/or modified sequence from DOBV(DOBV/Ano-Poroia/Afl9/1999)__NC_005234.1__IgE-leader_Gn-Gc (opt11)
gggagaaagcuuaccauggauuggacguggauacucuuucucguggccgcggccacgcgcgugcacucgcuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16690 - RNA, 1672 nt, Artificial Sequence
  mRNA product Design2 comprising derived and/or modified sequence from DOBV(DOBV/Ano-Poroia/Afl9/1999)__NC_005233.1__N (wt)
ggggcgcugccuacggagguggcagccaucuccuucucggcaucaagcuuaccauggcaacauuagaggaacuccaaaaagaaaucaacaaccacgagggccaauuggugauagccaggcagaaggugaaagaugcagaaaagcaguaugaaaaggauccugacgaccugaauaaaagggcauugagugaccgggaaagcauugcacaaucaauucagggaaaaauagaugaauuaaggagacagcuggcugaucguguggcagcagggaaaaacauuggcaaagagagggacccaacuggacuagacccuggagaucaccucaaagagaagucaaugcucaguuauggaaaugucauugaccucaaccaucuugacauugaugaaccuacagggcaaaccgcagacuggcugagcauuguggucuaccugacaucauucgugguuccaauauuguugaaggcucuuuacaugcuuaccaccagagggagacaaacuacuaaagacaauaagggaaugagaauucgauuuaaggaugacagcucuuuugaagaugugaaugggauuagaaagccaaagcaccuguucuugucaaugcccaaugcacaaucuagcaugaaggcagaugagauuacaccaggucgguucaggacugcaauuuguggacuauacccagcccaggugaaggcaaggaacuuaaucaguccugugaugagugugauuggguuuuuagcccuugcaaagaacuggacagagcggguugaggaauggcuugaccucccgugcaagcuacuaucugagccaucuccaacgucuuugaccaaaggcccauccaccaaucgugacuacuugaaucaaagacaaggagcgcuugcaaaaauggaaacaaaagaagcucaggcugugaggaaacaugccauagaugcuggcugcaaccuuaucgaccauauagacucaccaucaucaaucugggucuuugcaggagcacccgacagaugcccuccuaccugccuguucauugcaggcauggcagagcuaggugcauucuuugcuguucuccaggauaugaggaacaccaucauggcgucaaaaacuaucggaacaucugaggagaagcuaaagaagaaaucaucuuuuuaccaaucuuaccuacggaggacacaaucuauggggauacaacuggaccagcgcaucaucgugcucuucaugguugacuggggaaaagaggcaguugauaguuuucaucuuggugaugauauggauccugagcuccggggccuggcacaggcauuaauugaucaaaaagugaaggaaauaucuaaucaggaaccgcuuaagcuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16691 - RNA, 1672 nt, Artificial Sequence
  mRNA product Design2 comprising derived and/or modified sequence from DOBV(DOBV/Ano-Poroia/Afl9/1999)__NC_005233.1__N (wt)
ggggcgcugccuacggagguggcagccaucuccuucucggcaucaagcuuaccauggcaacauuagaggaacuccaaaaagaaaucaacaaccacgagggccaauuggugauagccaggcagaaggugaaagaugcagaaaagcaguaugaaaaggauccugacgaccugaauaaaagggcauugagugaccgggaaagcauugcacaaucaauucagggaaaaauagaugaauuaaggagacagcuggcugaucguguggcagcagggaaaaacauuggcaaagagagggacccaacuggacuagacccuggagaucaccucaaagagaagucaaugcucaguuauggaaaugucauugaccucaaccaucuugacauugaugaaccuacagggcaaaccgcagacuggcugagcauuguggucuaccugacaucauucgugguuccaauauuguugaaggcucuuuacaugcuuaccaccagagggagacaaacuacuaaagacaauaagggaaugagaauccgauuuaaggaugacagcucuuuugaagaugugaaugggauuagaaagccaaagcaccuguucuugucaaugcccaaugcacaaucuagcaugaaggcagaugagauuacaccaggucgguucaggacugcaauuuguggacuauacccagcccaggugaaggcaaggaacuuaaucaguccugugaugagugugauuggguuuuuagcccuugcaaagaacuggacagagcggguugaggaauggcuugaccucccgugcaagcuacuaucugagccaucuccaacgucuuugaccaaaggcccauccaccaaucgugacuacuugaaucaaagacaaggagcgcuugcaaaaauggaaacaaaagaagcucaggcugugaggaaacaugccauagaugcuggcugcaaccuuaucgaccauauagacucaccaucaucaaucugggucuuugcaggagcacccgacagaugcccuccuaccugccuguucauugcaggcauggcagagcuaggugcauucuuugcuguucuccaggauaugaggaacaccaucauggcgucaaaaacuaucggaacaucugaggagaagcuaaagaagaaaucaucuuuuuaccaaucuuaccuacggaggacacaaucuauggggauacaacuggaccagcgcaucaucgugcuguucaugguugacuggggaaaagaggcaguugauaguuuucaucuuggugaugauauggauccugagcuccggggccuggcacaggcauuaauugaucaaaaagugaaggaaauaucuaaucaggaaccgcuuaagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16692 - RNA, 3790 nt, Artificial Sequence
  mRNA product Design2 comprising derived and/or modified sequence from DOBV(DOBV/Ano-Poroia/Afl9/1999)__NC_005234.1__GP (wt)
ggggcgcugccuacggagguggcagccaucuccuucucggcaucaagcuuaccaugaucaugugggguuuacuauugacaaugauuuugaucgauuuuggggcauccuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacuaguuuauuuucaauaaugccugggguagcacauucaauugcaauugaauuauguguaccaggguuccaugguugggcaacugcugcucuucucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacuaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcucuucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16693 - RNA, 3790 nt, Artificial Sequence
  mRNA product Design2 comprising derived and/or modified sequence from DOBV(DOBV/Ano-Poroia/Afl9/1999)__NC_005234.1__GP (wt)
ggggcgcugccuacggagguggcagccaucuccuucucggcaucaagcuuaccaugaucaugugggguuuacuauugacaaugauuuugaucgauuuuggggcauccuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16694 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacuaguuuauuuucaauaaugccugggguagcacauucaauugcaauugaauuauguguaccaggguuccaugguugggcaacugcugcucuucucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacuaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcucuucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16695 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcuuaaggaaugucuaugacaugaaaauagaaugcccacauucaaucaacuuuggggagaguaguguaacagguaagguggagcugccaccccuucugcuuacagaugcagaggccuuggucccggaaaguucuuguaacauggacaaccaucaguccaugucaauuauacaaaaagugacaaaaguaagcuggagaaaaaaggcagacaaagcccaagcugccaaggacucauuugagacaacaucaagugagguuaacuuaaagggaacaugugcauugagucauaggaugguugaagaaucuuacagaaauaggagaucaguaauauguuaugacuugucuugcaauucaacacauugcaagccaacgaugcauaugauuguaccugugcacucaugcaacaugaugaaaagcugccugguugggcuugggccuuauagaauccaaaucgucuaugagagaaccuacuguacaacugguauacuaacagaagggaaguguuuugugccagaccagaguauuguuaauguuaucaagaaugggguguucgacaucgcaagugugagcauugucuguuuuuucaucagaguuaaagggaccaacuacaagauaauggcaaguauuaaaacagcaacugcaaauaacuguaaugacacugacaacaagguucaaggauauuaccuuuguauugucgggggaaauucuucuccuguguaugcaccuucaaccacugauuuuagaucuauggaggcacuugcuagccuuuuaagagcuccucauggugaagaccaugauuuaucuggagaagagguggcaacuuacucaauugccgggcaaauugaaggcaaaaucccacauacugcaaaugcagcaaacaugcuguuuacugcauucucaggaaucccuaguuacucuucauuaaguguuuuuaucggaagucaggacggaccuguuauauauagcccaggauuguuuccuagguugaaccaaucuucaugugauaagauugcacuaccauuaauaugggaaggauauauagaucugccuggcuauuaugaaacaguucacccauguaaugucuuuuguguguuaucuggcccaggggcaucaugugaggcauucucagaaggugguauuuucaacauuacauccccuacuugccuugugucaaagcaaaauagguucagagcugcugagcagcaagucaacuuugugugccagcgaguugaccaagauauugucaucuacuguaauggacaaaagaagacaauuuuaacuaagacauuagugauugggcaguguauuuacucagugacaaguuuauuuucaauaaugccugggguagcacauucaauugcaauugaauuauguguaccaggguuccaugguugggcaacugcugcucugcucacuacauucugcuuuggcuggauacugauccuuuccauuacauuagcuguguugguuguccugaaguuuuuugccgcaaucuuacauaauagcucucaagaaaaccgguuuaaaauuaucuuaagaaagauuaaagaagaauuugaaaagacuaaaggcucaauggucugugaagugugcaaguaugagugugaaacagggaaggagcuuaaagcccauaauuuaucuugcccucagucacaguguccuuauugcuuuacacacugugagccuacagaaucugccuuucaagcacauuauaaagugugccaagcaacacacagauuuagggaugauuuaaagaaaacaauaacaccucaaucaacaagcccagguuguuaccggacauuaaaucuuuuuagguauaaaaguagauguuacaucuuuacagugugggugaccuuacuaaucauugaaucaaucaugugggcagcuagugcaucagaaacugucuuggagccaagcuggaaugacaaugcacaugguguuggcguugucccaaugcauacugaccuggaacuugauuucucucuuccaucaaguucuaaguacacauauaagagaaaacugacaaguccauugaaucaagaacaaucaguagaucuucacauagagauagagagucaagggaucucuacaaguguucaugcauuaggucauugguuugauggaaggcuuaaccuaaagacaucuuuucauuguuauggugcauguacuaaguaugaauacccuuggcacacggcaaaaugccacuuugaaagagauuucgaauaugagaacaauuggggguguaauccugcugauugcccugggauugguacuggcuguacugcaugcgggcuauacauugaccagcuuaaaccuguaggcagugcauauaagcugaucacaguccguuacagccguaaaguauguguucaguuuggugaagaaaaucuaugcaagacaauugauaugaaugauugcuuuguuacaagacauguuaaaguauguaucaucgguacaguuucaaaguucucgcaaggugauacccuaguauuccuaggcccuauggaagguggggguuugauauuuaaggauuggugcacuagcacaugccaauuuggugauccaggagacauuaugaguccuaaagacaaagguuucagcugcccugacuucacaggccauuuccggaaaaaaugcaacuuugcaacaacaccugugugcgaguaugaugguaauauggucucuggguauaagaaaguaauggcaacuauugauuccuuucaaucauuuaacacaaguucaauucauuauacagaugaaaggauugaguggaaagacccggauggaaugcuuaaggaccaccuuaauauacuugucacaaaggauauugacuuugaaaaccuuggagagaacccguguaaaguaggacuucaaacaucaucaauagaaggugcaugggguucugggguugguuucacucucacuugucaaaucucacugacagaguguucacgcuuucuaacaucaaucaaagcaugugacauggcaauuuguuauggugcacaaaguguuacacucauuagaggccaaaacacagugaagguuuccgggaagggugggcauaguggcuccucauucaaguguugccauggaacagauugcucucaacaggggcuacaagcaagugcaccgcaccuggauaaggucaaugggauuguugaacaagagagugagaagguuuaugaugauggugcaccacaauguggcauuucaugcugguuuguuaagucuggggaguggauaacaggaauuuucaaugggaauuggauugucauaguugugcuuguuuucuucuucauauuguccuuaaucuuacuuagucuucuaugucccauucguaagcauaaacgcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16696 - RNA, 1672 nt, Artificial Sequence
  mRNA product Design2 comprising derived and/or modified sequence from DOBV(DOBV/Ano-Poroia/Afl9/1999)__NC_005233.1__N (opt4)
ggggcgcugccuacggagguggcagccaucuccuucucggcaucaagcuuaccauggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16697 - RNA, 3790 nt, Artificial Sequence
  mRNA product Design2 comprising derived and/or modified sequence from DOBV(DOBV/Ano-Poroia/Afl9/1999)__NC_005234.1__GP (opt4)
ggggcgcugccuacggagguggcagccaucuccuucucggcaucaagcuuaccaugaucauguggggccugcugcugaccaugauccugaucgacuucggcgccagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16698 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (opt4)
ggggcgcugccuacggagguggcagccaucuccuucucggcaucaagcuuaccauggacuggaccuggauccuguuccugguggccgccgccaccagagugcacagccugagaaacguguacgacaugaagaucgagugcccccacagcaucaacuucggcgagagcagcgugaccggcaagguggagcugcccccccugcugcugaccgacgccgaggcccuggugcccgagagcagcugcaacauggacaaccaccagagcaugagcaucauccagaaggugaccaaggugagcuggagaaagaaggccgacaaggcccaggccgccaaggacagcuucgagaccaccagcagcgaggugaaccugaagggcaccugcgcccugagccacagaaugguggaggagagcuacagaaacagaagaagcgugaucugcuacgaccugagcugcaacagcacccacugcaagcccaccaugcacaugaucgugcccgugcacagcugcaacaugaugaagagcugccuggugggccugggccccuacagaauccagaucguguacgagagaaccuacugcaccaccggcauccugaccgagggcaagugcuucgugcccgaccagagcaucgugaacgugaucaagaacggcguguucgacaucgccagcgugagcaucgugugcuucuucaucagagugaagggcaccaacuacaagaucauggccagcaucaagaccgccaccgccaacaacugcaacgacaccgacaacaaggugcagggcuacuaccugugcaucgugggcggcaacagcagccccguguacgcccccagcaccaccgacuucagaagcauggaggcccuggccagccugcugagagccccccacggcgaggaccacgaccugagcggcgaggagguggccaccuacagcaucgccggccagaucgagggcaagaucccccacaccgccaacgccgccaacaugcuguucaccgccuucagcggcauccccagcuacagcagccugagcguguucaucggcagccaggacggccccgugaucuacagccccggccuguuccccagacugaaccagagcagcugcgacaagaucgcccugccccugaucugggagggcuacaucgaccugcccggcuacuacgagaccgugcaccccugcaacguguucugcgugcugagcggccccggcgccagcugcgaggccuucagcgagggcggcaucuucaacaucaccagccccaccugccuggugagcaagcagaacagauucagagccgccgagcagcaggugaacuucgugugccagagaguggaccaggacaucgugaucuacugcaacggccagaagaagaccauccugaccaagacccuggugaucggccagugcaucuacagcgugaccagccuguucagcaucaugcccggcguggcccacagcaucgccaucgagcugugcgugcccggcuuccacggcugggccaccgccgcccugcugaccaccuucugcuucggcuggauccugauccugagcaucacccuggccgugcugguggugcugaaguucuucgccgccauccugcacaacagcagccaggagaacagauucaagaucauccugagaaagaucaaggaggaguucgagaagaccaagggcagcauggugugcgaggugugcaaguacgagugcgagaccggcaaggagcugaaggcccacaaccugagcugcccccagagccagugccccuacugcuucacccacugcgagcccaccgagagcgccuuccaggcccacuacaaggugugccaggccacccacagauucagagacgaccugaagaagaccaucaccccccagagcaccagccccggcugcuacagaacccugaaccuguucagauacaagagcagaugcuacaucuucaccgugugggugacccugcugaucaucgagagcaucaugugggccgccagcgccagcgagaccgugcuggagcccagcuggaacgacaacgcccacggcgugggcguggugcccaugcacaccgaccuggagcuggacuucagccugcccagcagcagcaaguacaccuacaagagaaagcugaccagcccccugaaccaggagcagagcguggaccugcacaucgagaucgagagccagggcaucagcaccagcgugcacgcccugggccacugguucgacggcagacugaaccugaagaccagcuuccacugcuacggcgccugcaccaaguacgaguaccccuggcacaccgccaagugccacuucgagagagacuucgaguacgagaacaacuggggcugcaaccccgccgacugccccggcaucggcaccggcugcaccgccugcggccuguacaucgaccagcugaagcccgugggcagcgccuacaagcugaucaccgugagauacagcagaaaggugugcgugcaguucggcgaggagaaccugugcaagaccaucgacaugaacgacugcuucgugaccagacacgugaaggugugcaucaucggcaccgugagcaaguucagccagggcgacacccugguguuccugggccccauggagggcggcggccugaucuucaaggacuggugcaccagcaccugccaguucggcgaccccggcgacaucaugagccccaaggacaagggcuucagcugccccgacuucaccggccacuucagaaagaagugcaacuucgccaccacccccgugugcgaguacgacggcaacauggugagcggcuacaagaaggugauggccaccaucgacagcuuccagagcuucaacaccagcagcauccacuacaccgacgagagaaucgaguggaaggaccccgacggcaugcugaaggaccaccugaacauccuggugaccaaggacaucgacuucgagaaccugggcgagaaccccugcaaggugggccugcagaccagcagcaucgagggcgccuggggcagcggcgugggcuucacccugaccugccagaucagccugaccgagugcagcagauuccugaccagcaucaaggccugcgacauggccaucugcuacggcgcccagagcgugacccugaucagaggccagaacaccgugaaggugagcggcaagggcggccacagcggcagcagcuucaagugcugccacggcaccgacugcagccagcagggccugcaggccagcgccccccaccuggacaaggugaacggcaucguggagcaggagagcgagaagguguacgacgacggcgccccccagugcggcaucagcugcugguucgugaagagcggcgaguggaucaccggcaucuucaacggcaacuggaucgugaucguggugcugguguucuucuucauccugagccugauccugcugagccugcugugccccaucagaaagcacaagagaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16699 - RNA, 1672 nt, Artificial Sequence
  mRNA product Design2 comprising derived and/or modified sequence from DOBV(DOBV/Ano-Poroia/Afl9/1999)__NC_005233.1__N (opt3)
ggggcgcugccuacggagguggcagccaucuccuucucggcaucaagcuuaccauggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcaguaugaaagccgaugagauuacccccggccgguuccgcacugcuaucugcggcuuguacccugcccaggugaaggcgcgaaaucugauauccccagucaugucugugauuggguuucuagcacucgccaaaaacuggacagaaagaguagaggaauggcuggaccuucccuguaagcuguugagcgagccuuccccaaccucacucacgaaaggaccgaguacuaauagggauuaucugaaccagcggcagggugcuuuagccaagauggaaaccaaggaggcacaagcuguucguaaacacgccaucgacgcgggcugcaaucugauugaucauaucgacagccccucuuccaucuggguguucgccggggcaccugaucgcuguccacccacaugccucuuuauugcuggaauggccgagcuuggcgcuuucuuugccguccugcaggacaugagaaacacuauaauggcaucaaagaccaucgguacaagcgaagagaaauugaagaaaaagaguucuuucuaccaguccuaucuaaggcggacccaaagcauggggauucagcuggaucagcgaaucauagugcucuuuaugguggacuggggaaaggaagccgucgacucguuccaccugggcgaugacauggauccugagcuucgcggccuggcucaggcguugauugaccaaaaaguuaaggaaaucucuaaucaggagccacucaaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16700 - RNA, 3790 nt, Artificial Sequence
  mRNA product Design2 comprising derived and/or modified sequence from DOBV(DOBV/Ano-Poroia/Afl9/1999)__NC_005234.1__GP (opt3)
ggggcgcugccuacggagguggcagccaucuccuucucggcaucaagcuuaccaugaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16701 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (opt3)
ggggcgcugccuacggagguggcagccaucuccuucucggcaucaagcuuaccauggacuggaccuggauccuguuccucguggccgcugcaacaagaguccacagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16702 - RNA, 1672 nt, Artificial Sequence
  mRNA product Design2 comprising derived and/or modified sequence from DOBV(DOBV/Ano-Poroia/Afl9/1999)__NC_005233.1__N (opt1)
ggggcgcugccuacggagguggcagccaucuccuucucggcaucaagcuuaccauggccacccuggaggagcuccagaaggagaucaacaaccacgagggccagcuggugaucgcccgccagaaggucaaggacgcggagaagcaguacgagaaggaccccgacgaccugaacaagcgggcccucagcgaccgcgaguccaucgcccagagcauccaggggaagaucgacgagcugcggcgccagcuggccgaccggguggccgcgggcaagaacaucgggaaggagcgcgaccccaccggccucgaccccggggaccaccugaaggagaaguccaugcugagcuacggcaacgugaucgaccucaaccaccuggacaucgacgagcccacgggccagaccgccgacuggcuguccaucgucguguaccucaccagcuucgugguccccauccugcugaaggcccucuacaugcugaccacgcgggggcgccagaccaccaaggacaacaagggcaugcggauccgcuucaaggacgacuccagcuucgaggacgugaacgggauccggaagccgaagcaccuguuccucuccaugcccaacgcccagagcuccaugaaggcggacgagaucacccccggccgcuuccggacggccaucugcgggcuguaccccgcccaggugaaggcccgcaaccugaucagcccggucauguccgugaucggcuuccucgcccuggcgaagaacuggaccgagcggguggaggaguggcuggaccuccccugcaagcugcugagcgagcccucccccaccagccucaccaagggcccguccacgaaccgcgacuaccugaaccagcggcagggggcccuggccaagauggagaccaaggaggcccaggccguccgcaagcacgcgaucgacgccggcugcaaccucaucgaccacaucgacagccccuccagcaucuggguguucgccggggcccccgaccggugcccgccgaccugccuguucaucgccggcauggcggagcugggcgccuucuucgccgugcuccaggacaugcgcaacaccaucauggccagcaagacgaucgggaccuccgaggagaagcugaagaagaaguccagcuucuaccagagcuaccugcggcgcacccaguccaugggcauccagcucgaccagcgcaucaucguccuguucaugguggacugggggaaggaggccguggacagcuuccaccugggcgacgacauggaccccgagcuccgggggcuggcgcaggcccugaucgaccagaaggucaaggagaucuccaaccaggagccccucaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16703 - RNA, 3790 nt, Artificial Sequence
  mRNA product Design2 comprising derived and/or modified sequence from DOBV(DOBV/Ano-Poroia/Afl9/1999)__NC_005234.1__GP (opt1)
ggggcgcugccuacggagguggcagccaucuccuucucggcaucaagcuuaccaugaucauguggggccugcuccugaccaugauccugaucgacuucggggccagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16704 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (opt1)
ggggcgcugccuacggagguggcagccaucuccuucucggcaucaagcuuaccauggacuggaccuggauccuguuccucguggccgccgcgacccgcguccacagccuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16705 - RNA, 1672 nt, Artificial Sequence
  mRNA product Design2 comprising derived and/or modified sequence from DOBV(DOBV/Ano-Poroia/Afl9/1999)__NC_005233.1__N (opt5)
ggggcgcugccuacggagguggcagccaucuccuucucggcaucaagcuuaccauggccacccuggaggaacuccagaaggagaucaacaaucacgaaggccaacuggugauugcuagacagaaagucaaggacgccgagaaacaguacgaaaaggaucccgacgaucuuaacaaacgggcgcugagcgaccgcgaguccaucgcucagucuauucaagggaagaucgaugagcucagacggcagcuggccgaccgcguugccgcuggaaagaauauuggcaaagaaagagauccuacagggcuugacccgggagaucaucugaaggagaaaagcaugcucuccuauggcaacgugaucgaccugaaucaccuggauaucgacgaacccacggggcagaccgccgauuggcucucuauuguggucuaccugaccagcuucgugguuccuauccuucugaaggcucucuauaugcugacaacacggggacgccagaccacaaaagacaacaagggcaugcggauuagauuuaaggacgauuccucuuucgaggacgugaauggcauccgcaaacccaagcaucuuuuucugagcaugccuaacgcccaauccagcaugaaagcggaugagauuacccccgggagauuccggacggccaucugcggacucuacccugcucaggucaaggcccgcaaucugauuucuccggugauguccguuaucggcuuucuggcucucgccaaaaacuggaccgaaagaguggaggaauggcuggaccuucccuguaagcugcucagcgagccuucucccacaucccugaccaaagggccuagcacaaaucgggauuaucuuaaccagcgccagggagcgcuggccaagauggaaaccaaggaggcucaagccgucagaaaacacgcuaucgacgccggcugcaaucucauugaucauaucgacucucccuccagcauuuggguguucgccggggcuccggaucgguguccucccacgugccuguuuaucgcgggaauggccgagcugggcgcuuucuuugccgugcuccaggacaugagaaacacaauuauggccuccaagaccaucggcacaucugaagagaaacugaagaaaaagagcuccuucuaccagagcuaucuucgccggacccaaucuauggggauccagcuggaucagagaauuaucguccucuuuaugguugacuggggaaaggaagcuguggacuccuuccaccugggcgaugacauggauccugagcuucgcgggcuggcccaggcgcucauugaccaaaaagugaaggaaaucagcaaucaggagccccugaaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16706 - RNA, 3790 nt, Artificial Sequence
  mRNA product Design2 comprising derived and/or modified sequence from DOBV(DOBV/Ano-Poroia/Afl9/1999)__NC_005234.1__GP (opt5)
ggggcgcugccuacggagguggcagccaucuccuucucggcaucaagcuuaccaugaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16707 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (opt5)
ggggcgcugccuacggagguggcagccaucuccuucucggcaucaagcuuaccauggacuggaccuggauccuguuccucguggccgcugccacaagaguccacagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16708 - RNA, 1672 nt, Artificial Sequence
  mRNA product Design2 comprising derived and/or modified sequence from DOBV(DOBV/Ano-Poroia/Afl9/1999)__NC_005233.1__N (opt11)
ggggcgcugccuacggagguggcagccaucuccuucucggcaucaagcuuaccauggccacccuagaagaacuccaaaaagaaaucaacaaccacgaaggacaacucguaaucgcacgccaaaaagucaaagacgccgaaaaacaauacgaaaaagaccccgacgaucuuaacaaacgagcacucucagaccgcgaaagcaucgcccaaagcauccaaggaaaaauagacgaacuccgccgucaacucgcagaccgagucgcagcaggcaaaaacaucggaaaagaacgcgacccuaccggccuugacccaggcgaccaccugaaagaaaaaucaaugcuaagcuacggcaacgucaucgaccuuaaccaccuagacauugacgagccaacaggccaaaccgccgacuggcuauccaucgucguauaccugaccucauucguaguccccauccuccuaaaagcccucuacaugcucaccacccgcggcagacaaacaaccaaagacaacaaaggcaugagaauacgcuucaaagacgacaguuccuucgaagacguuaacggcaucagaaaacccaaacaccucuuucucuccaugcccaacgcacaauccucaaugaaagccgacgaaaucacaccuggccgcuuccgaaccgccaucugcggacucuaccccgcacaagucaaagccagaaaccucaucucccccgucauguccgucauaggauuccucgcccucgccaaaaacuggacagaacgcgucgaagaauggcuagaccuacccugcaaacucuuauccgagcccagccccaccucccucacaaaaggccccucaacaaaccgcgacuaccucaaccaacgccaaggugcacucgcaaaaauggaaacuaaagaagcccaagccguccgcaaacacgccaucgacgccggcugcaaccucaucgaccacaucgacagcccgagcuccaucugggucuucgccggcgcaccagaccgcugcccaccaaccugccucuucaucgccggcauggcagaacucggcgccuucuucgccguacuccaagacaugcguaacaccaucauggcaagcaagaccaucggaaccuccgaagaaaaacuuaagaaaaagucaucauucuaccaauccuaccuccgccgaacccaaagcaugggcauccaacuagaccagcgcauaaucguccucuucauggucgacuggggaaaagaagcagucgauuccuuccaccucggagacgacauggacccagagcuacgaggccucgcgcaagcccucauagaccaaaaaguaaaagagaucuccaaucaagaaccacucaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16709 - RNA, 3790 nt, Artificial Sequence; identical to SEQ ID NO: 16703
  mRNA product Design2 comprising derived and/or modified sequence from DOBV(DOBV/Ano-Poroia/Afl9/1999)__NC_005234.1__GP (opt11)

SEQ ID NO: 16710 - RNA, 3790 nt, Artificial Sequence
  mRNA product Design2 comprising derived and/or modified sequence from DOBV(DOBV/Ano-Poroia/Afl9/1999)__NC_005234.1__IgE-leader_Gn-Gc (opt11)
ggggcgcugccuacggagguggcagccaucuccuucucggcaucaagcuuaccauggauuggacguggauacucuuucucguggccgcggccacgcgcgugcacucgcuccgcaacguguacgacaugaagaucgagugcccccacuccaucaacuucggcgagagcuccgucaccgggaagguggagcugccgccccugcuccugacggacgccgaggcccuggugcccgagagcuccugcaacauggacaaccaccagagcauguccaucauccagaaggucaccaaggugagcuggcggaagaaggccgacaaggcccaggccgccaaggacuccuucgagaccaccagcuccgaggugaaccucaagggcacgugcgcgcugagccaccgcauggucgaggaguccuaccggaaccgccggagcgugaucugcuacgaccuguccugcaacagcacccacugcaagcccaccaugcacaugaucgugccgguccacuccugcaacaugaugaaguccugccucguggggcugggccccuaccgcauccagaucguguacgagcggaccuacugcacgaccggcauccugaccgaggggaagugcuucguccccgaccaguccaucgugaacgugaucaagaacggcgucuucgacaucgccagcgugagcaucgugugcuucuucauccgcgucaaggggaccaacuacaagaucauggccuccaucaagacggccaccgcgaacaacugcaacgacaccgacaacaaggugcagggcuacuaccucugcaucgucgggggcaacagcucccccguguacgccccgagcaccacggacuuccgguccauggaggcccuggccagccugcuccgcgcgccccacggcgaggaccacgaccuguccggggaggagguggccaccuacagcaucgccggccagaucgaggggaagaucccccacaccgccaacgccgccaacaugcuguucaccgcguucuccggcauccccagcuacuccagccucuccguguucaucggcagccaggacgggccggucaucuacucccccggccuguucccccggcugaaccagagcuccugcgacaagaucgcccucccccugaucugggagggguacaucgaccugccgggcuacuacgagacggugcaccccugcaacgucuucugcgugcucagcgggcccggcgccuccugcgaggccuucagcgagggcgggaucuucaacaucaccagcccgaccugccugguguccaagcagaaccgcuuccgggccgcggagcagcaggucaacuucgugugccagcgcguggaccaggacaucgucaucuacugcaacggccagaagaagaccauccugacgaagacccucgugaucgggcagugcaucuacagcgugaccucccuguucagcaucaugcccggcgucgcccacuccaucgccaucgagcugugcgugcccggguuccacggcugggccaccgccgcgcuccugacgaccuucugcuucggcuggauccugauccucagcaucacccuggccgugcuggucgugcucaaguucuucgccgccauccugcacaacuccagccaggagaaccgguucaagaucauccugcgcaagaucaaggaggaguucgagaagaccaagggguccauggugugcgaggucugcaaguacgagugcgagacgggcaaggagcucaaggcgcacaaccugagcugcccccagucccagugccccuacugcuucacccacugcgagccgaccgagagcgccuuccaggcccacuacaaggugugccaggccacccaccgguuccgcgacgaccugaagaagacgaucacgccccaguccaccagccccgggugcuaccggacccucaaccuguuccgcuacaagucccggugcuacaucuucaccgugugggucacccugcucaucaucgagagcaucaugugggccgcguccgccagcgagaccgugcuggagcccagcuggaacgacaacgcccacggcgugggggucgugccgaugcacaccgaccuggagcuggacuucucccuccccagcuccagcaaguacaccuacaagcgcaagcugacgagcccccugaaccaggagcagagcguggaccuccacaucgagaucgagucccagggcaucagcaccuccguccacgcccugggccacugguucgacgggcgccugaaccucaagaccagcuuccacugcuacggcgccugcaccaaguacgaguacccguggcacacggcgaagugccacuucgagcgggacuucgaguacgagaacaacugggggugcaaccccgccgacugccccggcaucggcaccgggugcaccgccugcggccuguacaucgaccagcugaagcccgugggguccgccuacaagcucaucaccgugcgcuacagccggaaggucugcgugcaguucggcgaggagaaccugugcaagacgaucgacaugaacgacugcuucgugacccgccacgucaaggugugcaucaucgggaccguguccaaguucagccagggcgacacccuggucuuccucggcccgauggagggcggcgggcugaucuucaaggacuggugcacguccacgugccaguucggggaccccggggacaucaugagccccaaggacaagggcuucuccugccccgacuucaccggccacuuccggaagaagugcaacuucgccaccaccccggugugcgaguacgacgggaacauggugagcggcuacaagaaggucauggcgaccaucgacuccuuccagagcuucaacaccagcuccauccacuacaccgacgagcgcaucgaguggaaggaccccgacgggaugcugaaggaccaccucaacauccuggugacgaaggacaucgacuucgagaaccugggcgagaaccccugcaagguggggcuccagaccagcuccaucgagggcgccuggggcagcggggucggcuucacccugaccugccagaucucccugacggagugcagccgguuccucaccuccaucaaggccugcgacauggccaucugcuacggggcgcagagcgugacccugauccgcggccagaacaccgugaaggucuccgggaagggcggccacagcggguccagcuucaagugcugccacggcacggacugcucccagcaggggcugcaggccagcgcgccccaccucgacaaggugaacggcaucguggagcaggaguccgagaaggucuacgacgacggcgccccgcagugcgggaucagcugcugguucgugaaguccggcgaguggaucaccgggaucuucaacggcaacuggaucgugaucgucgugcugguguucuucuucauccugagccucauccugcugucccuccugugccccauccggaagcacaagcgcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16711 - protein, 429 aa, Artificial Sequence; identical to SEQ ID NO: 279
  derived and/or modified protein sequence (wt) from HTNV(76-118/POR)__KT885049.1__N

SEQ ID NO: 16712 - protein, 1135 aa, Artificial Sequence; identical to SEQ ID NO: 949
  derived and/or modified protein sequence (wt) from HTNV(76-118/POR)__KT885048.1__GP

SEQ ID NO: 16713 - protein, 1135 aa, Artificial Sequence
  derived and/or modified protein sequence (wt) from HTNV(76-118/POR)__KT885048.1__IgE-leader_Gn-Gc
MDWTWILFLVAAATRVHSLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSSMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 16714 - RNA, 1290 nt, Artificial Sequence; identical to SEQ ID NO: 2614
  derived and/or modified CDS sequence (wt) from HTNV(76-118/POR)__KT885049.1__N

SEQ ID NO: 16715 - RNA, 1290 nt, Artificial Sequence
  derived and/or modified CDS sequence (wt) from HTNV(76-118/POR)__KT885049.1__N
auggcaacuauggaggaauuacagagggaaaucaaugcccaugagggucaauuagugauagccaggcagaaggugagggaugcagaaaaacaguaugaaaaggauccagaugaguugaacaagagagcauuaacuaaccgagagggcguugcaguaucuauccaggcaaaaauugaugaguuaaaaaugcaacuggcagauaggauugcaacugggaaaaaccuugggaaggaacaagauccaacagggguggagccuggagaccaucugaaagagaggucaaugcucaguuaugguaaugugcuggauuuaaaccauuuggauauugaugaaccuacaggacagacagcagacuggcugagcaucaucgucuaucuuacauccuuugucgucccgauacuucugaaagcucuguauauguugacaacaagggggaggcaaacuaccaaggauaauaaagggacccggauucgauuuaaggaugauagcucguucgaggauguuaacgguauccggaaaccaaaacaucuuuacguguccuugccaaaugcacagucaagcaugaaggcagaagagauuacaccugguagauauagaacagcagucugugggcucuacccugcacagauuaaggcacggcagaugaucaguccaguuaugaguguaauugguuuucuagcauuagcaaaggacuggagugaucguaucgaacaaugguuaauugaaccuugcaagcugcuuccagauacagcagcaguuagccuccuuggugguccugcaacaaacagggacuacuuacggcagcggcaaguggcauuaggcaauauggagacaaaggagucaaaggcuauacgccagcaugcagaagcagcuggcuguagcaugauugaagauauugagucaccaucaucaauauggguuuuugcuggagcaccagaccguuguccaccaacauguuuguuuauagcagguauugcugagcuuggggcauuuuuuuccauccugcaggacaugcgaaauacaaucauggcaucuaagacaguuggaacaucugaggagaagcuacggaagaaaucaucauuuuaucaguccuaccucagaaggacacaaucaauggggauacaacuagaccagagaauuauugugcuguucaugguugccuggggaaaggaggcuguggacaacuuccacuuaggggaugauauggauccugagcuaaggacacuggcacagagcuugauugaugucaaagugaaggaaaucuccaaccaagagccuuugaaacucuaa

SEQ ID NO: 16716 - RNA, 3408 nt, Artificial Sequence; identical to SEQ ID NO: 3284
  derived and/or modified CDS sequence (wt) from HTNV(76-118/POR)__KT885048.1__GP

SEQ ID NO: 16717 - RNA, 3408 nt, Artificial Sequence
  derived and/or modified CDS sequence (wt) from HTNV(76-118/POR)__KT885048.1__GP
auggggauauggaaguggcuagugauggccaguuuaguauggccuguuuugacacugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauag

SEQ ID NO: 16718 - RNA, 3408 nt, Artificial Sequence
  derived and/or modified CDS sequence (wt) from HTNV(76-118/POR)__KT885048.1__IgE-leader_Gn-Gc
auggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaacaagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauag

SEQ ID NO: 16719 - RNA, 3408 nt, Artificial Sequence
  derived and/or modified CDS sequence (wt) from HTNV(76-118/POR)__KT885048.1__IgE-leader_Gn-Gc
auggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauag

SEQ ID NO: 16720 - RNA, 1290 nt, Artificial Sequence; identical to SEQ ID NO: 4949
  derived and/or modified CDS sequence (opt4) from HTNV(76-118/POR)__KT885049.1__N

SEQ ID NO: 16721 - RNA, 3408 nt, Artificial Sequence; identical to SEQ ID NO: 8387
  derived and/or modified CDS sequence (opt4) from HTNV(76-118/POR)__KT885048.1__GP

SEQ ID NO: 16722 - RNA, 3408 nt, Artificial Sequence
  derived and/or modified CDS sequence (opt4) from HTNV(76-118/POR)__KT885048.1__IgE-leader_Gn-Gc
auggacuggaccuggauccuguuccugguggccgccgccaccagagugcacagccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcuga

SEQ ID NO: 16723 - RNA, 1290 nt, Artificial Sequence; identical to SEQ ID NO: 5641
  derived and/or modified CDS sequence (opt3) from HTNV(76-118/POR)__KT885049.1__N

SEQ ID NO: 16724 - RNA, 3408 nt, Artificial Sequence; identical to SEQ ID NO: 10030
  derived and/or modified CDS sequence (opt3) from HTNV(76-118/POR)__KT885048.1__GP

SEQ ID NO: 16725 - RNA, 3408 nt, Artificial Sequence
  derived and/or modified CDS sequence (opt3) from HTNV(76-118/POR)__KT885048.1__IgE-leader_Gn-Gc
auggacuggaccuggauccuguuccucguggccgcugcaacaagaguccacagccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcuga

SEQ ID NO: 16726 - RNA, 1290 nt, Artificial Sequence; identical to SEQ ID NO: 6333
  derived and/or modified CDS sequence (opt1) from HTNV(76-118/POR)__KT885049.1__N

SEQ ID NO: 16727 - RNA, 3408 nt, Artificial Sequence; identical to SEQ ID NO: 11673
  derived and/or modified CDS sequence (opt1) from HTNV(76-118/POR)__KT885048.1__GP

SEQ ID NO: 16728 - RNA, 3408 nt, Artificial Sequence
  derived and/or modified CDS sequence (opt1) from HTNV(76-118/POR)__KT885048.1__IgE-leader_Gn-Gc
auggacuggaccuggauccuguuccucguggccgccgcgacccgcguccacagccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccuga

SEQ ID NO: 16729 - RNA, 1290 nt, Artificial Sequence; identical to SEQ ID NO: 7025
  derived and/or modified CDS sequence (opt5) from HTNV(76-118/POR)__KT885049.1__N

SEQ ID NO: 16730 - RNA, 3408 nt, Artificial Sequence; identical to SEQ ID NO: 13316
  derived and/or modified CDS sequence (opt5) from HTNV(76-118/POR)__KT885048.1__GP

SEQ ID NO: 16731 - RNA, 3408 nt, Artificial Sequence
  derived and/or modified CDS sequence (opt5) from HTNV(76-118/POR)__KT885048.1__IgE-leader_Gn-Gc
auggacuggaccuggauccuguuccucguggccgcugccacaagaguccacagccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcuga

SEQ ID NO: 16732 - RNA, 1290 nt, Artificial Sequence; identical to SEQ ID NO: 7717
  derived and/or modified CDS sequence (opt11) from HTNV(76-118/POR)__KT885049.1__N

SEQ ID NO: 16733 - RNA, 3408 nt, Artificial Sequence; identical to SEQ ID NO: 14959
  derived and/or modified CDS sequence (opt11) from HTNV(76-118/POR)__KT885048.1__GP

SEQ ID NO: 16734 - RNA, 3408 nt, Artificial Sequence
  derived and/or modified CDS sequence (opt11) from HTNV(76-118/POR)__KT885048.1__IgE-leader_Gn-Gc
auggauuggacguggauacucuuucucguggccgcggccacgcgcgugcacucgcugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccuga

SEQ ID NO: 16735 - RNA, 1507 nt, Artificial Sequence
  mRNA product Design1 comprising derived and/or modified sequence from HTNV(76-118/POR)__KT885049.1__N (wt)
gggagaaagcuuaccauggcaacuauggaggaauuacagagggaaaucaaugcccaugagggucaauuagugauagccaggcagaaggugagggaugcagaaaaacaguaugaaaaggauccagaugaguugaacaagagagcauuaacuaaccgagagggcguugcaguaucuauccaggcaaaaauugaugaguuaaaaaugcaacuggcagauaggauugcaacugggaaaaaccuugggaaggaacaagauccaacagggguggagccuggagaccaucugaaagagaggucaaugcucaguuaugguaaugugcuggauuuaaaccauuuggauauugaugaaccuacaggacagacagcagacuggcugagcaucaucgucuaucuuacauccuuugucgucccgauacuucugaaagcucuguauauguugacaacaagggggaggcaaacuaccaaggauaauaaagggacccggauucgauuuaaggaugauagcucguucgaggauguuaacgguauccggaaaccaaaacaucuuuacguguccuugccaaaugcacagucaagcaugaaggcagaagagauuacaccugguagauauagaacagcagucugugggcucuacccugcacagauuaaggcacggcagaugaucaguccaguuaugaguguaauugguuuucuagcauuagcaaaggacuggagugaucguaucgaacaaugguuaauugaaccuugcaagcuucuuccagauacagcagcaguuagccuccuuggugguccugcaacaaacagggacuacuuacggcagcggcaaguggcauuaggcaauauggagacaaaggagucaaaggcuauacgccagcaugcagaagcagcuggcuguagcaugauugaagauauugagucaccaucaucaauauggguuuuugcuggagcaccagaccguuguccaccaacauguuuguuuauagcagguauugcugagcuuggggcauuuuuuuccauccugcaggacaugcgaaauacaaucauggcaucuaagacaguuggaacaucugaggagaagcuacggaagaaaucaucauuuuaucaguccuaccucagaaggacacaaucaauggggauacaacuagaccagagaauuauugugcucuucaugguugccuggggaaaggaggcuguggacaacuuccacuuaggggaugauauggauccugagcuaaggacacuggcacagagcuugauugaugucaaagugaaggaaaucuccaaccaagagccuuugaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16736 - RNA, 1507 nt, Artificial Sequence
  mRNA product Design1 comprising derived and/or modified sequence from HTNV(76-118/POR)__KT885049.1__N (wt)
gggagaaagcuuaccauggcaacuauggaggaauuacagagggaaaucaaugcccaugagggucaauuagugauagccaggcagaaggugagggaugcagaaaaacaguaugaaaaggauccagaugaguugaacaagagagcauuaacuaaccgagagggcguugcaguaucuauccaggcaaaaauugaugaguuaaaaaugcaacuggcagauaggauugcaacugggaaaaaccuugggaaggaacaagauccaacagggguggagccuggagaccaucugaaagagaggucaaugcucaguuaugguaaugugcuggauuuaaaccauuuggauauugaugaaccuacaggacagacagcagacuggcugagcaucaucgucuaucuuacauccuuugucgucccgauacuucugaaagcucuguauauguugacaacaagggggaggcaaacuaccaaggauaauaaagggacccggauucgauuuaaggaugauagcucguucgaggauguuaacgguauccggaaaccaaaacaucuuuacguguccuugccaaaugcacagucaagcaugaaggcagaagagauuacaccugguagauauagaacagcagucugugggcucuacccugcacagauuaaggcacggcagaugaucaguccaguuaugaguguaauugguuuucuagcauuagcaaaggacuggagugaucguaucgaacaaugguuaauugaaccuugcaagcugcuuccagauacagcagcaguuagccuccuuggugguccugcaacaaacagggacuacuuacggcagcggcaaguggcauuaggcaauauggagacaaaggagucaaaggcuauacgccagcaugcagaagcagcuggcuguagcaugauugaagauauugagucaccaucaucaauauggguuuuugcuggagcaccagaccguuguccaccaacauguuuguuuauagcagguauugcugagcuuggggcauuuuuuuccauccugcaggacaugcgaaauacaaucauggcaucuaagacaguuggaacaucugaggagaagcuacggaagaaaucaucauuuuaucaguccuaccucagaaggacacaaucaauggggauacaacuagaccagagaauuauugugcuguucaugguugccuggggaaaggaggcuguggacaacuuccacuuaggggaugauauggauccugagcuaaggacacuggcacagagcuugauugaugucaaagugaaggaaaucuccaaccaagagccuuugaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16737 - RNA, 3625 nt, Artificial Sequence
  mRNA product Design1 comprising derived and/or modified sequence from HTNV(76-118/POR)__KT885048.1__GP (wt)
gggagaaagcuuaccauggggauauggaaguggcuagugauggccaguuuaguauggccuguuuugacacugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaacaagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16738 - RNA, 3625 nt, Artificial Sequence
  mRNA product Design1 comprising derived and/or modified sequence from HTNV(76-118/POR)__KT885048.1__GP (wt)
gggagaaagcuuaccauggggauauggaaguggcuagugauggccaguuuaguauggccuguuuugacacugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16739 - RNA, 3625 nt, Artificial Sequence
  mRNA product Design1 comprising derived and/or modified sequence from HTNV(76-118/POR)__KT885048.1__IgE-leader_Gn-Gc (wt)
gggagaaagcuuaccauggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaacaagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16740 - RNA, 3625 nt, Artificial Sequence
  mRNA product Design1 comprising derived and/or modified sequence from HTNV(76-118/POR)__KT885048.1__IgE-leader_Gn-Gc (wt)
gggagaaagcuuaccauggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16741 - RNA, 1507 nt, Artificial Sequence
  mRNA product Design1 comprising derived and/or modified sequence from HTNV(76-118/POR)__KT885049.1__N (opt4)
gggagaaagcuuaccauggccaccauggaggagcugcagagagagaucaacgcccacgagggccagcuggugaucgccagacagaaggugagagacgccgagaagcaguacgagaaggaccccgacgagcugaacaagagagcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16742 - RNA, 3625 nt, Artificial Sequence
  mRNA product Design1 comprising derived and/or modified sequence from HTNV(76-118/POR)__KT885048.1__GP (opt4)
gggagaaagcuuaccaugggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16743 - RNA, 3625 nt, Artificial Sequence
  mRNA product Design1 comprising derived and/or modified sequence from HTNV(76-118/POR)__KT885048.1__IgE-leader_Gn-Gc (opt4)
gggagaaagcuuaccauggacuggaccuggauccuguuccugguggccgccgccaccagagugcacagccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16744 - RNA, 1507 nt, Artificial Sequence
  mRNA product Design1 comprising derived and/or modified sequence from HTNV(76-118/POR)__KT885049.1__N (opt3)
gggagaaagcuuaccauggccaccauggaggaacugcagagagagaucaacgcucacgaaggccaacucgugauugcaaggcagaagguccgggacgccgagaaacaguacgaaaaggaucccgacgagcuuaauaaacgcgcgcugacaaaccgagaggggguugcugugagcauacaggccaagaucgaugaauugaaaaugcaauuagcagaccguauugccacuggaaagaaucuggguaaggagcaggauccuacgggcguagaaccaggggaccaucuaaaagagagauccaugcucucuuauggaaacgugcuggaucuuaaucaccuggacaucgaugagccgaccggccagacagcugacugguugucaauuaucgucuaccucaccaguuucgugguucccauacugcugaaggcacucuauauguuaacuacaaggggucggcagaccacuaaagauaacaaggggacacgcaucagauuuaaagacgauagcuccuucgaagacgugaauggaauuaggaagccuaagcaucuguacgucucucuuccaaacgcccaaucgucaaugaaagcugaggaaaucacccccggccgguaucgcacggccgugugcggcuuguacccugcgcagauuaaggcacgacagaugaucagcccaguaaugaguguuauaggguuucuggcccuagcuaaagacugguccgauagaauugagcaguggcucaucgaacccuguaagcugcuuccugacacugccgcagugucucuguugggagguccagcuaccaauagggauuaucuccggcaacgucaggucgcccugggcaacauggagacaaaagagagcaaggcgauucgccagcacgccgaagcagcugggugcuccaugaucgaggacaucgaaucaccgaguagcauuuggguguucgccggagcucccgauagauguccuccaacuugcuuauuuauagccggcaucgcagagcugggugccuucuuuucuauucuccaagacaugaggaauaccaucauggcuuccaaaacaguggggaccucagaagagaagcugcggaagaaaagcaguuucuaccagucuuaccuucgacgcacgcaguccaugggaauacaguuggaucaaagaauuaucguccuauuuaugguugcguggggcaaggaggcaguggacaacuuccaucugggcgaugacauggaucccgaacucaggacucuggcccagagccuuaucgacguaaaagugaaggagauuucgaaucaggaaccucugaaauugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16745 - RNA, 3625 nt, Artificial Sequence
  mRNA product Design1 comprising derived and/or modified sequence from HTNV(76-118/POR)__KT885048.1__GP (opt3)
gggagaaagcuuaccaugggcaucuggaaguggcuggugauggccagccucgucuggcccguucuuacccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16746 - RNA, 3625 nt, Artificial Sequence
  mRNA product Design1 comprising derived and/or modified sequence from HTNV(76-118/POR)__KT885048.1__IgE-leader_Gn-Gc (opt3)
gggagaaagcuuaccauggacuggaccuggauccuguuccucguggccgcugcaacaagaguccacagccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16747 - RNA, 1507 nt, Artificial Sequence
  mRNA product Design1 comprising derived and/or modified sequence from HTNV(76-118/POR)__KT885049.1__N (opt1)
gggagaaagcuuaccauggccaccauggaggagcugcagcgcgagaucaacgcccacgagggccagcucgugaucgcgcggcagaagguccgcgacgccgagaagcaguacgagaaggaccccgacgagcugaacaagcgggcccugaccaaccgcgaggggguggccgugagcauccaggccaagaucgacgagcucaagaugcagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgggggcgccagaccacgaaggacaacaagggcacccggauccgcuucaaggacgacuccagcuucgaggacgugaacgggauccggaagccgaagcaccuguacgucucccuccccaacgcgcagagcuccaugaaggccgaggagaucacccccggccgcuaccggaccgccgugugcgggcuguaccccgcccagaucaaggcccgccagaugaucagcccggugauguccgucaucggcuuccuggcgcucgccaaggacuggagcgaccggaucgagcaguggcugaucgagcccugcaagcugcuccccgacacggccgccgugucccugcugggcgggcccgccaccaaccgcgacuaccuccggcagcgccagguggcgcugggcaacauggagaccaaggagagcaaggccauccggcagcacgccgaggccgccgggugcuccaugaucgaggacaucgagagcccguccagcaucugggucuucgcgggcgcccccgaccgcugcccgccgaccugccuguucaucgccggcaucgccgagcucggggccuucuucuccauccugcaggacaugcggaacacgaucauggcgagcaagaccgugggcaccagcgaggagaagcugcgcaagaaguccagcuucuaccaguccuaccuccgccggacccagagcauggggauccagcuggaccagcgcaucaucgugcuguucauggucgccuggggcaaggaggccguggacaacuuccaccucggggacgacauggaccccgagcugcggacgcuggcccagucccucaucgacgugaaggucaaggagaucagcaaccaggagccccugaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16748 - RNA, 3625 nt, Artificial Sequence
  mRNA product Design1 comprising derived and/or modified sequence from HTNV(76-118/POR)__KT885048.1__GP (opt1)
gggagaaagcuuaccaugggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16749 - RNA, 3625 nt, Artificial Sequence
  mRNA product Design1 comprising derived and/or modified sequence from HTNV(76-118/POR)__KT885048.1__IgE-leader_Gn-Gc (opt1)
gggagaaagcuuaccauggacuggaccuggauccuguuccucguggccgccgcgacccgcguccacagccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16750 - RNA, 1507 nt, Artificial Sequence
  mRNA product Design1 comprising derived and/or modified sequence from HTNV(76-118/POR)__KT885049.1__N (opt5)
gggagaaagcuuaccauggccaccauggaggaacugcagagagagaucaacgcucacgaaggccaacucgugauugcccggcagaagguccgcgacgcggagaaacaguacgaaaaggaucccgacgagcugaauaaaagagcucuuacaaaccgggaggggguugccgugagcauccaggccaagauugaugaacugaaaaugcaacucgcugaccgcaucgccacgggaaagaaucugggcaaggagcaggauccuaccgggguggaaccgggagaccaucuuaaagagagauccaugcugucuuauggcaacguccucgaucugaaucaccuggacauugaugagcccacagggcagaccgcugacuggcucagcaucaucguguaccugacauccuucguugugccuauucuucugaaggcccucuauaugcugaccacacggggacgccagaccacgaaagauaacaagggcaccagaauccgguuuaaagacgauucuagcuucgaagacgucaauggcauucgcaagcccaagcaucuuuacgugucccugccuaacgcgcaaucuagcaugaaagccgaggaaaucacacccgggagauaucggaccgcuguuugcggacucuacccugcccagauuaaggcucgccagaugaucuccccggugaugagcgucauuggcuuucuggcccuggcgaaagacuggucugauagaaucgagcaguggcucaucgaacccuguaagcugcuuccugacacagccgcugugucccugcucgggggacccgccaccaaucgggauuaucugcgccaaagacagguggcucuuggcaacauggagacgaaagagagcaaggccauucggcagcacgccgaagcugcggggugcucuaugaucgaggacauugaauccccuagcucuaucugggucuucgccggagcucccgauagauguccgccuacaugccuguuuauugccggcaucgccgagcucggcgcuuucuuuuccauccugcaagacaugcgcaauaccauuauggccagcaaaacaguugggaccuccgaagagaagcugcggaagaaaucuagcuucuaccaguccuaccucagacgcacccagagcaugggaauccagcuggaucaacggauuaucgugcuuuuuaugguggcguggggcaaggaggcugucgacaacuuccaucugggggaugacauggaucccgaacucagaacacuggcccagucucuuauugacgugaaaguuaaggagaucuccaaucaggaaccucugaaacucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16751 - RNA, 3625 nt, Artificial Sequence
  mRNA product Design1 comprising derived and/or modified sequence from HTNV(76-118/POR)__KT885048.1__GP (opt5)
gggagaaagcuuaccaugggcaucuggaaguggcuggugauggccagccucgucuggcccguucugacccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16752 - RNA, 3625 nt, Artificial Sequence
  mRNA product Design1 comprising derived and/or modified sequence from HTNV(76-118/POR)__KT885048.1__IgE-leader_Gn-Gc (opt5)
gggagaaagcuuaccauggacuggaccuggauccuguuccucguggccgcugccacaagaguccacagccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16753 - RNA, 1507 nt, Artificial Sequence
  mRNA product Design1 comprising derived and/or modified sequence from HTNV(76-118/POR)__KT885049.1__N (opt11)
gggagaaagcuuaccauggccaccauggaggaacuccaacgagagauaaacgcccacgaaggccagcuagucaucgccagacaaaaaguccgagacgccgaaaaacaauacgaaaaagaccccgacgaacucaacaagagagcccuaaccaaccgagaaggcgucgcagucuccauccaagcaaaaaucgacgaacucaaaaugcaacuagcagacagaauagcuaccggcaaaaaccucggaaaagagcaagaccccacaggcguagaacccggcgaccaccucaaagaaagauccaugcucucauacggcaacguacuagaccucaaccaccucgacauagacgaacccaccgggcaaacagccgacuggcucuccauaaucgucuaccucaccuccuucgucgucccaauccuccucaaagcacuauacaugcuaaccacccggggcagacaaacuaccaaagacaacaaaggcacccggaucagauucaaggacgacagcucauucgaagacgugaacggcauccgaaaacccaaacaccuuuacgucucccuccccaacgcacaaucaagcaugaaagccgaagaaaucacgccuggccgcuaccgaaccgcaguaugcggccucuaccccgcacaaaucaaagccagacaaaugaucucccccgucaugucaguaauagguuuccucgcccucgccaaagacuggagcgaccgcaucgaacaauggcugaucgaaccaugcaaacuccuccccgacacagccgcggucagccuccuaggcggaccagccacaaacagagacuaccucagacaacgccaagucgcccucggcaacauggaaaccaaagaaagcaaagcaauacgacagcacgccgaagcggccggaugcuccaugaucgaagacauagaaagcccaagcucaauaugggucuucgccggcgcccccgaccgcugcccaccaaccugccucuucaucgccggaaucgcagaacuuggcgccuucuucucuauccuccaagacaugcgcaacaccaucauggcaagcaaaacagucggcaccagcgaggagaaacuaagaaagaaauccuccuucuaccaaucauaccucagacgcacccaguccaugggcauacaacucgaccaacgaaucauaguccucuucaugguagcauggggcaaagaagcagucgacaacuuccaccuaggcgaugacauggaccccgaacuccgcacccucgcccaaagccucaucgacguaaaagucaaagaaaucuccaaccaagaaccccucaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16754 - RNA, 3625 nt, Artificial Sequence
  mRNA product Design1 comprising derived and/or modified sequence from HTNV(76-118/POR)__KT885048.1__GP (opt11)
gggagaaagcuuaccaugggcaucuggaaguggcuggugauggcaagccucgucuggcccgugcuuacccugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16755 - RNA, 3625 nt, Artificial Sequence
  mRNA product Design1 comprising derived and/or modified sequence from HTNV(76-118/POR)__KT885048.1__IgE-leader_Gn-Gc (opt11)
gggagaaagcuuaccauggauuggacguggauacucuuucucguggccgcggccacgcgcgugcacucgcugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16756 - RNA, 1672 nt, Artificial Sequence
  mRNA product Design2 comprising derived and/or modified sequence from HTNV(76-118/POR)__KT885049.1__N (wt)
ggggcgcugccuacggagguggcagccaucuccuucucggcaucaagcuuaccauggcaacuauggaggaauuacagagggaaaucaaugcccaugagggucaauuagugauagccaggcagaaggugagggaugcagaaaaacaguaugaaaaggauccagaugaguugaacaagagagcauuaacuaaccgagagggcguugcaguaucuauccaggcaaaaauugaugaguuaaaaaugcaacuggcagauaggauugcaacugggaaaaaccuugggaaggaacaagauccaacagggguggagccuggagaccaucugaaagagaggucaaugcucaguuaugguaaugugcuggauuuaaaccauuuggauauugaugaaccuacaggacagacagcagacuggcugagcaucaucgucuaucuuacauccuuugucgucccgauacuucugaaagcucuguauauguugacaacaagggggaggcaaacuaccaaggauaauaaagggacccggauucgauuuaaggaugauagcucguucgaggauguuaacgguauccggaaaccaaaacaucuuuacguguccuugccaaaugcacagucaagcaugaaggcagaagagauuacaccugguagauauagaacagcagucugugggcucuacccugcacagauuaaggcacggcagaugaucaguccaguuaugaguguaauugguuuucuagcauuagcaaaggacuggagugaucguaucgaacaaugguuaauugaaccuugcaagcuucuuccagauacagcagcaguuagccuccuuggugguccugcaacaaacagggacuacuuacggcagcggcaaguggcauuaggcaauauggagacaaaggagucaaaggcuauacgccagcaugcagaagcagcuggcuguagcaugauugaagauauugagucaccaucaucaauauggguuuuugcuggagcaccagaccguuguccaccaacauguuuguuuauagcagguauugcugagcuuggggcauuuuuuuccauccugcaggacaugcgaaauacaaucauggcaucuaagacaguuggaacaucugaggagaagcuacggaagaaaucaucauuuuaucaguccuaccucagaaggacacaaucaauggggauacaacuagaccagagaauuauugugcucuucaugguugccuggggaaaggaggcuguggacaacuuccacuuaggggaugauauggauccugagcuaaggacacuggcacagagcuugauugaugucaaagugaaggaaaucuccaaccaagagccuuugaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16757 - RNA, 1672 nt, Artificial Sequence
  mRNA product Design2 comprising derived and/or modified sequence from HTNV(76-118/POR)__KT885049.1__N (wt)
ggggcgcugccuacggagguggcagccaucuccuucucggcaucaagcuuaccauggcaacuauggaggaauuacagagggaaaucaaugcccaugagggucaauuagugauagccaggcagaaggugagggaugcagaaaaacaguaugaaaaggauccagaugaguugaacaagagagcauuaacuaaccgagagggcguugcaguaucuauccaggcaaaaauugaugaguuaaaaaugcaacuggcagauaggauugcaacugggaaaaaccuugggaaggaacaagauccaacagggguggagccuggagaccaucugaaagagaggucaaugcucaguuaugguaaugugcuggauuuaaaccauuuggauauugaugaaccuacaggacagacagcagacuggcugagcaucaucgucuaucuuacauccuuugucgucccgauacuucugaaagcucuguauauguugacaacaagggggaggcaaacuaccaaggauaauaaagggacccggauucgauuuaaggaugauagcucguucgaggauguuaacgguauccggaaaccaaaacaucuuuacguguccuugccaaaugcacagucaagcaugaaggcagaagagauuacaccugguagauauagaacagcagucugugggcucuacccugcacagauuaaggcacggcagaugaucaguccaguuaugaguguaauugguuuucuagcauuagcaaaggacuggagugaucguaucgaacaaugguuaauugaaccuugcaagcugcuuccagauacagcagcaguuagccuccuuggugguccugcaacaaacagggacuacuuacggcagcggcaaguggcauuaggcaauauggagacaaaggagucaaaggcuauacgccagcaugcagaagcagcuggcuguagcaugauugaagauauugagucaccaucaucaauauggguuuuugcuggagcaccagaccguuguccaccaacauguuuguuuauagcagguauugcugagcuuggggcauuuuuuuccauccugcaggacaugcgaaauacaaucauggcaucuaagacaguuggaacaucugaggagaagcuacggaagaaaucaucauuuuaucaguccuaccucagaaggacacaaucaauggggauacaacuagaccagagaauuauugugcuguucaugguugccuggggaaaggaggcuguggacaacuuccacuuaggggaugauauggauccugagcuaaggacacuggcacagagcuugauugaugucaaagugaaggaaaucuccaaccaagagccuuugaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16758 - RNA, 3790 nt, Artificial Sequence
  mRNA product Design2 comprising derived and/or modified sequence from HTNV(76-118/POR)__KT885048.1__GP (wt)
ggggcgcugccuacggagguggcagccaucuccuucucggcaucaagcuuaccauggggauauggaaguggcuagugauggccaguuuaguauggccuguuuugacacugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaacaagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16759 - RNA, 3790 nt, Artificial Sequence
  mRNA product Design2 comprising derived and/or modified sequence from HTNV(76-118/POR)__KT885048.1__GP (wt)
ggggcgcugccuacggagguggcagccaucuccuucucggcaucaagcuuaccauggggauauggaaguggcuagugauggccaguuuaguauggccuguuuugacacugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16760 - RNA, 3790 nt, Artificial Sequence
  mRNA product Design2 comprising derived and/or modified sequence from HTNV(76-118/POR)__KT885048.1__IgE-leader_Gn-Gc (wt)
ggggcgcugccuacggagguggcagccaucuccuucucggcaucaagcuuaccauggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaacaagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16761 - RNA, 3790 nt, Artificial Sequence
  mRNA product Design2 comprising derived and/or modified sequence from HTNV(76-118/POR)__KT885048.1__IgE-leader_Gn-Gc (wt)
ggggcgcugccuacggagguggcagccaucuccuucucggcaucaagcuuaccauggacuggaccuggauccuguuccucguggccgccgcgacccgcguccacagccugagaaaugucuaugacaugaaaauugagugcccccauacaguaaguuuugggggaaacagugugauagguuauguagaauuaccccccgugccauuggccgacacagcacagauggugccugagaguucuuguagcauggauaaucaccaaucguugaauacaauaacaaaauauacccaaguaaguuggagaggaaaggcugaucagucacagucuagucaaaauucauuugagacaguguccacugaaguugacuugaaaggaacauguguucuaaaacacaaaaugguggaagaaucauaccguaguaggaaaucaguaaccuguuacgaccugucuugcaauagcacuuacugcaagccaacacuauacaugauuguaccaauucaugcaugcaauaugaugaaaagcuguuugauugcauugggaccauacagaguacaggugguuuaugagagaacuuacuguaugacaggaguccugauugaagggaaaugcuuugucccagaucaaaguguggucaguauuaucaagcaugggaucuuugauauugcaaguguucauauuguauguuucuuuguugcaguuaaagggaauacuuauaaaauuuuugaacagguuaagaaauccuuugaaucaacaugcaaugauacagagaauaaagugcaaggauauuauauuuguauuguagggggaaacucugcaccaauauauguuccaacacuugaugauuucagauccauggaagcauuuacaggaaucuucagaucaccacauggggaagaucaugaucuggcuggagaagaaauugcaucuuauucuauagucggaccugccaaugcaaaaguuccucauagugcuagcucagauacauugagauugauugccuauucagguauaccaucuuauucuucccuuagcauccuaacaaguucaacagaagcuaagcauguauucagcccuggguuguucccaaaacuuaaucacacaaauugugauaaaagugccauaccacucauauggacugggaugauugauuuaccuggauacuacgaagcuguccacccuuguacaguuuuuugcguauuaucagguccuggggcaucaugugaagccuuuucugaaggcgggauuuucaacauaaccucuuccaugugcuuagugucaaaacaaaaucgauuccgguuaacagaacagcaagugaauuuugugugucagcgaguggacauggacauuguuguguacugcaacgggcagaggaaaguaauauuaacaaaaacucuaguuauuggacaauguauauauacuauaaccagcuuauucucauuacuaccuggaguagcacauucuauugcuguugaauuguguguaccuggguuccaugguugggccacagcugcucugcuuguuacauucuguuucggauggguucuuauaccagcaauuacauuuaucauacuaacaguccuaaaguucauugcuaauauuuuucacacaaguaaccaagagaauaggcuaaaaucaguacuuagaaagauaaaggaagaguuugaaaaaacaaaaggcucaaugguaugugaugucugcaaguaugagugugaaaccuauaaagaauuaaaggcacacgggguaucaugcccccaaucucaauguccuuacuguuuuacucauugugaacccacagaagcagcauuccaagcucauuacaagguaugccaaguuacucacagauucagggaugaucuaaagaaaacuguuacuccucaaaauuuuacaccaggauguuaccggacacuaaauuuauuuagauacaaaagcaggugcuacaucuuuacaauguggauauuucuucuugucuuagaauccauacugugggcugcaagugcaucagagacaccauuaacuccugucuggaaugacaaugcccaugggguagguucuguuccuaugcauacagauuuagagcuugauuucucuuuaacauccaguuccaaguauacauaccguaggaaguuaacaaacccacuugaggaagcacaauccauugaccuacauauugaaauagaagaacagacaauugguguugaugugcaugcucuaggacacugguuugauggucgucuuaaccuuaaaacauccuuucacuguuauggugcuuguacaaaguaugaauacccuuggcauacugcaaagugccacuaugaaagagauuaccaauaugagacgagcugggguuguaauccaucagauuguccuggggugggcacaggcuguacagcaugugguuuauaccuagaucaacugaaaccaguugguagugcuuauaaaauuaucacaauaagguacagcaggagagucuguguucaguuuggggaggaaaaccuuuguaagauaauagacaugaaugauuguuuuguaucuaggcauguuaaggucugcauaauugguacaguaucuaaauucucucagggugauaccuuauuguuuuuuggaccgcuugaaggugguggucuaauauuuaaacacugguguacauccacaugucaauuuggugacccaggagauaucaugaguccaagagacaaagguuuuuuaugcccugaguuuccagguaguuucaggaagaaaugcaacuuugcuacuaccccuauuugugaguaugauggaaauauggucucagguuacaagaaagugauggcgacaauugauuccuuccaaucuuuuaauacaagcacuaugcacuucacugaugaaaggauagaguggaaagacccugauggaaugcuaagggaccauauaaacauuuuaguaacgaaggacauugacuuugauaaccuuggugaaaauccuugcaaaauuggccuacaaacaucuucuauugagggggccugggguucuggugugggguucacauuaacaugucugguaucacuaacagaauguccuaccuuuuugaccucaauaaaggcuugugauaaggcuaucuguuauggugcagagaguguaacauugacaagaggacaaaauacagucaagguaucagggaaagguggccauagugguucaacauuuaaguguugccauggggaggacuguucacaaauuggacuccaugcugcugcaccucaccuugacaagguaaaugggauuucugagauagaaaauaguaaaguauaugaugauggggcaccgcaaugugggauaaaauguugguuuguuaaaucaggggaauggauuucagggauauucagugguaauuggauuguacucauuguccucuguguauuucuauuguucuccuugguuuuacuaagcauucucugucccguaaggaagcauaaaaaaucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16762 - RNA, 1672 nt, Artificial Sequence
  mRNA product Design2 comprising derived and/or modified sequence from HTNV(76-118/POR)__KT885049.1__N (opt4)
ggggcgcugccuacggagguggcagccaucuccuucucggcaucaagcuuaccauggccaccauggaggagcugcagagagagaucaacgcccacgagggccagcuggugaucgccagacagaaggugagagacgccgagaagcaguacgagaaggaccccgacgagcugaacaagagagcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16763 - RNA, 3790 nt, Artificial Sequence
  mRNA product Design2 comprising derived and/or modified sequence from HTNV(76-118/POR)__KT885048.1__GP (opt4)
ggggcgcugccuacggagguggcagccaucuccuucucggcaucaagcuuaccaugggcaucuggaaguggcuggugauggccagccugguguggcccgugcugacccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16764 - RNA, 3790 nt, Artificial Sequence
  mRNA product Design2 comprising derived and/or modified sequence from HTNV(76-118/POR)__KT885048.1__IgE-leader_Gn-Gc (opt4)
ggggcgcugccuacggagguggcagccaucuccuucucggcaucaagcuuaccauggacuggaccuggauccuguuccugguggccgccgccaccagagugcacagccugagaaacguguacgacaugaagaucgagugcccccacaccgugagcuucggcggcaacagcgugaucggcuacguggagcugccccccgugccccuggccgacaccgcccagauggugcccgagagcagcugcagcauggacaaccaccagagccugaacaccaucaccaaguacacccaggugagcuggagaggcaaggccgaccagagccagagcagccagaacagcuucgagaccgugagcaccgagguggaccugaagggcaccugcgugcugaagcacaagaugguggaggagagcuacagaagcagaaagagcgugaccugcuacgaccugagcugcaacagcaccuacugcaagcccacccuguacaugaucgugcccauccacgccugcaacaugaugaagagcugccugaucgcccugggccccuacagagugcaggugguguacgagagaaccuacugcaugaccggcgugcugaucgagggcaagugcuucgugcccgaccagagcguggugagcaucaucaagcacggcaucuucgacaucgccagcgugcacaucgugugcuucuucguggccgugaagggcaacaccuacaagaucuucgagcaggugaagaagagcuucgagagcaccugcaacgacaccgagaacaaggugcagggcuacuacaucugcaucgugggcggcaacagcgcccccaucuacgugcccacccuggacgacuucagaagcauggaggccuucaccggcaucuucagaagcccccacggcgaggaccacgaccuggccggcgaggagaucgccagcuacagcaucgugggccccgccaacgccaaggugccccacagcgccagcagcgacacccugagacugaucgccuacagcggcauccccagcuacagcagccugagcauccugaccagcagcaccgaggccaagcacguguucagccccggccuguuccccaagcugaaccacaccaacugcgacaagagcgccaucccccugaucuggaccggcaugaucgaccugcccggcuacuacgaggccgugcaccccugcaccguguucugcgugcugagcggccccggcgccagcugcgaggccuucagcgagggcggcaucuucaacaucaccagcagcaugugccuggugagcaagcagaacagauucagacugaccgagcagcaggugaacuucgugugccagagaguggacauggacaucgugguguacugcaacggccagagaaaggugauccugaccaagacccuggugaucggccagugcaucuacaccaucaccagccuguucagccugcugcccggcguggcccacagcaucgccguggagcugugcgugcccggcuuccacggcugggccaccgccgcccugcuggugaccuucugcuucggcugggugcugauccccgccaucaccuucaucauccugaccgugcugaaguucaucgccaacaucuuccacaccagcaaccaggagaacagacugaagagcgugcugagaaagaucaaggaggaguucgagaagaccaagggcagcauggugugcgacgugugcaaguacgagugcgagaccuacaaggagcugaaggcccacggcgugagcugcccccagagccagugccccuacugcuucacccacugcgagcccaccgaggccgccuuccaggcccacuacaaggugugccaggugacccacagauucagagacgaccugaagaagaccgugaccccccagaacuucacccccggcugcuacagaacccugaaccuguucagauacaagagcagaugcuacaucuucaccauguggaucuuccugcuggugcuggagagcauccugugggccgccagcgccagcgagaccccccugacccccguguggaacgacaacgcccacggcgugggcagcgugcccaugcacaccgaccuggagcuggacuucagccugaccagcagcagcaaguacaccuacagaagaaagcugaccaacccccuggaggaggcccagagcaucgaccugcacaucgagaucgaggagcagaccaucggcguggacgugcacgcccugggccacugguucgacggcagacugaaccugaagaccagcuuccacugcuacggcgccugcaccaaguacgaguaccccuggcacaccgccaagugccacuacgagagagacuaccaguacgagaccagcuggggcugcaaccccagcgacugccccggcgugggcaccggcugcaccgccugcggccuguaccuggaccagcugaagcccgugggcagcgccuacaagaucaucaccaucagauacagcagaagagugugcgugcaguucggcgaggagaaccugugcaagaucaucgacaugaacgacugcuucgugagcagacacgugaaggugugcaucaucggcaccgugagcaaguucagccagggcgacacccugcuguucuucggcccccuggagggcggcggccugaucuucaagcacuggugcaccagcaccugccaguucggcgaccccggcgacaucaugagccccagagacaagggcuuccugugccccgaguuccccggcagcuucagaaagaagugcaacuucgccaccacccccaucugcgaguacgacggcaacauggugagcggcuacaagaaggugauggccaccaucgacagcuuccagagcuucaacaccagcaccaugcacuucaccgacgagagaaucgaguggaaggaccccgacggcaugcugagagaccacaucaacauccuggugaccaaggacaucgacuucgacaaccugggcgagaaccccugcaagaucggccugcagaccagcagcaucgagggcgccuggggcagcggcgugggcuucacccugaccugccuggugagccugaccgagugccccaccuuccugaccagcaucaaggccugcgacaaggccaucugcuacggcgccgagagcgugacccugaccagaggccagaacaccgugaaggugagcggcaagggcggccacagcggcagcaccuucaagugcugccacggcgaggacugcagccagaucggccugcacgccgccgccccccaccuggacaaggugaacggcaucagcgagaucgagaacagcaagguguacgacgacggcgccccccagugcggcaucaagugcugguucgugaagagcggcgaguggaucagcggcaucuucagcggcaacuggaucgugcugaucgugcugugcguguuccugcuguucagccuggugcugcugagcauccugugccccgugagaaagcacaagaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16765 - RNA, 1672 nt, Artificial Sequence
  mRNA product Design2 comprising derived and/or modified sequence from HTNV(76-118/POR)__KT885049.1__N (opt3)
ggggcgcugccuacggagguggcagccaucuccuucucggcaucaagcuuaccauggccaccauggaggaacugcagagagagaucaacgcucacgaaggccaacucgugauugcaaggcagaagguccgggacgccgagaaacaguacgaaaaggaucccgacgagcuuaauaaacgcgcgcugacaaaccgagaggggguugcugugagcauacaggccaagaucgaugaauugaaaaugcaauuagcagaccguauugccacuggaaagaaucuggguaaggagcaggauccuacgggcguagaaccaggggaccaucuaaaagagagauccaugcucucuuauggaaacgugcuggaucuuaaucaccuggacaucgaugagccgaccggccagacagcugacugguugucaauuaucgucuaccucaccaguuucgugguucccauacugcugaaggcacucuauauguuaacuacaaggggucggcagaccacuaaagauaacaaggggacacgcaucagauuuaaagacgauagcuccuucgaagacgugaauggaauuaggaagccuaagcaucuguacgucucucuuccaaacgcccaaucgucaaugaaagcugaggaaaucacccccggccgguaucgcacggccgugugcggcuuguacccugcgcagauuaaggcacgacagaugaucagcccaguaaugaguguuauaggguuucuggcccuagcuaaagacugguccgauagaauugagcaguggcucaucgaacccuguaagcugcuuccugacacugccgcagugucucuguugggagguccagcuaccaauagggauuaucuccggcaacgucaggucgcccugggcaacauggagacaaaagagagcaaggcgauucgccagcacgccgaagcagcugggugcuccaugaucgaggacaucgaaucaccgaguagcauuuggguguucgccggagcucccgauagauguccuccaacuugcuuauuuauagccggcaucgcagagcugggugccuucuuuucuauucuccaagacaugaggaauaccaucauggcuuccaaaacaguggggaccucagaagagaagcugcggaagaaaagcaguuucuaccagucuuaccuucgacgcacgcaguccaugggaauacaguuggaucaaagaauuaucguccuauuuaugguugcguggggcaaggaggcaguggacaacuuccaucugggcgaugacauggaucccgaacucaggacucuggcccagagccuuaucgacguaaaagugaaggagauuucgaaucaggaaccucugaaauugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16766 - RNA, 3790 nt, Artificial Sequence
  mRNA product Design2 comprising derived and/or modified sequence from HTNV(76-118/POR)__KT885048.1__GP (opt3)
ggggcgcugccuacggagguggcagccaucuccuucucggcaucaagcuuaccaugggcaucuggaaguggcuggugauggccagccucgucuggcccguucuuacccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16767 - RNA, 3790 nt, Artificial Sequence
  mRNA product Design2 comprising derived and/or modified sequence from HTNV(76-118/POR)__KT885048.1__IgE-leader_Gn-Gc (opt3)
ggggcgcugccuacggagguggcagccaucuccuucucggcaucaagcuuaccauggacuggaccuggauccuguuccucguggccgcugcaacaagaguccacagccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16768 - RNA, 1672 nt, Artificial Sequence
  mRNA product Design2 comprising derived and/or modified sequence from HTNV(76-118/POR)__KT885049.1__N (opt1)
ggggcgcugccuacggagguggcagccaucuccuucucggcaucaagcuuaccauggccaccauggaggagcugcagcgcgagaucaacgcccacgagggccagcucgugaucgcgcggcagaagguccgcgacgccgagaagcaguacgagaaggaccccgacgagcugaacaagcgggcccugaccaaccgcgaggggguggccgugagcauccaggccaagaucgacgagcucaagaugcagcuggcggaccggaucgccacgggcaagaaccuggggaaggagcaggaccccaccggcgucgagcccggggaccaccucaaggagcgcuccaugcugagcuacggcaacgugcuggaccucaaccaccuggacaucgacgagcccaccggccagaccgccgacuggcuguccaucaucguguaccucacgagcuucgucgugcccauccugcugaaggcccucuacaugcugaccacccgggggcgccagaccacgaaggacaacaagggcacccggauccgcuucaaggacgacuccagcuucgaggacgugaacgggauccggaagccgaagcaccuguacgucucccuccccaacgcgcagagcuccaugaaggccgaggagaucacccccggccgcuaccggaccgccgugugcgggcuguaccccgcccagaucaaggcccgccagaugaucagcccggugauguccgucaucggcuuccuggcgcucgccaaggacuggagcgaccggaucgagcaguggcugaucgagcccugcaagcugcuccccgacacggccgccgugucccugcugggcgggcccgccaccaaccgcgacuaccuccggcagcgccagguggcgcugggcaacauggagaccaaggagagcaaggccauccggcagcacgccgaggccgccgggugcuccaugaucgaggacaucgagagcccguccagcaucugggucuucgcgggcgcccccgaccgcugcccgccgaccugccuguucaucgccggcaucgccgagcucggggccuucuucuccauccugcaggacaugcggaacacgaucauggcgagcaagaccgugggcaccagcgaggagaagcugcgcaagaaguccagcuucuaccaguccuaccuccgccggacccagagcauggggauccagcuggaccagcgcaucaucgugcuguucauggucgccuggggcaaggaggccguggacaacuuccaccucggggacgacauggaccccgagcugcggacgcuggcccagucccucaucgacgugaaggucaaggagaucagcaaccaggagccccugaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16769 - RNA, 3790 nt, Artificial Sequence
  mRNA product Design2 comprising derived and/or modified sequence from HTNV(76-118/POR)__KT885048.1__GP (opt1)
ggggcgcugccuacggagguggcagccaucuccuucucggcaucaagcuuaccaugggcaucuggaaguggcuggugauggccagccucgucuggcccgugcugacccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16770 - RNA, 3790 nt, Artificial Sequence
  mRNA product Design2 comprising derived and/or modified sequence from HTNV(76-118/POR)__KT885048.1__IgE-leader_Gn-Gc (opt1)
ggggcgcugccuacggagguggcagccaucuccuucucggcaucaagcuuaccauggacuggaccuggauccuguuccucguggccgccgcgacccgcguccacagccugcgcaacguguacgacaugaagaucgagugcccgcacaccgucuccuucgggggcaacagcgugaucggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguggaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuacugcaugaccggcguccucaucgaggggaagugcuucgugccggaccaguccguggucagcaucaucaagcacggcaucuucgacaucgccagcgugcacaucgugugcuucuucgucgcggugaaggggaacacguacaagaucuucgagcaggucaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccacgaccuggccggcgaggagaucgcgagcuacuccaucguggggccggccaacgccaaggugccccacagcgccuccagcgacacccuccgccugaucgccuacuccggcauccccagcuacuccagccuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccgugcaccccugcaccguguucugcguccugagcgggccgggcgccagcugcgaggccuucuccgagggcgggaucuucaacaucaccagcuccaugugccucgugagcaagcagaaccgguuccgccugacggagcagcaggucaacuucgugugccagcggguggacauggacaucguggucuacugcaacggccagcgcaaggugauccugaccaagacccucgugaucgggcagugcaucuacaccaucacgucccuguucagccugcuccccggcgucgcgcacuccaucgccguggagcugugcgugcccggguuccacggcugggccaccgccgcccugcucgucaccuucugcuucgggugggugcugauccccgcgaucaccuucaucauccugacggugcucaaguucaucgccaacaucuuccacaccagcaaccaggagaaccggcugaaguccguccugcgcaagaucaaggaggaguucgagaagaccaagggcagcauggugugcgacgugugcaaguacgagugcgagaccuacaaggagcucaaggcccacggcgucuccugcccgcagagccagugccccuacugcuucacgcacugcgagcccaccgaggccgccuuccaggcgcacuacaaggugugccaggugacccaccgguuccgcgacgaccugaagaagaccgucacgccccagaacuucaccccggggugcuaccggacccugaaccucuuccgcuacaagucccggugcuacaucuucaccauguggaucuuccugcuggugcucgagagcauccugugggccgccuccgccagcgagacgccccugacccccguguggaacgacaacgcgcacggcgucggguccgugccgaugcacaccgaccucgagcuggacuucagccugaccagcuccagcaaguacaccuaccgccggaagcugacgaacccccucgaggaggcccaguccaucgaccugcacaucgagaucgaggagcagaccaucggcguggacguccacgcccuggggcacugguucgacggccgccucaaccugaagaccagcuuccacugcuacggcgccugcaccaaguacgaguaccccuggcacacggccaagugccacuacgagcgcgacuaccaguacgagaccuccugggggugcaaccccagcgacugcccgggcguggggaccggcugcaccgcgugcggccuguaccucgaccagcugaagcccgugggguccgccuacaagaucaucacgauccgguacagccgccgggucugcgugcaguucggcgaggagaaccugugcaagaucaucgacaugaacgacugcuucgugucccgccacgucaaggugugcaucaucgggaccgugagcaaguucucccagggcgacacccuccuguucuucgggccccuggagggcggcgggcucaucuucaagcacuggugcaccagcacgugccaguucggcgaccccggggacaucauguccccgcgggacaagggcuuccugugccccgaguuccccgggagcuuccgcaagaagugcaacuucgccaccacccccaucugcgaguacgacggcaacauggucuccggcuacaagaaggugauggccaccaucgacagcuuccaguccuucaacacgagcaccaugcacuucaccgacgagcggaucgaguggaaggacccggacgggaugcugcgcgaccacaucaacauccucgugaccaaggacaucgacuucgacaaccugggcgagaaccccugcaagaucgggcugcagacguccagcaucgagggcgccugggggagcggcgucggcuucacccugaccugccucgugucccugaccgagugccccacguuccucaccagcaucaaggcgugcgacaaggccaucugcuacggggccgaguccgugacccugacccggggccagaacacggucaaggugagcgggaagggcgggcacuccggcagcaccuucaagugcugccacggcgaggacugcucccagaucgggcugcacgccgccgcgccccaccucgacaaggucaacggcaucagcgagaucgagaacuccaagguguacgacgacggggccccgcagugcggcaucaagugcugguucgucaagagcggcgaguggaucuccgggaucuucagcggcaacuggaucgugcugaucgugcugugcguguuccuccuguucucccugguccuccugagcauccugugccccgugcgcaagcacaagaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16771 - RNA, 1672 nt, Artificial Sequence
  mRNA product Design2 comprising derived and/or modified sequence from HTNV(76-118/POR)__KT885049.1__N (opt5)
ggggcgcugccuacggagguggcagccaucuccuucucggcaucaagcuuaccauggccaccauggaggaacugcagagagagaucaacgcucacgaaggccaacucgugauugcccggcagaagguccgcgacgcggagaaacaguacgaaaaggaucccgacgagcugaauaaaagagcucuuacaaaccgggaggggguugccgugagcauccaggccaagauugaugaacugaaaaugcaacucgcugaccgcaucgccacgggaaagaaucugggcaaggagcaggauccuaccgggguggaaccgggagaccaucuuaaagagagauccaugcugucuuauggcaacguccucgaucugaaucaccuggacauugaugagcccacagggcagaccgcugacuggcucagcaucaucguguaccugacauccuucguugugccuauucuucugaaggcccucuauaugcugaccacacggggacgccagaccacgaaagauaacaagggcaccagaauccgguuuaaagacgauucuagcuucgaagacgucaauggcauucgcaagcccaagcaucuuuacgugucccugccuaacgcgcaaucuagcaugaaagccgaggaaaucacacccgggagauaucggaccgcuguuugcggacucuacccugcccagauuaaggcucgccagaugaucuccccggugaugagcgucauuggcuuucuggcccuggcgaaagacuggucugauagaaucgagcaguggcucaucgaacccuguaagcugcuuccugacacagccgcugugucccugcucgggggacccgccaccaaucgggauuaucugcgccaaagacagguggcucuuggcaacauggagacgaaagagagcaaggccauucggcagcacgccgaagcugcggggugcucuaugaucgaggacauugaauccccuagcucuaucugggucuucgccggagcucccgauagauguccgccuacaugccuguuuauugccggcaucgccgagcucggcgcuuucuuuuccauccugcaagacaugcgcaauaccauuauggccagcaaaacaguugggaccuccgaagagaagcugcggaagaaaucuagcuucuaccaguccuaccucagacgcacccagagcaugggaauccagcuggaucaacggauuaucgugcuuuuuaugguggcguggggcaaggaggcugucgacaacuuccaucugggggaugacauggaucccgaacucagaacacuggcccagucucuuauugacgugaaaguuaaggagaucuccaaucaggaaccucugaaacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16772 - RNA, 3790 nt, Artificial Sequence
  mRNA product Design2 comprising derived and/or modified sequence from HTNV(76-118/POR)__KT885048.1__GP (opt5)
ggggcgcugccuacggagguggcagccaucuccuucucggcaucaagcuuaccaugggcaucuggaaguggcuggugauggccagccucgucuggcccguucugacccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16773 - RNA, 3790 nt, Artificial Sequence
  mRNA product Design2 comprising derived and/or modified sequence from HTNV(76-118/POR)__KT885048.1__IgE-leader_Gn-Gc (opt5)
ggggcgcugccuacggagguggcagccaucuccuucucggcaucaagcuuaccauggacuggaccuggauccuguuccucguggccgcugccacaagaguccacagccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16774 - RNA, 1672 nt, Artificial Sequence
  mRNA product Design2 comprising derived and/or modified sequence from HTNV(76-118/POR)__KT885049.1__N (opt11)
ggggcgcugccuacggagguggcagccaucuccuucucggcaucaagcuuaccauggccaccauggaggaacuccaacgagagauaaacgcccacgaaggccagcuagucaucgccagacaaaaaguccgagacgccgaaaaacaauacgaaaaagaccccgacgaacucaacaagagagcccuaaccaaccgagaaggcgucgcagucuccauccaagcaaaaaucgacgaacucaaaaugcaacuagcagacagaauagcuaccggcaaaaaccucggaaaagagcaagaccccacaggcguagaacccggcgaccaccucaaagaaagauccaugcucucauacggcaacguacuagaccucaaccaccucgacauagacgaacccaccgggcaaacagccgacuggcucuccauaaucgucuaccucaccuccuucgucgucccaauccuccucaaagcacuauacaugcuaaccacccggggcagacaaacuaccaaagacaacaaaggcacccggaucagauucaaggacgacagcucauucgaagacgugaacggcauccgaaaacccaaacaccuuuacgucucccuccccaacgcacaaucaagcaugaaagccgaagaaaucacgccuggccgcuaccgaaccgcaguaugcggccucuaccccgcacaaaucaaagccagacaaaugaucucccccgucaugucaguaauagguuuccucgcccucgccaaagacuggagcgaccgcaucgaacaauggcugaucgaaccaugcaaacuccuccccgacacagccgcggucagccuccuaggcggaccagccacaaacagagacuaccucagacaacgccaagucgcccucggcaacauggaaaccaaagaaagcaaagcaauacgacagcacgccgaagcggccggaugcuccaugaucgaagacauagaaagcccaagcucaauaugggucuucgccggcgcccccgaccgcugcccaccaaccugccucuucaucgccggaaucgcagaacuuggcgccuucuucucuauccuccaagacaugcgcaacaccaucauggcaagcaaaacagucggcaccagcgaggagaaacuaagaaagaaauccuccuucuaccaaucauaccucagacgcacccaguccaugggcauacaacucgaccaacgaaucauaguccucuucaugguagcauggggcaaagaagcagucgacaacuuccaccuaggcgaugacauggaccccgaacuccgcacccucgcccaaagccucaucgacguaaaagucaaagaaaucuccaaccaagaaccccucaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16775 - RNA, 3790 nt, Artificial Sequence
  mRNA product Design2 comprising derived and/or modified sequence from HTNV(76-118/POR)__KT885048.1__GP (opt11)
ggggcgcugccuacggagguggcagccaucuccuucucggcaucaagcuuaccaugggcaucuggaaguggcuggugauggcaagccucgucuggcccgugcuuacccugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16776 - RNA, 3790 nt, Artificial Sequence
  mRNA product Design2 comprising derived and/or modified sequence from HTNV(76-118/POR)__KT885048.1__IgE-leader_Gn-Gc (opt11)
ggggcgcugccuacggagguggcagccaucuccuucucggcaucaagcuuaccauggauuggacguggauacucuuucucguggccgcggccacgcgcgugcacucgcugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16777 - protein, 433 aa, Artificial Sequence; identical to SEQ ID NO: 379
  derived and/or modified protein sequence (wt) from PUUV(K27)__L08804.1__N

SEQ ID NO: 16778 - protein, 1148 aa, Artificial Sequence; identical to SEQ ID NO: 1060
  derived and/or modified protein sequence (wt) from PUUV(K27)__L08754.1__GP

SEQ ID NO: 16779 - protein, 1143 aa, Artificial Sequence
  derived and/or modified protein sequence (wt) from PUUV(K27)__L08754.1__IgE-leader_Gn-Gc
MDWTWILFLVAAATRVHSARNLNELKMECPHTIRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCSINRVQRFRGSEQQIKFVCQRVDMDITVYCNGMKKVILTKTLVIGQCIYTFTSIFSLIPGVAHSLAVELCVPGLHGWATMLLLLTLCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 16780 - RNA, 1302 nt, Artificial Sequence; identical to SEQ ID NO: 2714
  derived and/or modified CDS sequence (wt) from PUUV(K27)__L08804.1__N

SEQ ID NO: 16781 - RNA, 3447 nt, Artificial Sequence; identical to SEQ ID NO: 3395
  derived and/or modified CDS sequence (wt) from PUUV(K27)__L08754.1__GP

SEQ ID NO: 16782 - RNA, 3447 nt, Artificial Sequence
  derived and/or modified CDS sequence (wt) from PUUV(K27)__L08754.1__GP
augggagaacuuaguccaguuugucuguaucugcuucuccagggucuauuacuauguaauacaggggcugccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaa

SEQ ID NO: 16783 - RNA, 3432 nt, Artificial Sequence
  derived and/or modified CDS sequence (wt) from PUUV(K27)__L08754.1__IgE-leader_Gn-Gc
auggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcuuacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacuaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaa

SEQ ID NO: 16784 - RNA, 3432 nt, Artificial Sequence
  derived and/or modified CDS sequence (wt) from PUUV(K27)__L08754.1__IgE-leader_Gn-Gc
auggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaa

SEQ ID NO: 16785 - RNA, 1302 nt, Artificial Sequence; identical to SEQ ID NO: 5049
  derived and/or modified CDS sequence (opt4) from PUUV(K27)__L08804.1__N

SEQ ID NO: 16786 - RNA, 3447 nt, Artificial Sequence; identical to SEQ ID NO: 8498
  derived and/or modified CDS sequence (opt4) from PUUV(K27)__L08754.1__GP

SEQ ID NO: 16787 - RNA, 3432 nt, Artificial Sequence
  derived and/or modified CDS sequence (opt4) from PUUV(K27)__L08754.1__IgE-leader_Gn-Gc
auggacuggaccuggauccuguuccugguggccgccgccaccagagugcacagcgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccuga

SEQ ID NO: 16788 - RNA, 1302 nt, Artificial Sequence; identical to SEQ ID NO: 5741
  derived and/or modified CDS sequence (opt3) from PUUV(K27)__L08804.1__N

SEQ ID NO: 16789 - RNA, 3447 nt, Artificial Sequence; identical to SEQ ID NO: 10141
  derived and/or modified CDS sequence (opt3) from PUUV(K27)__L08754.1__GP

SEQ ID NO: 16790 - RNA, 3432 nt, Artificial Sequence
  derived and/or modified CDS sequence (opt3) from PUUV(K27)__L08754.1__IgE-leader_Gn-Gc
auggacuggaccuggauccuguuccucguggccgcugcaacaagaguccacagcgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccuga

SEQ ID NO: 16791 - RNA, 1302 nt, Artificial Sequence; identical to SEQ ID NO: 6433
  derived and/or modified CDS sequence (opt1) from PUUV(K27)__L08804.1__N

SEQ ID NO: 16792 - RNA, 3447 nt, Artificial Sequence; identical to SEQ ID NO: 11784
  derived and/or modified CDS sequence (opt1) from PUUV(K27)__L08754.1__GP

SEQ ID NO: 16793 - RNA, 3432 nt, Artificial Sequence
  derived and/or modified CDS sequence (opt1) from PUUV(K27)__L08754.1__IgE-leader_Gn-Gc
auggacuggaccuggauccuguuccucguggccgccgcgacccgcguccacagcgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccuga

SEQ ID NO: 16794 - RNA, 1302 nt, Artificial Sequence; identical to SEQ ID NO: 7125
  derived and/or modified CDS sequence (opt5) from PUUV(K27)__L08804.1__N

SEQ ID NO: 16795 - RNA, 3447 nt, Artificial Sequence; identical to SEQ ID NO: 13427
  derived and/or modified CDS sequence (opt5) from PUUV(K27)__L08754.1__GP

SEQ ID NO: 16796 - RNA, 3432 nt, Artificial Sequence
  derived and/or modified CDS sequence (opt5) from PUUV(K27)__L08754.1__IgE-leader_Gn-Gc
auggacuggaccuggauccuguuccucguggccgcugccacaagaguccacagcgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccuga

SEQ ID NO: 16797 - RNA, 1302 nt, Artificial Sequence; identical to SEQ ID NO: 7817
  derived and/or modified CDS sequence (opt11) from PUUV(K27)__L08804.1__N

SEQ ID NO: 16798 - RNA, 3447 nt, Artificial Sequence; identical to SEQ ID NO: 15070
  derived and/or modified CDS sequence (opt11) from PUUV(K27)__L08754.1__GP

SEQ ID NO: 16799 - RNA, 3432 nt, Artificial Sequence
  derived and/or modified CDS sequence (opt11) from PUUV(K27)__L08754.1__IgE-leader_Gn-Gc
auggauuggacguggauacucuuucucguggccgcggccacgcgcgugcacucggcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccuga

SEQ ID NO: 16800 - RNA, 1519 nt, Artificial Sequence
  mRNA product Design1 comprising derived and/or modified sequence from PUUV(K27)__L08804.1__N (wt)
gggagaaagcuuaccaugagugacuugacagacauccaagaggagauaacccgccaugagcaacaacuuguuguugccagacaaaaacucaaggaugcagagagagcaguggaaguguacccggaugacguuaucaagaacacauuacaagcaagacaacaaacagugucagcacuggaggauaaacucgcagacuacaagagaagaauggcagaugcugugucccggaagaaaauggauacuaaaccuacugacccgacugggauugaaccugaugaucaucucaaggagagaucaagccuuagauauggaaauguccuugaugugaaugcuauugacauugaagaaccaaguggccagacagcagauugguauacuaucggagucuauguaauaggguucacaauuccuaucauuuugaaggcucuauauauguugucaacacguggaagacagacuguaaaggaaaacaaaggaacacggaucagguucaaggaugacacaucauuugaggauaucaauggcaucaggagaccaaaacaccuauauguauccaugccuacugcccaguccaccaugaaagcugaagaacuuacaccuggacgguuccguacaauaguauguggcuuauucccuacacagauacaaguucguaacaucaugaguccaguaaugggagugauugguuuuucuuucuucguuaaagacuggccagaaaaaauuagggaguuuauggagaaagaaugcccuuucauaaagccagaaguuaaaccugggacaccagcacaggagguagaauuuuugaaaagaaauagaguuuacuucaugacccgccaggauguucuugacaaaaaucauguggcugacaucgauaaguugauugacuaugcugccucuggugacccuacaucgccugaugacaucaaaucuccuaaugcaccauggguauuugcuugugcaccagaucggucgcccccaacauguauuuauguugcugggauggcugaauuaggugcauucuuuuccaucuuacaggauaugaggaacaccauuauggcaucuaaaacugugggcacagcagaagagaaacugaaaaggaaguccuccuucuaucaaucauauuugcgccgaacacaaucaauggggauucaacuugaucagaggauaauccuacuguacauguuggaauggggaaaagaaaugguggaucauuuccaucuuggugaugacauggauccugagcuaaggggccuugcucagucacucauagaccagaagguaaaagagauaucaaaccaagaacccuuaaagauaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16801 - RNA, 3664 nt, Artificial Sequence
  mRNA product Design1 comprising derived and/or modified sequence from PUUV(K27)__L08754.1__GP (wt)
gggagaaagcuuaccaugggagaacuuaguccaguuugucuguaucugcuucuccagggucuauuacuauguaauacaggggcugccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcuuacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacuaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16802 - RNA, 3664 nt, Artificial Sequence
  mRNA product Design1 comprising derived and/or modified sequence from PUUV(K27)__L08754.1__GP (wt)
gggagaaagcuuaccaugggagaacuuaguccaguuugucuguaucugcuucuccagggucuauuacuauguaauacaggggcugccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16803 - RNA, 3649 nt, Artificial Sequence
  mRNA product Design1 comprising derived and/or modified sequence from PUUV(K27)__L08754.1__IgE-leader_Gn-Gc (wt)
gggagaaagcuuaccauggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcuuacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacuaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16804 - RNA, 3649 nt, Artificial Sequence
  mRNA product Design1 comprising derived and/or modified sequence from PUUV(K27)__L08754.1__IgE-leader_Gn-Gc (wt)
gggagaaagcuuaccauggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16805 - RNA, 1519 nt, Artificial Sequence
  mRNA product Design1 comprising derived and/or modified sequence from PUUV(K27)__L08804.1__N (opt4)
gggagaaagcuuaccaugagcgaccugaccgacauccaggaggagaucaccagacacgagcagcagcuggugguggccagacagaagcugaaggacgccgagagagccguggagguguaccccgacgacgugaucaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucaagagccccaacgcccccuggguguucgccugcgcccccgacagaagcccccccaccugcaucuacguggccggcauggccgagcugggcgccuucuucagcauccugcaggacaugagaaacaccaucauggccagcaagaccgugggcaccgccgaggagaagcugaagagaaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16806 - RNA, 3664 nt, Artificial Sequence
  mRNA product Design1 comprising derived and/or modified sequence from PUUV(K27)__L08754.1__GP (opt4)
gggagaaagcuuaccaugggcgagcugagccccgugugccuguaccugcugcugcagggccugcugcugugcaacaccggcgccgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16807 - RNA, 3649 nt, Artificial Sequence
  mRNA product Design1 comprising derived and/or modified sequence from PUUV(K27)__L08754.1__IgE-leader_Gn-Gc (opt4)
gggagaaagcuuaccauggacuggaccuggauccuguuccugguggccgccgccaccagagugcacagcgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16808 - RNA, 1519 nt, Artificial Sequence
  mRNA product Design1 comprising derived and/or modified sequence from PUUV(K27)__L08804.1__N (opt3)
gggagaaagcuuaccaugagcgaccugaccgauauccaggaggaaauuacaagacacgagcaacagcucguggucgccaggcagaaacuuaaagacgcugaacgggcaguugagguguaccccgaugacguaauaaagaacacucugcaggcccgccaacagacgguguccgcguuggaagauaaauuagcugacuauaagcgacguauggccgaugcagucucuagaaagaagauggacaccaagccuacagauccaacuggcaucgagccggacgaucaucugaaagagaggucaagucuacgguacgggaaugugcucgacguuaacgccauugauaucgaagaacccagcggacagaccgcugacugguauacaauugguguguacgucaucggcuucaccauaccuaucauucugaaggcacuuuauaugcuguccacucgcgggagacagacagugaaagaaaauaagggaaccaggauccgguuuaaagacgauacgucuuucgaggacauuaacggcauccgccgaccaaagcacuuguacguaucgaugcccacugcccaaucaaccaugaaggcugaggaacucacaccugguagauuuaggacuauaguuugcgggcuguucccaacccagauucaggugcggaauaucaugagccccgucaugggagugauuggcuuuaguuucuuugugaaagauuggccugagaagauccgugaguucauggagaaagaauguccauuuaucaagccggaggucaaacccggcaccccugcccaggagguugaguuccugaagcgcaacagaguguauuuuaugacaaggcaagacguacucgauaaaaaucauguggcggacauugauaaguuaauagacuacgcagccuccggggauccaacgucucccgacgauaucaagagcccuaacgcuccaugggucuucgccugcgcacccgaccgguccccgccuacuuguauuuacguggcuggaauggccgaacugggugcguuuuucucaauccuucaggacaugcgaaauacaauaauggccaguaaaaccguuggcacugcagaagagaaguugaaacgcaagagcucuuucuaucaguccuaccugagaaggacacaaucaauggggauucagcuagaucagcggaucauccuccuguauaugcuugaauggggaaaagagaugguggaccacuuucaucugggcgaugacauggaucccgaguugcgcggucucgcucagagccugauugaccaaaaggucaaggaaaucaguaaccaggagccauuaaaaauuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16809 - RNA, 3664 nt, Artificial Sequence
  mRNA product Design1 comprising derived and/or modified sequence from PUUV(K27)__L08754.1__GP (opt3)
gggagaaagcuuaccaugggcgagcugagccccgugugccucuaccuucuguugcagggguuacugcuauguaacaccggagccgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16810 - RNA, 3649 nt, Artificial Sequence
  mRNA product Design1 comprising derived and/or modified sequence from PUUV(K27)__L08754.1__IgE-leader_Gn-Gc (opt3)
gggagaaagcuuaccauggacuggaccuggauccuguuccucguggccgcugcaacaagaguccacagcgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16811 - RNA, 1519 nt, Artificial Sequence
  mRNA product Design1 comprising derived and/or modified sequence from PUUV(K27)__L08804.1__N (opt1)
gggagaaagcuuaccaugagcgaccugaccgacauccaggaggagaucacccgccacgagcagcagcucguggucgcccggcagaagcugaaggacgccgagcgcgcgguggagguguaccccgacgacgucaucaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcgagcggcgaccccaccuccccggacgacaucaagagccccaacgcccccuggguguucgccugcgcccccgaccgcuccccgcccacgugcaucuacguggccggcauggcggagcugggggccuucuucagcauccuccaggacaugcgcaacaccaucauggccuccaagaccgucggcaccgccgaggagaagcugaagcgcaagagcuccuucuaccagagcuaccugcggcggacgcagagcauggggauccagcucgaccagcgcaucauccugcuguacaugcucgaguggggcaaggagaugguggaccacuuccaccugggcgacgacauggaccccgagcugcgggggcucgcccagucccugaucgaccagaaggucaaggagaucagcaaccaggagccccugaagaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16812 - RNA, 3664 nt, Artificial Sequence
  mRNA product Design1 comprising derived and/or modified sequence from PUUV(K27)__L08754.1__GP (opt1)
gggagaaagcuuaccaugggcgagcugagccccgugugccucuaccugcugcuccaggggcugcugcucugcaacaccggcgccgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16813 - RNA, 3649 nt, Artificial Sequence
  mRNA product Design1 comprising derived and/or modified sequence from PUUV(K27)__L08754.1__IgE-leader_Gn-Gc (opt1)
gggagaaagcuuaccauggacuggaccuggauccuguuccucguggccgccgcgacccgcguccacagcgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16814 - RNA, 1519 nt, Artificial Sequence
  mRNA product Design1 comprising derived and/or modified sequence from PUUV(K27)__L08804.1__N (opt5)
gggagaaagcuuaccaugagcgaccugaccgauauccaggaggaaauuacaagacacgagcaacagcucguggucgcccggcagaagcugaaagacgcugaacgcgccguugagguguaccccgaugacgugaucaagaacacgcuucaggcgagacaacagaccgucuccgcucuggaagauaaacucgccgacuauaagcggcgcauggccgaugcugugucucggaaaaagauggacacaaagccuaccgauccgacaggcauugagcccgacgaucaucugaaagagagaagcucccuucgcuacgggaauguucuggacgugaacgccaucgauauugaagaaccuucuggacagaccgcugacugguauacaaucggcgucuacgugaucggguucaccauucccaucauucucaaggcccuguauaugcugagcacgagaggacggcagaccguuaaagaaaauaagggcacacgcaucagauuuaaagacgauaccuccuucgaggacauuaacgggauccggcgcccuaagcaccucuacgugucuaugcccacagcgcaaagcaccaugaaggccgaggaacugacgccuggaagauuucggacaauugucugcggccuuuucccgacccagauccaggugcgcaauaucaugucccccgugaugggcgucauuggguuuagcuucuuuguuaaagauuggccugagaagaucagagaguucauggagaaagaaugucccuuuauuaagccugaggugaaacccggaacaccggcucaggagguggaguuccugaagcggaacagagucuauuuuaugacccgccaagacgugcucgauaaaaaucauguugccgacaucgauaagcugauugacuacgcugccucuggcgauccuaccucccccgacgauaucaagagcccuaacgcgcccuggguguucgccugcgcucccgaccggucuccuccgacauguaucuacgucgccgggauggcugaacuuggagccuuuuucuccauucugcaggacaugagaaauacgaucauggccagcaaaaccgugggcacagcugaagagaagcucaaacgcaagucuuccuucuaucagagcuaccugcggagaacccaauccauggggauucagcuggaucagcgcaucauucuccuguauaugcuugaauggggaaaagagaugguugaccacuuucaucugggcgaugacauggaucccgagcuccggggccuggcgcagucucuuaucgaccaaaaggugaaggaaaucagcaaccaggagccucugaaaauuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16815 - RNA, 3664 nt, Artificial Sequence
  mRNA product Design1 comprising derived and/or modified sequence from PUUV(K27)__L08754.1__GP (opt5)
gggagaaagcuuaccaugggcgagcugagccccgugugccucuaccugcuucugcaggggcuccugcuuuguaacaccggagccgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16816 - RNA, 3649 nt, Artificial Sequence
  mRNA product Design1 comprising derived and/or modified sequence from PUUV(K27)__L08754.1__IgE-leader_Gn-Gc (opt5)
gggagaaagcuuaccauggacuggaccuggauccuguuccucguggccgcugccacaagaguccacagcgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16817 - RNA, 1519 nt, Artificial Sequence
  mRNA product Design1 comprising derived and/or modified sequence from PUUV(K27)__L08804.1__N (opt11)
gggagaaagcuuaccauguccgaccucaccgacauccaagaagaaaucacccgccacgaacagcaacugguagucgcccgacaaaagcucaaagacgccgaacgcgccgucgaaguauaccccgacgacgucaucaaaaauacacuacaagccagacagcaaacagucagcgcccucgaagacaaacuagccgacuacaaaagacgcauggccgacgcagucucacgcaagaaaauggacaccaaacccacagacccaaccggaauagaacccgacgaccaccuaaaagaacgauccucccuccgcuacgguaacguacucgacgucaacgccaucgacaucgaagaaccauccggccaaacugccgacugguacacaaucggcgucuacgucauaggcuucaccauccccaucauccuaaaagcccuauacaugcucucaacccggggccggcaaacagucaaagaaaacaaaggcacccggauccgcuucaaagacgacaccuccuucgaagacauuaauggcauccgccgcccaaaacacuuauacguauccaugccaaccgcacaaucaacaaugaaagcagaagaacucaccccaggacgcuuccgcaccaucgucugcggccucuuccccacacaaauccaaguccgcaacaucaugucccccgucaugggagucaucggauucuccuucuucgucaaagacuggcccgaaaagauacgcgaguucauggaaaaagaaugccccuucaucaaacccgaagucaaacccggcacccccgcccaagaagucgaguuccucaaacgcaaccgcgucuacuucaugacccgacaagacguccucgacaaaaaccacguagccgacaucgacaaacugaucgacuacgcugccucuggcgaccccaccucacccgacgacauaaaaagccccaacgcaccaugggucuucgcaugcgccccagaccgauccccacccacuugcauauacguagccggcauggccgaacucggcgccuucuucagcauccuccaagacaugcguaacacaauaauggccuccaagaccgucggcaccgccgaagaaaagcuaaaacguaaaucaucguucuaccaauccuaccuaagacgcacacaauccaugggcauacaacuagaccaacgcaucauccuccuauacaugcucgaauggggaaaagaaauggucgaccauuuccaccuaggcgacgacauggaucccgaacugcgcggacucgcccaaagccucaucgaccagaaagucaaagaaaucuccaaccaagaaccccuaaaaaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16818 - RNA, 3664 nt, Artificial Sequence
  mRNA product Design1 comprising derived and/or modified sequence from PUUV(K27)__L08754.1__GP (opt11)
gggagaaagcuuaccaugggugagcucucaccggucugccuauaucuccuccuccagggccugcugcuuugcaacaccggagccgcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16819 - RNA, 3649 nt, Artificial Sequence
  mRNA product Design1 comprising derived and/or modified sequence from PUUV(K27)__L08754.1__IgE-leader_Gn-Gc (opt11)
gggagaaagcuuaccauggauuggacguggauacucuuucucguggccgcggccacgcgcgugcacucggcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16820 - RNA, 1684 nt, Artificial Sequence
  mRNA product Design2 comprising derived and/or modified sequence from PUUV(K27)__L08804.1__N (wt)
ggggcgcugccuacggagguggcagccaucuccuucucggcaucaagcuuaccaugagugacuugacagacauccaagaggagauaacccgccaugagcaacaacuuguuguugccagacaaaaacucaaggaugcagagagagcaguggaaguguacccggaugacguuaucaagaacacauuacaagcaagacaacaaacagugucagcacuggaggauaaacucgcagacuacaagagaagaauggcagaugcugugucccggaagaaaauggauacuaaaccuacugacccgacugggauugaaccugaugaucaucucaaggagagaucaagccuuagauauggaaauguccuugaugugaaugcuauugacauugaagaaccaaguggccagacagcagauugguauacuaucggagucuauguaauaggguucacaauuccuaucauuuugaaggcucuauauauguugucaacacguggaagacagacuguaaaggaaaacaaaggaacacggaucagguucaaggaugacacaucauuugaggauaucaauggcaucaggagaccaaaacaccuauauguauccaugccuacugcccaguccaccaugaaagcugaagaacuuacaccuggacgguuccguacaauaguauguggcuuauucccuacacagauacaaguucguaacaucaugaguccaguaaugggagugauugguuuuucuuucuucguuaaagacuggccagaaaaaauuagggaguuuauggagaaagaaugcccuuucauaaagccagaaguuaaaccugggacaccagcacaggagguagaauuuuugaaaagaaauagaguuuacuucaugacccgccaggauguucuugacaaaaaucauguggcugacaucgauaaguugauugacuaugcugccucuggugacccuacaucgccugaugacaucaaaucuccuaaugcaccauggguauuugcuugugcaccagaucggucgcccccaacauguauuuauguugcugggauggcugaauuaggugcauucuuuuccaucuuacaggauaugaggaacaccauuauggcaucuaaaacugugggcacagcagaagagaaacugaaaaggaaguccuccuucuaucaaucauauuugcgccgaacacaaucaauggggauucaacuugaucagaggauaauccuacuguacauguuggaauggggaaaagaaaugguggaucauuuccaucuuggugaugacauggauccugagcuaaggggccuugcucagucacucauagaccagaagguaaaagagauaucaaaccaagaacccuuaaagauaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16821 - RNA, 3829 nt, Artificial Sequence
  mRNA product Design2 comprising derived and/or modified sequence from PUUV(K27)__L08754.1__GP (wt)
ggggcgcugccuacggagguggcagccaucuccuucucggcaucaagcuuaccaugggagaacuuaguccaguuugucuguaucugcuucuccagggucuauuacuauguaauacaggggcugccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcuuacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacuaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16822 - RNA, 3829 nt, Artificial Sequence
  mRNA product Design2 comprising derived and/or modified sequence from PUUV(K27)__L08754.1__GP (wt)
ggggcgcugccuacggagguggcagccaucuccuucucggcaucaagcuuaccaugggagaacuuaguccaguuugucuguaucugcuucuccagggucuauuacuauguaauacaggggcugccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16823 - RNA, 3814 nt, Artificial Sequence
  mRNA product Design2 comprising derived and/or modified sequence from PUUV(K27)__L08754.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcuuacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacuaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16824 - RNA, 3814 nt, Artificial Sequence
  mRNA product Design2 comprising derived and/or modified sequence from PUUV(K27)__L08754.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcgccagaaaccuuaaugagcuuaaaauggaauguccacauacuauuagauuagggcagggucuuguuguggguucaguagaauugccaucucuuccaauacagcaggucgagacacuaaagcuggagaguucuuguaauuuugaucuacauaccaguacagcaggacaacaaucauucacaaaauggacaugggaaauuaaaggugaucuugcagagaacacacaggcaucaucaacaaguuuucaaacaaaaagcagugaagugaauuugagaggauuauguuugaucccuacuuuagugguugaaacagcagcaagaaugcgaaaaacaauagcauguuaugaccugucaugcaaucaaacagugugucagccuacugucuauuuaaugggaccuauccagacuuguauaacaacuaaaaguugucuccugaguuuaggugaucaaaggauucaaguaaauuaugaaaaaacauacuguguuucugggcagcuuguugaagguaucuguuuuaauccaauacauacaauggcacucucucaaccuagucauacauaugauauaaugaccaugaugguucgcuguuucuugguaauaaagaaagugacuucuggugacaguaugaagauugaaaagaacuuugagacucuuguucaaaaaaauggcugcacagcuaauaacuuccaaggguauuauaucugucuuauagggaguaguucagagccccuauauguuccagcauuagaugauuaucguucagcugaaguucuuucaaggauggcauuugcaccacauggugaagaucaugauauugagaaaaaugcagugagugcaaugcguauugcuggaaaggugacaggaaaggcgccaucaacagaaucaucagauacaguacaggggauugcauuuucagguaguccucuuuauacaucuacuggugucuugacaucaaaagaugauccugucuacauuugggcuccuggaaucauaauggaaggaaaccauucuauuugugaaaagaagaccuuaccccuuacauggacugguuuuauuucauugccuggagagauugaaaaaacaacacaauguacaguauuuuguacauuggcuggaccaggugcagauugugaagcauacucugaaacaggcaucuucaacauaaguucaccuacuugcucaauaaaucguguccagagauuccgugguucagaacagcaaauaaaguuugugugccagagaguggacauggauaucacuguuuacuguaaugggaugaagaaagucauucucaccaagacccuaguuauuggacaaugcauuuauacuuuuacaaguauuuucucucuaaucccugguguugcacauucccuugcuguugaauuauguguaccuggucuucaugguugggcaacuaugcuauuauuacuaacacuuuguuuuggcugggucuuaauaccaacuauaacaaugauccugcuaaagauauugauugcauucgcauacuuauguucuaaauauaacacagauucgaaauucaggaucuugauugagaaagugaaaagagaguaccagaaaacaauggguucaaugguuugugaagugugucaguaugaaugugagacugcaaaagaacuggagucacauagaaagaguuguuccauugguucaugcccuuauugucucaauccaucugaggcaacaacaucugcccuucaggcucauuuuaaaguguguaagcucacaucacgguuucaggagaauuuaagaaagucauuaacgguauaugagccuaugcaagggugcuaccggacuuuaucccucuuuagauauaggagucgguucuuugugggucuagucuggugcguguuauugguucuagaguuaauuguaugggcugccagugcugaaacacaaaauuuaaaugcagguuggacagacacagcacauggaucuggaauuauaccuaugaaaacugaucuggaauuagacuucucucuuccgucaucagcaagcuauacauauaggagacagcuacaaaacccagcaaacgaacaagagaaaaucccauuucaucugcaguuaagcaaacaagugauucaugcagagauccagcauuuaggucauuggauggaugcuacauuuaaucuuaaaacugcauuucacugcuauggcucaugugagaaguaugcuuauccuuggcagacagcagguuguuucauagaaaaagauuaugaauaugagacugguugggguuguaauccaccugauugcccagggguagggacaggcuguacugcuugugggguauaccuugauaaauuaaaaucaguuggaaagguuuucaaaauuguguccuuaagauacacaaggaaaguaugcauucaguugggcacagaacaaacauguaagacuguugauaguaaugacugucucauuaccacuucaguuaaagugugcuugauagggaccauaucaaaauuccaaccaucugacacuuugcuauuucuagguccacuacagcaggguggucugauauuuaaacaauggugcacuacaacaugccaguuuggcgaucccggggacauaaugagcacaccuacaggcaugaagugcccagaauuaaaugguucuuuuagaaagaaaugugcauuugcaacaacuccaguuugccaguuugauggaaauacaauuucaggcuauaagaggaugauugccacaaaggauucauuucaaucuuucaaugugacagaaccccauauuucuacaagugcacuugaauggauugauccugacagcucacuuagggaccauauuaauguaauugugagucgugaucuauccuuccaagaccuaagugaaacaccaugucaaauugauuuagcaacagccucuauagauggagcaugggguucaggaguugguuuuaaucugguuuguacuguuaguuuaacagaauguucugcauuucugacaucaaucaaggccugugaugcugcaauguguuauggguccaccacagccaaucuaguucgagggcaaaauaccauucauaucgucgguaagggugggcauucugguucaaaauuuauguguugucaugacacaaaauguucuagcaccggucuaguugcagcugcaccacacuuagaucgugugacaggauacaaucaggcugauagugacaaaaucuuugaugauggggcaccagaaugugguaugucauguugguuuaaaaaaucaggugaauggauucuugggguuuugaacgggaauuggaugguuguugcuguacugguaguauuacugaucuuguccauacucuuauucacauuauguuguccucguagaccuaguuacaggaaagaacauaagcccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16825 - RNA, 1684 nt, Artificial Sequence
  mRNA product Design2 comprising derived and/or modified sequence from PUUV(K27)__L08804.1__N (opt4)
ggggcgcugccuacggagguggcagccaucuccuucucggcaucaagcuuaccaugagcgaccugaccgacauccaggaggagaucaccagacacgagcagcagcuggugguggccagacagaagcugaaggacgccgagagagccguggagguguaccccgacgacgugaucaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucaagagccccaacgcccccuggguguucgccugcgcccccgacagaagcccccccaccugcaucuacguggccggcauggccgagcugggcgccuucuucagcauccugcaggacaugagaaacaccaucauggccagcaagaccgugggcaccgccgaggagaagcugaagagaaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16826 - RNA, 3829 nt, Artificial Sequence
  mRNA product Design2 comprising derived and/or modified sequence from PUUV(K27)__L08754.1__GP (opt4)
ggggcgcugccuacggagguggcagccaucuccuucucggcaucaagcuuaccaugggcgagcugagccccgugugccuguaccugcugcugcagggccugcugcugugcaacaccggcgccgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16827 - RNA, 3814 nt, Artificial Sequence
  mRNA product Design2 comprising derived and/or modified sequence from PUUV(K27)__L08754.1__IgE-leader_Gn-Gc (opt4)
ggggcgcugccuacggagguggcagccaucuccuucucggcaucaagcuuaccauggacuggaccuggauccuguuccugguggccgccgccaccagagugcacagcgccagaaaccugaacgagcugaagauggagugcccccacaccaucagacugggccagggccugguggugggcagcguggagcugcccagccugcccauccagcagguggagacccugaagcuggagagcagcugcaacuucgaccugcacaccagcaccgccggccagcagagcuucaccaaguggaccugggagaucaagggcgaccuggccgagaacacccaggccagcagcaccagcuuccagaccaagagcagcgaggugaaccugagaggccugugccugauccccacccuggugguggagaccgccgccagaaugagaaagaccaucgccugcuacgaccugagcugcaaccagaccgugugccagcccaccguguaccugaugggccccauccagaccugcaucaccaccaagagcugccugcugagccugggcgaccagagaauccaggugaacuacgagaagaccuacugcgugagcggccagcugguggagggcaucugcuucaaccccauccacaccauggcccugagccagcccagccacaccuacgacaucaugaccaugauggugagaugcuuccuggugaucaagaaggugaccagcggcgacagcaugaagaucgagaagaacuucgagacccuggugcagaagaacggcugcaccgccaacaacuuccagggcuacuacaucugccugaucggcagcagcagcgagccccuguacgugcccgcccuggacgacuacagaagcgccgaggugcugagcagaauggccuucgccccccacggcgaggaccacgacaucgagaagaacgccgugagcgccaugagaaucgccggcaaggugaccggcaaggcccccagcaccgagagcagcgacaccgugcagggcaucgccuucagcggcagcccccuguacaccagcaccggcgugcugaccagcaaggacgaccccguguacaucugggcccccggcaucaucauggagggcaaccacagcaucugcgagaagaagacccugccccugaccuggaccggcuucaucagccugcccggcgagaucgagaagaccacccagugcaccguguucugcacccuggccggccccggcgccgacugcgaggccuacagcgagaccggcaucuucaacaucagcagccccaccugcagcaucaacagagugcagagauucagaggcagcgagcagcagaucaaguucgugugccagagaguggacauggacaucaccguguacugcaacggcaugaagaaggugauccugaccaagacccuggugaucggccagugcaucuacaccuucaccagcaucuucagccugauccccggcguggcccacagccuggccguggagcugugcgugcccggccugcacggcugggccaccaugcugcugcugcugacccugugcuucggcugggugcugauccccaccaucaccaugauccugcugaagauccugaucgccuucgccuaccugugcagcaaguacaacaccgacagcaaguucagaauccugaucgagaaggugaagagagaguaccagaagaccaugggcagcauggugugcgaggugugccaguacgagugcgagaccgccaaggagcuggagagccacagaaagagcugcagcaucggcagcugccccuacugccugaaccccagcgaggccaccaccagcgcccugcaggcccacuucaaggugugcaagcugaccagcagauuccaggagaaccugagaaagagccugaccguguacgagcccaugcagggcugcuacagaacccugagccuguucagauacagaagcagauucuucgugggccugguguggugcgugcugcuggugcuggagcugaucgugugggccgccagcgccgagacccagaaccugaacgccggcuggaccgacaccgcccacggcagcggcaucauccccaugaagaccgaccuggagcuggacuucagccugcccagcagcgccagcuacaccuacagaagacagcugcagaaccccgccaacgagcaggagaagauccccuuccaccugcagcugagcaagcaggugauccacgccgagauccagcaccugggccacuggauggacgccaccuucaaccugaagaccgccuuccacugcuacggcagcugcgagaaguacgccuaccccuggcagaccgccggcugcuucaucgagaaggacuacgaguacgagaccggcuggggcugcaacccccccgacugccccggcgugggcaccggcugcaccgccugcggcguguaccuggacaagcugaagagcgugggcaagguguucaagaucgugagccugagauacaccagaaaggugugcauccagcugggcaccgagcagaccugcaagaccguggacagcaacgacugccugaucaccaccagcgugaaggugugccugaucggcaccaucagcaaguuccagcccagcgacacccugcuguuccugggcccccugcagcagggcggccugaucuucaagcaguggugcaccaccaccugccaguucggcgaccccggcgacaucaugagcacccccaccggcaugaagugccccgagcugaacggcagcuucagaaagaagugcgccuucgccaccacccccgugugccaguucgacggcaacaccaucagcggcuacaagagaaugaucgccaccaaggacagcuuccagagcuucaacgugaccgagccccacaucagcaccagcgcccuggaguggaucgaccccgacagcagccugagagaccacaucaacgugaucgugagcagagaccugagcuuccaggaccugagcgagacccccugccagaucgaccuggccaccgccagcaucgacggcgccuggggcagcggcgugggcuucaaccuggugugcaccgugagccugaccgagugcagcgccuuccugaccagcaucaaggccugcgacgccgccaugugcuacggcagcaccaccgccaaccuggugagaggccagaacaccauccacaucgugggcaagggcggccacagcggcagcaaguucaugugcugccacgacaccaagugcagcagcaccggccugguggccgccgccccccaccuggacagagugaccggcuacaaccaggccgacagcgacaagaucuucgacgacggcgcccccgagugcggcaugagcugcugguucaagaagagcggcgaguggauccugggcgugcugaacggcaacuggauggugguggccgugcugguggugcugcugauccugagcauccugcuguucacccugugcugccccagaagacccagcuacagaaaggagcacaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16828 - RNA, 1684 nt, Artificial Sequence
  mRNA product Design2 comprising derived and/or modified sequence from PUUV(K27)__L08804.1__N (opt3)
ggggcgcugccuacggagguggcagccaucuccuucucggcaucaagcuuaccaugagcgaccugaccgauauccaggaggaaauuacaagacacgagcaacagcucguggucgccaggcagaaacuuaaagacgcugaacgggcaguugagguguaccccgaugacguaauaaagaacacucugcaggcccgccaacagacgguguccgcguuggaagauaaauuagcugacuauaagcgacguauggccgaugcagucucuagaaagaagauggacaccaagccuacagauccaacuggcaucgagccggacgaucaucugaaagagaggucaagucuacgguacgggaaugugcucgacguuaacgccauugauaucgaagaacccagcggacagaccgcugacugguauacaauugguguguacgucaucggcuucaccauaccuaucauucugaaggcacuuuauaugcuguccacucgcgggagacagacagugaaagaaaauaagggaaccaggauccgguuuaaagacgauacgucuuucgaggacauuaacggcauccgccgaccaaagcacuuguacguaucgaugcccacugcccaaucaaccaugaaggcugaggaacucacaccugguagauuuaggacuauaguuugcgggcuguucccaacccagauucaggugcggaauaucaugagccccgucaugggagugauuggcuuuaguuucuuugugaaagauuggccugagaagauccgugaguucauggagaaagaauguccauuuaucaagccggaggucaaacccggcaccccugcccaggagguugaguuccugaagcgcaacagaguguauuuuaugacaaggcaagacguacucgauaaaaaucauguggcggacauugauaaguuaauagacuacgcagccuccggggauccaacgucucccgacgauaucaagagcccuaacgcuccaugggucuucgccugcgcacccgaccgguccccgccuacuuguauuuacguggcuggaauggccgaacugggugcguuuuucucaauccuucaggacaugcgaaauacaauaauggccaguaaaaccguuggcacugcagaagagaaguugaaacgcaagagcucuuucuaucaguccuaccugagaaggacacaaucaauggggauucagcuagaucagcggaucauccuccuguauaugcuugaauggggaaaagagaugguggaccacuuucaucugggcgaugacauggaucccgaguugcgcggucucgcucagagccugauugaccaaaaggucaaggaaaucaguaaccaggagccauuaaaaauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16829 - RNA, 3829 nt, Artificial Sequence
  mRNA product Design2 comprising derived and/or modified sequence from PUUV(K27)__L08754.1__GP (opt3)
ggggcgcugccuacggagguggcagccaucuccuucucggcaucaagcuuaccaugggcgagcugagccccgugugccucuaccuucuguugcagggguuacugcuauguaacaccggagccgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16830 - RNA, 3814 nt, Artificial Sequence
  mRNA product Design2 comprising derived and/or modified sequence from PUUV(K27)__L08754.1__IgE-leader_Gn-Gc (opt3)
ggggcgcugccuacggagguggcagccaucuccuucucggcaucaagcuuaccauggacuggaccuggauccuguuccucguggccgcugcaacaagaguccacagcgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16831 - RNA, 1684 nt, Artificial Sequence
  mRNA product Design2 comprising derived and/or modified sequence from PUUV(K27)__L08804.1__N (opt1)
ggggcgcugccuacggagguggcagccaucuccuucucggcaucaagcuuaccaugagcgaccugaccgacauccaggaggagaucacccgccacgagcagcagcucguggucgcccggcagaagcugaaggacgccgagcgcgcgguggagguguaccccgacgacgucaucaagaacacgcugcaggcccggcagcagaccguguccgcccucgaggacaagcuggccgacuacaagcgccggauggccgacgcggugagccgcaagaagauggacaccaagccgaccgaccccacgggcaucgagcccgacgaccaccugaaggagcgguccagccuccgcuacgggaacguccuggacgugaacgccaucgacaucgaggagcccuccggccagaccgccgacugguacaccaucgggguguacgucaucggcuucaccaucccgaucauccugaaggcccucuacaugcugagcacgcgggggcgccagaccgugaaggagaacaagggcacccggauccgcuucaaggacgacaccuccuucgaggacaucaacggcauccggcgccccaagcaccuguacgugagcaugcccacggcgcaguccaccaugaaggccgaggagcucacccccgggcgguuccgcaccaucgucugcggccuguucccgacgcagauccaggugcggaacaucaugagccccgugaugggggucaucggcuucuccuucuucgugaaggacuggcccgagaagauccgcgaguucauggagaaggagugccccuucaucaagccggaggugaagcccgggacccccgcccaggaggucgaguuccugaagcggaaccgcguguacuucaugacccggcaggacgugcucgacaagaaccacgucgccgacaucgacaagcugaucgacuacgccgcgagcggcgaccccaccuccccggacgacaucaagagccccaacgcccccuggguguucgccugcgcccccgaccgcuccccgcccacgugcaucuacguggccggcauggcggagcugggggccuucuucagcauccuccaggacaugcgcaacaccaucauggccuccaagaccgucggcaccgccgaggagaagcugaagcgcaagagcuccuucuaccagagcuaccugcggcggacgcagagcauggggauccagcucgaccagcgcaucauccugcuguacaugcucgaguggggcaaggagaugguggaccacuuccaccugggcgacgacauggaccccgagcugcgggggcucgcccagucccugaucgaccagaaggucaaggagaucagcaaccaggagccccugaagaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16832 - RNA, 3829 nt, Artificial Sequence
  mRNA product Design2 comprising derived and/or modified sequence from PUUV(K27)__L08754.1__GP (opt1)
ggggcgcugccuacggagguggcagccaucuccuucucggcaucaagcuuaccaugggcgagcugagccccgugugccucuaccugcugcuccaggggcugcugcucugcaacaccggcgccgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16833 - RNA, 3814 nt, Artificial Sequence
  mRNA product Design2 comprising derived and/or modified sequence from PUUV(K27)__L08754.1__IgE-leader_Gn-Gc (opt1)
ggggcgcugccuacggagguggcagccaucuccuucucggcaucaagcuuaccauggacuggaccuggauccuguuccucguggccgccgcgacccgcguccacagcgcccgcaaccugaacgagcugaagauggagugcccgcacaccauccggcucgggcagggccuggucgugggguccguggagcugcccagccuccccauccagcaggucgagacgcugaagcuggaguccagcugcaacuucgaccuccacaccuccaccgcgggccagcagagcuucaccaaguggacgugggagaucaagggcgaccuggccgagaacacccaggccuccagcaccuccuuccagaccaagagcuccgaggugaaccugcgcgggcucugccugauccccacgcugguggucgagaccgccgcccggaugcgcaagaccaucgcgugcuacgaccucagcugcaaccagaccgugugccagccgacgguguaccugaugggccccauccagaccugcaucaccaccaaguccugccugcucagccugggggaccagcggauccaggucaacuacgagaagacguacugcguguccggccagcugguggaggggaucugcuucaaccccauccacaccauggcccucagccagcccucccacaccuacgacaucaugaccaugaugguccgcugcuuccuggugaucaagaaggugacgagcggcgacuccaugaagaucgagaagaacuucgagacccugguccagaagaacggcugcaccgccaacaacuuccagggguacuacaucugccucaucggcagcagcuccgagccgcuguacgugcccgcccuggacgacuaccggagcgcggaggugcucucccgcauggccuucgcgccccacggggaggaccacgacaucgagaagaacgccgucagcgccaugcggaucgccggcaaggugaccggcaaggcccccuccacggagagcuccgacaccgugcaggggaucgccuucagcggcuccccgcuguacaccagcaccgggguccugacguccaaggacgaccccguguacaucugggcccccggcaucaucauggaggggaaccacagcaucugcgagaagaagacccucccccugaccuggaccggcuucaucucccugccgggcgagaucgagaagacgacccagugcaccguguucugcacccucgccgggcccggcgcggacugcgaggccuacagcgagacggggaucuucaacaucuccagcccgaccugcuccaucaaccgcguccagcgguuccgcggcagcgagcagcagaucaaguucgugugccagcgggucgacauggacaucaccguguacugcaacgggaugaagaaggugauccugaccaagacccuggucaucggccagugcaucuacacguucaccuccaucuucagccucauccccggcguggcccacagccuggccguggagcugugcguccccgggcuccacggcugggccaccaugcugcugcuccugacccugugcuucgggugggugcugauccccacgaucaccaugauccuccugaagauccugaucgcguucgccuaccucugcuccaaguacaacaccgacagcaaguuccgcauccugaucgagaaggugaagcgggaguaccagaagaccaugggcuccauggucugcgaggugugccaguacgagugcgagacggccaaggagcuggagagccaccgcaaguccugcagcaucggguccugccccuacugccucaaccccagcgaggccaccaccuccgcccugcaggcgcacuucaaggugugcaagcugaccagccgguuccaggagaaccuccgcaagucccugacggucuacgagccgaugcagggcugcuaccggacccugagccucuuccgcuaccggucccgcuucuucgugggccugguguggugcguccugcucgugcuggagcugaucgugugggccgccagcgccgagacccagaaccucaacgcgggguggaccgacacggcccacggcuccgggaucauccccaugaagaccgaccuggagcuggacuucagccuccccuccagcgccagcuacaccuaccgccggcagcugcagaaccccgccaacgagcaggagaagaucccguuccaccuccagcucuccaagcaggucauccacgccgagauccagcaccugggccacuggauggacgcgaccuucaaccugaagacggccuuccacugcuacggcagcugcgagaaguacgccuaccccuggcagaccgccgggugcuucaucgagaaggacuacgaguacgagaccggcugggggugcaacccgcccgacugccccggcguggggaccggcugcacggccugcggcguguaccucgacaagcugaaguccgucgggaagguguucaagaucgugagccugcgcuacacccggaaggucugcauccagcucggcaccgagcagaccugcaagacgguggacuccaacgacugccugaucaccaccagcgugaaggucugccugaucgggaccaucuccaaguuccagcccagcgacacgcuccuguuccugggcccccuccagcagggcgggcugaucuucaagcaguggugcaccacgaccugccaguucggcgacccgggggacaucauguccacccccaccggcaugaagugccccgagcugaacgggagcuuccgcaagaagugcgcguucgccaccacccccgugugccaguucgacggcaacaccaucuccggguacaagcggaugaucgccacgaaggacagcuuccaguccuucaacgugaccgagccgcacaucagcaccuccgcccucgaguggaucgaccccgacagcucccugcgcgaccacaucaacgucaucgugagccgggaccuguccuuccaggaccucagcgagacccccugccagaucgaccuggccacggcgagcaucgacggcgccuggggcuccggggugggcuucaaccuggucugcaccgugagccucaccgagugcuccgccuuccugaccagcaucaaggccugcgacgcggccaugugcuacggguccacgaccgccaaccuggugcgcggccagaacaccauccacaucgucgggaagggcggccacagcggguccaaguucaugugcugccacgacaccaagugcagcuccacgggccucguggccgccgcgccccaccuggaccgggugaccggguacaaccaggccgacagcgacaagaucuucgacgacggcgccccggagugcggcauguccugcugguucaagaaguccggggaguggauccugggcguccucaacgggaacuggauggugguggccguccugguggugcugcucauccugagcauccugcuguucacccugugcugcccccgccggcccagcuaccgcaaggagcacaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16834 - RNA, 1684 nt, Artificial Sequence
  mRNA product Design2 comprising derived and/or modified sequence from PUUV(K27)__L08804.1__N (opt5)
ggggcgcugccuacggagguggcagccaucuccuucucggcaucaagcuuaccaugagcgaccugaccgauauccaggaggaaauuacaagacacgagcaacagcucguggucgcccggcagaagcugaaagacgcugaacgcgccguugagguguaccccgaugacgugaucaagaacacgcuucaggcgagacaacagaccgucuccgcucuggaagauaaacucgccgacuauaagcggcgcauggccgaugcugugucucggaaaaagauggacacaaagccuaccgauccgacaggcauugagcccgacgaucaucugaaagagagaagcucccuucgcuacgggaauguucuggacgugaacgccaucgauauugaagaaccuucuggacagaccgcugacugguauacaaucggcgucuacgugaucggguucaccauucccaucauucucaaggcccuguauaugcugagcacgagaggacggcagaccguuaaagaaaauaagggcacacgcaucagauuuaaagacgauaccuccuucgaggacauuaacgggauccggcgcccuaagcaccucuacgugucuaugcccacagcgcaaagcaccaugaaggccgaggaacugacgccuggaagauuucggacaauugucugcggccuuuucccgacccagauccaggugcgcaauaucaugucccccgugaugggcgucauuggguuuagcuucuuuguuaaagauuggccugagaagaucagagaguucauggagaaagaaugucccuuuauuaagccugaggugaaacccggaacaccggcucaggagguggaguuccugaagcggaacagagucuauuuuaugacccgccaagacgugcucgauaaaaaucauguugccgacaucgauaagcugauugacuacgcugccucuggcgauccuaccucccccgacgauaucaagagcccuaacgcgcccuggguguucgccugcgcucccgaccggucuccuccgacauguaucuacgucgccgggauggcugaacuuggagccuuuuucuccauucugcaggacaugagaaauacgaucauggccagcaaaaccgugggcacagcugaagagaagcucaaacgcaagucuuccuucuaucagagcuaccugcggagaacccaauccauggggauucagcuggaucagcgcaucauucuccuguauaugcuugaauggggaaaagagaugguugaccacuuucaucugggcgaugacauggaucccgagcuccggggccuggcgcagucucuuaucgaccaaaaggugaaggaaaucagcaaccaggagccucugaaaauuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16835 - RNA, 3829 nt, Artificial Sequence
  mRNA product Design2 comprising derived and/or modified sequence from PUUV(K27)__L08754.1__GP (opt5)
ggggcgcugccuacggagguggcagccaucuccuucucggcaucaagcuuaccaugggcgagcugagccccgugugccucuaccugcuucugcaggggcuccugcuuuguaacaccggagccgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16836 - RNA, 3814 nt, Artificial Sequence
  mRNA product Design2 comprising derived and/or modified sequence from PUUV(K27)__L08754.1__IgE-leader_Gn-Gc (opt5)
ggggcgcugccuacggagguggcagccaucuccuucucggcaucaagcuuaccauggacuggaccuggauccuguuccucguggccgcugccacaagaguccacagcgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16837 - RNA, 1684 nt, Artificial Sequence
  mRNA product Design2 comprising derived and/or modified sequence from PUUV(K27)__L08804.1__N (opt11)
ggggcgcugccuacggagguggcagccaucuccuucucggcaucaagcuuaccauguccgaccucaccgacauccaagaagaaaucacccgccacgaacagcaacugguagucgcccgacaaaagcucaaagacgccgaacgcgccgucgaaguauaccccgacgacgucaucaaaaauacacuacaagccagacagcaaacagucagcgcccucgaagacaaacuagccgacuacaaaagacgcauggccgacgcagucucacgcaagaaaauggacaccaaacccacagacccaaccggaauagaacccgacgaccaccuaaaagaacgauccucccuccgcuacgguaacguacucgacgucaacgccaucgacaucgaagaaccauccggccaaacugccgacugguacacaaucggcgucuacgucauaggcuucaccauccccaucauccuaaaagcccuauacaugcucucaacccggggccggcaaacagucaaagaaaacaaaggcacccggauccgcuucaaagacgacaccuccuucgaagacauuaauggcauccgccgcccaaaacacuuauacguauccaugccaaccgcacaaucaacaaugaaagcagaagaacucaccccaggacgcuuccgcaccaucgucugcggccucuuccccacacaaauccaaguccgcaacaucaugucccccgucaugggagucaucggauucuccuucuucgucaaagacuggcccgaaaagauacgcgaguucauggaaaaagaaugccccuucaucaaacccgaagucaaacccggcacccccgcccaagaagucgaguuccucaaacgcaaccgcgucuacuucaugacccgacaagacguccucgacaaaaaccacguagccgacaucgacaaacugaucgacuacgcugccucuggcgaccccaccucacccgacgacauaaaaagccccaacgcaccaugggucuucgcaugcgccccagaccgauccccacccacuugcauauacguagccggcauggccgaacucggcgccuucuucagcauccuccaagacaugcguaacacaauaauggccuccaagaccgucggcaccgccgaagaaaagcuaaaacguaaaucaucguucuaccaauccuaccuaagacgcacacaauccaugggcauacaacuagaccaacgcaucauccuccuauacaugcucgaauggggaaaagaaauggucgaccauuuccaccuaggcgacgacauggaucccgaacugcgcggacucgcccaaagccucaucgaccagaaagucaaagaaaucuccaaccaagaaccccuaaaaaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16838 - RNA, 3829 nt, Artificial Sequence
  mRNA product Design2 comprising derived and/or modified sequence from PUUV(K27)__L08754.1__GP (opt11)
ggggcgcugccuacggagguggcagccaucuccuucucggcaucaagcuuaccaugggugagcucucaccggucugccuauaucuccuccuccagggccugcugcuuugcaacaccggagccgcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16839 - RNA, 3814 nt, Artificial Sequence
  mRNA product Design2 comprising derived and/or modified sequence from PUUV(K27)__L08754.1__IgE-leader_Gn-Gc (opt11)
ggggcgcugccuacggagguggcagccaucuccuucucggcaucaagcuuaccauggauuggacguggauacucuuucucguggccgcggccacgcgcgugcacucggcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16840 - protein, 482 aa, Artificial Sequence; identical to SEQ ID NO: 588
  derived and/or modified protein sequence (wt) from CCHFV(10200)__NC_005302.1/U88410.1__N

SEQ ID NO: 16841 - protein, 482 aa, Artificial Sequence; identical to SEQ ID NO: 589
  derived and/or modified protein sequence (wt) from CCHFV(Turkey-Kelkit06)__GQ337053.1__N

SEQ ID NO: 16842 - protein, 1684 aa, Artificial Sequence; identical to SEQ ID NO: 1171
  derived and/or modified protein sequence (wt) from CCHFV(10200)__U39455.2__GP

SEQ ID NO: 16843 - protein, 1684 aa, Artificial Sequence; identical to SEQ ID NO: 1172
  derived and/or modified protein sequence (wt) from CCHFV(IbAr10200)__AF467768.2__GP

SEQ ID NO: 16844 - protein, 1688 aa, Artificial Sequence; identical to SEQ ID NO: 1173
  derived and/or modified protein sequence (wt) from CCHFV(Turkey-Kelkit06)__GQ337054.1__GP

SEQ ID NO: 16845 - protein, 1192 aa, Artificial Sequence
  derived and/or modified protein sequence (wt) from CCHVF(10200)__U39455.2__SP-GP_Gn-NSm-Gc
MHISLMYAILCLQLCGLGETHGSHNETSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16846 - protein, 1183 aa, Artificial Sequence
  derived and/or modified protein sequence (wt) from CCHVF(10200)__U39455.2__IgE-leader_Gn-NSm-Gc
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16847 - protein, 990 aa, Artificial Sequence
  derived and/or modified protein sequence (wt) from CCHVF(10200)__U39455.2__IgE-leader_Gn-4aa-Gc
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16848 - protein, 342 aa, Artificial Sequence
  derived and/or modified protein sequence (wt) from CCHVF(10200)__U39455.2__IgE-leader_Gn
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 16849 - protein, 662 aa, Artificial Sequence
  derived and/or modified protein sequence (wt) from CCHVF(10200)__U39455.2__IgE-leader_Gc
MDWTWILFLVAAATRVHSFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16850 - RNA, 1449 nt, Artificial Sequence; identical to SEQ ID NO: 2923
  derived and/or modified CDS sequence (wt) from CCHFV(10200)__NC_005302.1/U88410.1__N

SEQ ID NO: 16851 - RNA, 1449 nt, Artificial Sequence
  derived and/or modified CDS sequence (wt) from CCHFV(10200)__NC_005302.1/U88410.1__N
auggaaaacaagaucgaggugaauaacaaagaugagaugaacaggugguuugaagaguucaaaaaaggaaauggacuuguggacaccuucacaaacuccuauuccuuuugcgagaguguucccaauuuggacagguuuguguuucagauggccagugccaccgaugaugcacagaaggacuccaucuacgcaucugcucugguggaggcaacaaaguuuugugcaccuauauaugagugcgcauggguuagcuccacuggcauuguaaaaaagggacuugaaugguucgagaaaaaugcaggaaccauuaaguccugggaugaaaguuauacugagcuaaaggucgacgucccgaaaauagagcagcuuaccgguuaccaacaagcugccuugaaguggagaaaagacauagguuuccgugucaaugccaacacagcagcucugagcaacaaaguccucgcagaauacaaagucccuggugagauugugaugucugucaaagagaugcugucagacaugauuaggagaaggaaccugauucuaaacagggguggugaugagaacccacguggcccagugagccaugagcauguagacuggugcagggaguuugucaaaggcaaauacaucauggccuucaacccaccauggggggacaucaacaagucaggccguucaggaauagcacuuguugcaacaggccuugcuaagcuggcagagacugaaggaaagggaauauuugaugaagccaaaaagacuguggaggcccucaacggguaucuggacaagcauaaggacgaaguugauagagcaagcgccgacagcaugauaacaaaccuucuuaagcauauugccaaggcacaggagcucuauaaaaauucaucugcacuucgugcacaaagcgcacagauugacacugcuuucagcucauacuauuggcuuuacaaggcuggcgugacuccugaaaccuucccgacggugucacaguuccucuuugagcuagggaaacagccaagagguaccaagaaaaugaagaaggcucugcugagcaccccaaugaagugggggaagaagcuguaugagcucuuugccgaugauucuuuccagcagaacaggauuuacaugcauccugccgugcuuacagcugguagaaucagugaaaugggagucugcuuugggacaaucccuguggccaauccugaugaugcugcccaaggaucuggacacacuaagucuauucucaaccuccguaccaacacugagaccaauaauccgugugccaaaaccaucgucaagcuauuugaaguucaaaaaacaggguucaacauucaggacauggacauaguggccucugagcacuugcuacaccaaucccuuguuggcaagcaauccccauuccagaacgccuacaacgucaagggcaaugccaccagugcuaacaucauuuaa

SEQ ID NO: 16852 - RNA, 1449 nt, Artificial Sequence; identical to SEQ ID NO: 2924
  derived and/or modified CDS sequence (wt) from CCHFV(Turkey-Kelkit06)__GQ337053.1__N

SEQ ID NO: 16853 - RNA, 1449 nt, Artificial Sequence
  derived and/or modified CDS sequence (wt) from CCHFV(Turkey-Kelkit06)__GQ337053.1__N
auggaaaacaagaucgaggugaacagcaaggaugagaugaacaaaugguuugaggaguuuaaaaagggaaauggacuuauggacacuuucacaaacuccuacuccuuuugugagaauguaccaaaucuggauaaguuuguguuccagauggccagcgccacagaugaugcacagaaggacuccaucuaugcaucggcucuaguggaagcaaccaaguucugugcacccauauaugaaugugcuugggucagcucuacuggcauugugaagaaggggcuugagugguucgagaaggauucaggaacuaucaaaucaugggaugagaacuaugcugagcugaagguugauguucccaaaauagaacaacuugccaauuaccaacaggcugcucuuaaguggaggaaggacauagguuuccgugucaacgcaaacacggcagccuuaagcaacaaaguccuugcagaauacaaagucccuggugaaauugugaugucuguuaaagaaaugcugucagacaugauuagaaggaggaaucuaauucucaacaggggcggugaugaaaauccacgcggcccagugagccgugaacauguggaguggugcagggaauuugucaaaggcaaguacaucauggcuuucaauccaccuuggggggacaucaacaaaucaggucguucgggaauagcacuuguugcaacaggccuugccaagcuggcagagaccgaggggaaaggaguuuuugacgaagcuaagaagaccguggaggcucucaauggguauuuggacaagcacagggacgaagucgacaaagcaagugcugacagcaugauaacaaaccucccuaagcacauugccaaagcacaagagcuuuauaaaaauucaucugcucugcgugcacaaggugcacagauugacaccccuuucagcucguuuuacuggcucuacaaggccggugugacuccagagaccuucccaaccaucucacaguuccuuuuugaacugggggagcagccaagggggaccaaaaaaaugaaaaaggcacuccugagcacuccaaugaagugggggaagaaacuuuaugagcucuuugcugaugacucuuuccagcagaacagaaucuacaugcacccugcuguguugacagccgguagaaucagugaaaugggugucugcuuuggaacaaucccuguugccaauccugaugaugcugcucagggaucuggacauaccaaguccauucucaaccuucggacaagcacagagaccaacaauccaugcgccaagacaauugucaaauuauuugaaauccaagaaacaggauuuaacauacaggacauggacauuguggccucugagcacuugcugcaccaauccauuguuggcaagcaaucuccauuccaaaaugccuacaacgucaagggcaaugccaccagugccaacaucaucuaa

SEQ ID NO: 16854 - RNA, 5055 nt, Artificial Sequence; identical to SEQ ID NO: 3506
  derived and/or modified CDS sequence (wt) from CCHFV(10200)__U39455.2__GP

SEQ ID NO: 16855 - RNA, 5055 nt, Artificial Sequence
  derived and/or modified CDS sequence (wt) from CCHFV(10200)__U39455.2__GP
augcauauaucauuaauguaugcaauccuuugccuacagcuguguggucugggagagacucauggaucacacaaugaaacuagacacaauaaaacagacaccaugacaacacacggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcuuuagaagauugcuuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16856 - RNA, 5055 nt, Artificial Sequence; identical to SEQ ID NO: 3507
  derived and/or modified CDS sequence (wt) from CCHFV(IbAr10200)__AF467768.2__GP

SEQ ID NO: 16857 - RNA, 5055 nt, Artificial Sequence
  derived and/or modified CDS sequence (wt) from CCHFV(IbAr10200)__AF467768.2__GP
augcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuggcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuag

SEQ ID NO: 16858 - RNA, 5067 nt, Artificial Sequence; identical to SEQ ID NO: 3508
  derived and/or modified CDS sequence (wt) from CCHFV(Turkey-Kelkit06)__GQ337054.1__GP

SEQ ID NO: 16859 - RNA, 5067 nt, Artificial Sequence
  derived and/or modified CDS sequence (wt) from CCHFV(Turkey-Kelkit06)__GQ337054.1__GP
augcccaccaacauuaugcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcugcugcaccucaccuuagaacaggacaccgaaggccugcuagaaugguguaagggaaaccuugggucaaacugugaugaugacuucuuucaaaagagaauagaagaguucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagaaccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaaucccuuggauugucagaaagcuauugcaggucucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugagagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagggcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaaccagcuuggaaaccagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccuguugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcugccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuggaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaa

SEQ ID NO: 16860 - RNA, 3579 nt, Artificial Sequence
  derived and/or modified CDS sequence (wt) from CCHVF(10200)__U39455.2__SP-GP_Gn-NSm-Gc
augcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16861 - RNA, 3579 nt, Artificial Sequence
  derived and/or modified CDS sequence (wt) from CCHVF(10200)__U39455.2__SP-GP_Gn-NSm-Gc
augcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16862 - RNA, 3552 nt, Artificial Sequence
  derived and/or modified CDS sequence (wt) from CCHVF(10200)__U39455.2__IgE-leader_Gn-NSm-Gc
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16863 - RNA, 3552 nt, Artificial Sequence
  derived and/or modified CDS sequence (wt) from CCHVF(10200)__U39455.2__IgE-leader_Gn-NSm-Gc
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16864 - RNA, 2973 nt, Artificial Sequence
  derived and/or modified CDS sequence (wt) from CCHVF(10200)__U39455.2__IgE-leader_Gn-4aa-Gc
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16865 - RNA, 2973 nt, Artificial Sequence
  derived and/or modified CDS sequence (wt) from CCHVF(10200)__U39455.2__IgE-leader_Gn-4aa-Gc
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16866 - RNA, 1029 nt, Artificial Sequence
  derived and/or modified CDS sequence (wt) from CCHVF(10200)__U39455.2__IgE-leader_Gn
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguuag

SEQ ID NO: 16867 - RNA, 1029 nt, Artificial Sequence
  derived and/or modified CDS sequence (wt) from CCHVF(10200)__U39455.2__IgE-leader_Gn
auggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguuag

SEQ ID NO: 16868 - RNA, 1989 nt, Artificial Sequence
  derived and/or modified CDS sequence (wt) from CCHVF(10200)__U39455.2__IgE-leader_Gc
auggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag
